United States Patent 12,642,819 (COMPOSITIONS AND METHODS FOR TREATING INFLAMMATORY BOWEL DISEASE) - sequence listing, part 52

SEQ ID NO: 20 - DNA, 2264685 bp, Bifidobacterium bifidum
  modified_base (310511)..(310609): a, c, t, g, unknown or other
ggcgatggtactgcacccgacagggtgtgggagagtagcacgccgccgcaccacacgacaaggacccccggacgaggacaacaacccccgggggcccttcttgtgtatgtttttgctttcttcttataaatcgagtattataaattaataacagcataggttgctgtgttgctacttcacggatataaatcctgtctctgtaactttccgttcttatcagaaaggtgcgaagatgtctaagctgcaacgctgcaggaagtggccaataagtttagtatcaacgctattgtcattcttatttttgatgagcatggtgccagtcgcgagtgcctattcttatagcaagagtcattggctcaataagaaccaggttgtaatgcttatggccacggtgaaaggcaattacttgacttcggccaagcaggctgtctccaatattaattcagcaacgaaagttggattctcgaccggaacgcggatggtttggcaggcaacttctcagaatttcggcaagaatgggtgggaaggacaatcggcctatacatttttagcgtccgggtatactaaagacgcggtttcgcgtgtaaatacctattatatgaagtcatcttacccggttgcccgcatgagagtgctttggcttcatgagttttctcattgttggggattggggcattctacgatcaatacagtgatgtacaagagtgcatctgacgcttacaacaatggtgtcagatatctcacgtcagatgatatcaaaggtattaacagtagatattgaggtgacacgatgaagaagatttcaaggattagatggctaacgacccttatggggttggtagtgttgatgtttacgtgcgcgggttgcggtcagacagcggcacaatctaatgttcccaagccggatgcttctcagtcgcgggtacgcatttatgaatccatggtagaacttgaggacgatagtcccctgattattaccggagaaatatcgagaacttccgtgattcgggatattgatgatattactgatttcacgttacttgacgtgaaggtctcgcagacgcttaagggaaccgtcaacagtggcagcattattgtacgtcagactggttccgcggagcaggggagcgcggagactctgctgcagaccggtgacgtggtcatgttgtttcttacgccgaccgatttgcctggagaacagtcatctcagtactatgtgaccggtgcgactgccggcgtataccgagtgaccgacgatacgcaacaatcgtggaacgttttgcggtctcaacatggtaacgcttctgatgcatggcagccggtatttgagcgagtcaacgtagattcgggggatgagcttccatcagagctgacacctgcgcaagtgtacgaacaggtgaaagactagccggtacgtgagtggattcgtcgaaatgacattcgatgggtccactcacgccgctatgcaatttatgggctagcgcaatgacggcagtcatctgatatcacattgtggatgcgctgtcgcgtgtctttctgagatgctgatactatgtcaggcatgacgtatctttcatgttgttgtcgctgaccgacgcctgcgggcgaacggttgacgacgcatacttgaaatacggttcattcttgatgattccccgatgtcgcatgattggcacaacaatatctgtagcaggtcatacaacgggacggcaaagaccaacaccatcatcgacgatcaccatccacctgtttcaactgcgttcaacccatctgcccggtatacgaaaccgaataacgcaccaatcgaaacgcagaaggaaacaggatccacgatgaccattcacaacagtctttccgaactcatcggcaacacgccactcgtaaagcttcatcacgtcactgacggcatcaaggcgaccatcgccgtcaaagtggagtatttcaatcccggtggatcctccaaggaccgcatcgcggagcgcatcatcgacgccgcggagcgctccggacaactcaagcccggcggtgtgatcgtcgagccgacctccggcaacaccggtgtcgggctcgcgctcgtcgcacagcagcgcggctaccgtacgatcttcacgctgcccgacaaggtctccgaatccaagcgtgccgtgctgcgcgcatacggtgccgaagtcgtcgtcacccccaccgatgcgggccccgacgacccgcggtcctactatcaggtggctgagtgcctcgccaacacgattcccggaggattccgcccgaaccagtacgacaaccccaacgggccgctgagtcactactacaccaccggccccgagatctgggaagccaccgaccacaaggtcacgcatttcgtggccggcatcggtaccggcggcacgatctcaggcaccggcaaatacctcaaggaggtttctgacggcgcggtcacggtcgtgggctccgatccggaaggctccatctactccgacccgagcgacgtgcaccaatacgacattgaaggcgtgggggaggacttctacccgaaggcgttcgaccggaacatcaccgacgatatcgtgcaggtcaccgatcgcgaggcgttcgagatgacacgtcgcctggcctcggaggaaggactgctcgtcggcggctcgtccggcatggccgtcgtcagcgccctgaaatacgcgcgtgagcacgatctggacagcaatcaggtcgtcgtcgtgctgctgccggactccggccgcagctatctggagaagatcttcaacgacgactggatgcgcgagaacggctatggcgacatcgtcgagcggacctccaagccatcacttgccgaacagtacctgtaaggcccggccaaggcccgcctgaaccgcgtccgcgaacccgaacttcaatatctcaatatcgaatcaatacaacaaactgcaatataaggaaacaaccatcatgaccatctccaccaacgccgcagccctcgtcaacaccactctcgccacccgcgccatccacgccggacaggagcctgacccgaccaccggcgccgtcgtcacgccgatctacatgacctccacgttcaagcaggacggcgtgggcggactgcgcaacggctacgattacagccggtccgtcaatcccacgcgaaacagcttcgacgcgcagctcgccgccgtcgaaggcgcgaaatacgcgctgagcttctcttccggacttgccgcgattgacgtgctgctgcgggccacgctgaagccgggcgacaacatcctgctcggcaacgacgtgtacggcggcacctaccgtctgctcgccaaggtgttcgtgccgtggggcatcgggctcgacgtggtcgacatcaccgacactgccgccgtcgccgccgcgcttgaagccaagcaataccggtacatctgggtggagacgccctccaacccgctgctcaacatcaccgacatcgccgcgaccgccgacgtcgcgcaccggcacggcaccaaggtcgtggtggacaacacgttcgcttccccggtgctgcagcatccgctcgacgacggtgccgacgcggtcgtgtattcgaccaccaagtacatcggcgggcattccgatgtggtcggcggcgcgatcgtgctcaacgacgaagaaacccgcgacgcggtcgcgttcctgcagaacgccgccggcgcggtgccatccccgttcgactcgtggctggacatccgcggcctgaagaccctggccgtgcgagtgcagcgccacagcgaaaacgcgctgaagatcgcgcaatggctggaaacccgtccggaagtggagcgcgtgtggtacccgggactggaatcccacccggggcatcagatcgcggcccgccagatgcatggtggtttcggcggcatgatctccgtgcagatcgcggccggtttcgaggcggccaagcggttcgccggcgccacgcagatcttcacgctcgccgagtcactgggcggagtggagagcctgatcgagcacccgggcgcgatgacccacgcctcagtggccggcaccacgctggaggtgcccgcgaacctggtgcgcctgtccgtcggcatcgaagacgccgacgacctgatcgccgacctggagcaggccttcgccgccatctgattcggcggcacgccgacgggcatgcatgcaaggtccggtttgcgtccataagtgcgcgcacttgtcgtttcggcgcgcacttaacgacgcttttgggacgacggagaaggaaagagaaggggagagaggcagccccgacgctgtactcgaaggagcggtggccggaatgcggtaatgttgggaggcatgacagatcaggtggcggcgctgggggcgctcaaacggtatttcggctatgactcgttccgaccggggcagtcagggctcgtcgacgcgatcctcgccgggcgcgacgtgctcggcgtgatgccgaccggcgccggaaaatccgtgtgctaccagattccggccacactgctgcccggcgtcacaatcgtcatctccccgctgatctccctgatgcgcgaccaggtcgacgcgctcaacgacgccggcatcccggccgcatacgtcaacaccacgcagggcggcgacgagcaggccatggtgctggcgcaggccgcgcaaggcgacatcaaactgctgtatgtggcccccgaacgactggaaaccgaacggttccgcaacttcgccacacgcgtgcctatctcgctggtggccgtcgacgaagcccactgcgtgtcgcaatggggacaggatttccgctcgtcgtacctcggcatcggcgagttcatcgccggcctgccggcccgcccgaccgtagccgcgttcaccgccaccgccaccgagcgcgtccgccgcgacatcatcggtatcctggggctcaacgccccgcaagtcaccgtcaccggattcgaccgggagaacctgtacttcgatgtgctcaagatcgagaccaaatacaaggcggcatgggtcgcacgatacgtagccgagcatccggacgaatccggcatcgtctactgcgccacgcgcaaggagacggaggcactcgccgcggccctcaaccacaccgtgccggcgttgcgcggagcggcgggcggcagtgcggcagattccgtcatgcgcgatggccccgtcgcggtcgcctaccacggcggaatgccggccaacgtacgcaaccaggcgcaacgcgacttcgtcaccgacgccgtgccggtagtcgtcgctaccaatgcgttcggcatgggcatcgacaagtcgaacgtccgctacgtcatccaccacaacatgccggaaagcatcgaggcatactatcaggaagccggtcgcgccggccgagacggggagccgagccgctgcacgctgctgtggaacgaatccgacatcgtcacccgtcggcgcctgctcgacatggataacgacaacgaacgactgaccccggaagagcgcgagaccgtgcgcatgagcaagcgccgtctgctggacggcatgatcggctactgccgtaccaccgactgcctgcacgtctacatgacccgctacttcggcgagaacacgtcaagaaccggcacatgcacgggcggttgcacgaattgcgacagcacgttcgaaacccttgacgtgaccgacatcgcgcggtcaatcagccgatgcgtgcacgatgccatgtacgattacgacgatcaggggcgaccggcgtgcggccccgtgcgccaaggcctcggctcggggaaaatcgtggcgatactgcgcggctccaaggccaaggacctcatcgcgcggcatcttgacaggtgcccgagctacggtcgtctgcacgatgcgcccgaagcccgaatccgcgacgtgctcagccagatggccaccgacggattcctctccatcgccgaagggcggctgccgatcgtcggcttcgggcagcgcgcggcggaaacggtcgcgcccgaattccgatatgagatcaaacgggtcgagcgcaaggccgccggcgccggaacgggcgtgacgtcacggaccgattccagttcgaaatccgcggcgtcggacggcccggcattgggctcgtacgcccccgacgacgagaacgagacgttgttccagaaactgcgcgaactgcgtctgtccatcgcccgcgagaacagcctacccccatacatggtgttcaacgatcgcacgctgcgagacatggcccgtctccgccccatcaccgacgcgcagttcctcgccgtcaacggcgtgggtgacagcaagctggccaaatacggcaagcgattcatggaggccatcgccggcttcgacgattgacagcgccgttacagcgcaccggactcgcctcgtgccgtatatgccgtatatgaggaacgcctatagccaagaatgcggcgagacgcgcgcgatagtgagacaatggtcgatggaatgccggctaacggtcgtacgcgccggcgtcatatcgagcaaaaggagtctgcgatggcagaagaaaagccgattgtcgaaagtttccagctggatcacacgaaggtcaaggcgccgtacgtgcgttacatcgacaccgagaccggccccaacggcgacgtgatctccaactatgacctgcgtctggtacagcccaacgagaacgcgattccgaccgcaggcctgcacaccatcgagcacaccatcgccgtgctgctgcgcgaacgtatccccggctacatcgactgctctccgttcggctgccgcaccggcttccacctgctgacctggggcacgcactccaccgaggatgtggcccgtgccctcaaggaatcgctggaattcatcgcatataaggccacgtgggacgacattcccgccacgaccgtcgaaagctgcggcaactaccgtgaccacagcctgttcaccgccaaggagtggtgcaaggacatcctcgccaagggcatcagctccgacccgttcgagcgcaaggtcgtctgaggctgggactggccgacacagccgtattcccggcattggtccgggttatgggatgagggcggcatcggtatcggaccggtgccgccctcatcgttgtttcgtcactacctcatgcgtcgactattccacgcggaagatgttgcgccgcggaatcagctggaccgaatcatcatacggattatcctgccacagcgtcttcactgcatcctcggcgctcgcccgcatcacgatgatgtccaacggcttgccgtcgcgctcgatcgcatgctgcattcggtcgatctcccggaagccacgttccgcgaacatgtgacgggcgcgaaggttatgagccgccacacgcaccgtgatcgtggccactcgcatgtcatgcagccggtgcagcgcgatcgtcagcgcctggctgccatacccatgcccctgatagtacggtccaaccatgatcgacagcgtcgcgtcacgctcgggatcggcaataccccaggcgctgatgcagccgacgcacagcccctcctgattgcgaatcgcatacccgaaaccggaatccgactcctcatggcaccagatgcggaaacgctcgatgttgtcctctaccggcagcggatccacctccttgcggcatccgtccgcaatcttgcagttgttccaccactgcgcgaacagcgaaaggtcatcctccgacgccggttccagcgagaccgtatacgtactcatcgcttgctctccttcgatgaatgtcatccgccctcatcataacgactcccggtaaacggcacatgcactccaatcggacgagtgcccatgatagccttacggccagttgtccaacacacgaacatgaggtgaccggtgactgacagtgcttcccagcggcgattccgacacgcgaccatgcgcgactacccgcacatgcagaagaactacgcgcgcgcccgcgagctgatggcacgcaacggcaaccccacccaatggggcgacaccttccccaaagacgacgtcgtacgcgacgacatcgcgcagcgacgcgccatgctgctcgtcgacgaagtgggcggacacgagcgcatcctcgcgcaattcgcgctatgccccggcgaagaccccacctaccatcacatcgacggcgcctggctcgacgacgattcctacgtcaccatccaccgcatcgcgtcctccggcctcgtcaagcatgccgcccgcgactgcatcgcctgggccctcaagcattacggcaacgtccgcgccgacacccaccccaacaacaaggccatgcagcacgtcctcgaaaccagcggattcgcccgctgcggcctgatacagctgcttgaccggcccaccgatacgacaaggatcgcataccagcgtcacgagtggtaacgcccggcacgaaacaacggcgcgtcgcctgcgttgctcctcagtcgccgaacgtgctcccgctggcgggagctgtcgcgcgcagcgagaccgagggtggtctgatgcactactggccgtgaagaccacccctagttgcttcgcgacagcccctgccagcgggagcacgttattccgcgtcggatgcgttcagcttggagcgcttgcggctgtaggcgaagtagacgatcagtcccaggccgaaccagaccgcgaaccgcacccaggtctcccaattgagaccggcgatcagcaccatgcagaatgcgattgccagaatcggtgtgaacggcacgcccggagcgcggaacccgcgatgcgcgtccggctgggtcctgcgcatccacatcacgccggccgacacaataatgaatgcggacagcgtaccgatgttcaccagctcgaacagcacgttgatgttgatgaagccgcccgcgaacgcggtcagcagtccgaagaaccacgtccccttgaacggggtgcggtacttgtcatgcacgtcgccgaagaacttcgggaacaggccgtcacggctcatcgcgtagcagatgcgcgactggccgtacagctgcaccagcatcaccgtggtcatgccgatcagcgcgccgaggttgacgatcaccgccagccagttcatgccggtcttcaggatcacgccggccaccggcgcgtcgatgaactgcgcgaactgctcatacggcaccacgccggtcatgatgagcgtcatcacgatgtacaggatcgtggagatgaccagcgaatacaggatgccacgcggcagcgtcctgttcgggttgacggtctcctcggccgacgacgacaccgcgtcgaagccgatgaagctgaagaacacgatcgacgcggccggcacgatgccatacggctgcgtcgaaccgggctggaactggtagatgccgtacggcgcgaacggcttccagttggacgggttgacataccagatgacgcacacgatgaacaacacgatgatcgcgagcttgatgagcaccatgatgtcgttggccttcttcgtctggttgatgccgatcgacagcacccaggtgatgagcagcacgatcacgaaaccgggaagattgaagtatgtggtcgtattggggttggtgccgtacgcggcggtcagctcgaccggcagatgcagtccgaacccttcgagcagcttgttgaaatagccgctccatccggcggacaccgtggccgcctgcagcgcgtactccagaatcaggtcccagccgatcacgaacgcgatcagttccccgaacgcgagataggcgtacgagtatgccgagccggaaaccggtgccatcgacgcgaattcggcatagcacaggccggcgaagccgcagcagaccgcggccagcaggaacgacaccatcaacgccgggccggcggtcagcgcgcccttgccggtgagtacgaagatgccggtgccgatgatcgccccgatgcccagcatcgtcaggtcgaacgtgtgcatcgtgcgtttgagcggggtggattcggcgacaagctgatccaccgatttcttgcgaaatagatccatggtcttctctcaatatatggaatggattgggctgtaccggacggcgttccgggaccccggcacgcctcaacgccgggaatctgatgcggcggcggtcgaccgcggacgccgcgaatatgcgtcgtacagcatacggcaatgcgccggacaacgccgctgccggctgaggtcggattcgtgccgtcatgcgacgcgctccggcattcgtcatcatgccgcgccacaataagagccatgactttgaacgcagcatccgaattgcagttttcatccccggctggcgaggccaactaccgggcggcgcgacgccggtaccccgcgcaggcgatcgtcgacctggccacgttgagggacaacatggcccacttggtcgatgtggtgggcggcccgcattccggcacggcggtgatgggcgtggtcaaggcggacgcctacgggcacggtctgctgccggccgcgctggcggcgctcgcgggcggcgcgacctggctgggcaccgcgcaatcgcatgaggcgctgctgctgcgcaaactcggcatcggcccggaccgctgccgcattctgacatgggtgtacaacggcatggatgtgccgttcgacgagctgatcgacaacgacatcgacatctccgtcggctcgctggcgggcatcgacgcgctcgccgacgccgcgcgccggctcggcaaacccgcacgcgtgcatgtcaaggtcgactccggcttcggccgcaacggcttcacgccggccggattcgacgcggctcttgccaagctggtgccgctcgcgcatgagggcgtgctgcacatcgtcggccagtggagccatctggcggtcgccgactcgccggatgtgcctgaattcgtcgcctccaccgaccggcagatcgaatcgttcacggaattcacccgtcgcatggaagccgcgggcatcgcgcccgaaatacgccatctggcaaacaccgcggccacgctcaaccgtcccgagattcatttcgaactgacccgtccgggcatcggcctgtacggctacgagcccgacccggcgatgggcacgccgcgtgactggcatctgaagcccgccatgacattgcaggcgcagctcggcacggtcaaggacgtggaggccgggcacggcgtctcgtacggtcgcacgtacctgacgcccgacaacaccagcaccgccatcgtgcccctcggctacgccgacggcatccaccgttccgcgtccggcttcgacatgcagggcgccaagcatgtcgagaaggccggcggtcccgtgcgtgtgatgaccagcgccggcccgcgcctgctgcacgtgtgcggtcgcgtgtgcatggaccagttcatcgtcgacctgcacgggtcggccgccgagcttggcgtccatgagggcgacaccgtggagttgttcgggcccggtcgcggtgagcaatacggcgagccgaccgccgacgactgggcgcgcgccgccgacacgattagctacgaggtgttcacctgtctgcgcaatcgcatcccgaggctctacctgcatgccgccgacgtgctgcccgccgcggacctcgccaagctcgatccggcgagcctgctgtagacccgccgcgcgtcgcgtacattgcacgcattgcgaggacggcgtgaccggctccgtccaaggaaccctttgctaaactggataccggaacgtggcgacggcaagggaggtcccatgaaatccgaggacagcggcgaacgcataccagcaggggaggggtacaccgcattcgacgagcagcgctgggcgggcgagccgccgaagtcgaaatcgcgcactgccttcgagcgcgaccgcgcccgtgtcgtgcactcgtcggcgctgcgcaggctcggcgcgaagacgcagatcctcgtcgcgggcaccgacgatttcgcccgcaccaggctcacccacacgcttgaggtcgcccagatcggacggcaggtcggagccatgctcggatgcgacccggatgtggtcgattgcgcgtgcctgtgccatgatcttggtcacccgcctttcggccataacggcgaacgggcgctcgccgacatcgccgccggcatcggcggattcgaaggcaacgcgcagacgctgcgcctgctcacccggctggagccgaaggtcttccactccgacggccggtcggccggcgtgaacctgaccagggcttcgctggacgcggccgtcaaatacccgtggaccctcgccgaagcggccaagtacgacggtggccgcggcgtgaagttctgcgtgtacccggatgacgaggacgtgttccgctggctgaagacaggagctcccgaagcccgcaaacccatggaatgccaggtcatggacctgtccgacgacatcgcctatagcgtccacgacgtcgaggacgccatagcgaccggcgcgttcaacccactggtgctcgccgacccgcgaatgatcggctgcatcatcgaggcgacgcgctcatggtacggctcgaaatgggatgccgacgagctggagcgggcgttcggaaggctgcggcggctgcgcatgttccccgaccacttcgacgggtcgcgccaggcgctggcgcaactgaagaacatcacctcggacctgatcggacgcttcgcatggtcggtggagaacgcgacccgcgacacgtacggcgacgggcctctgacccggtattcggcgaacgtggtgatccccgaggagaccagctacgaaatcgtggcgctcaagggcatcgccgtgtacttcgtgatggctcctcgcgagcacgagccgttccaccaggaggaacgccagatcatcaacgatctcatcgacgtgctcatggccgattctccgcgcccttccagtgcgctggaggccgtgctcctgcaggattgggacgaggcgacgaacgacggcgagcgcctgcgcgtcgcggtcgaccaggtggcctccctcaccgacagctccgcccttgcgttgcattcgatcctgtgacggccgcggcggcctcaggcacggctgacgttagactggtgggctatggctggaatgattctgaaggaagacgtggagaaggtgcgcgccgccgcggacctgtacgacatcgtgtccgcgagcgtgacgctgcggccttccggcaccggcacgttcgtcggcctgtgcccgttccatgacgagaagacgccgagtttctccgtgcggcctgcgctgggcgtgtggcattgtttcggctgcggtctcggcggcgacgtgttcggctacgttgagcatcaggagaacatcgatttccgcgaggcggtggagcttctcgccgataaataccatatcgagctgcattacgagaattccggtgggcgcaccgagcattccgggtcgaagcgggccaggctgatcgaggccaacgaggaggctcagcgttttttcatgtcgcagatcatgagcaaggaggctctggccgcgcgcaagctgctcggcggacgcaatttcagccgggcggactgcgagcgtttcggctgcgggtacgcgcctcaggggtgggacaatctggttcgctatcttgcgtccaaggggttcacgcagcaggagatgcttgacgccgggcttgcgaggcaggggcaacgcggcgtgtacgactatttccgcggccgcgccacatggccgattcgtgattcgaccgggcgcacgctcggctttggcgcgcgcaagctgtatgacgacgatcagatcgccgcgaagtacatcaacacgccggacacccagctgtaccgtaagacgcaggtgctgtacggcatcgacttggcgaagtcgtccatcgtgaagaagcgtcaggtcgtcatcgtcgaaggttacaccgatgtcatggcgatgcatctggccggcatcgatacggcggtggcgacctgcggcacggcgttcggcgccgagcacgcgaagatcgtgcggcggctggtcgccgatgattcgctgggcgcggtgcagctggtcggcccgctgaacgttcccgggcaggcattgagctcgcgcatcgtgttcacgttcgatggcgatgccgcggggcagaaggccgcgctgcacgcgttcggattggattcggcgttcctgtcgcagacgttcgtcgccgttgccgacgacaatctcgacccgtgcgatctgcgcatcaaccgtggcgatcaggcggtgcgctcgctgatcgagcatgcgaagccgttgtatgattttgtgatcgatgccgcgatcggccggttcgacaccacgtatgccaccgggcagatgggcgcggtgaaggccgtggcgccgctcatcgcccagattcgcgatcgttcgcagcgtgacctgtatgcacgcaaggcgacgcgccgcatcggggtggatctggacatcatgcagcgcgaggtgcgttcggcgcacggccagctgcatgtgcgcgacgaggacgcctattcgccccggcgtcgtttcggcgcgggcaacggcgagggcgcaggccagcctcgtgtcgagcccggctcggatccgtatgcgaatccggccgaacgccgggcgttggagcatcgagctgccacagagcagtcgtatttccgcatcgacgatgcggtgttcatctgcgagcagcagttcatggccacgctgattcagattccgcgtgccatcaaccgcacgatgttcgcgtcgctcaacgaggactcgttcgtcgccccagtgttccgcgcgttgttcctcgccattcaggccgcgggcggattgccgccggatgatgcgccgcaggggttgtggatgcataatctcaacaaggccggcggattgacgctgacgacggtgatcaatgagctcgcggtgctgcagctgcccctgcctccgtcagatcaggatcgggccgtcgccggatccggcgtgccgggcgctgccaatgcggcggccgtgcagctgcgtccggcgagccccgccgagacccggtacgccgccgaactgttggcccgtcttctggacatgggatacatgcggcgcatcgccgcggcgcgccggcgcatggccggcatgcccgaaggctcggaaaaactggaactgctcggcgaaatcaccaaattggagacctctcgcaaggacctgcaagcgcaggtctacggtaacaccgtcggctgagtcgagcatatttcgtcgcttgccttccgtcgcgccgcctgatgcggcgccattgcgtgtgatgcctatggcatcccgtccggtgttcagttgtgtcacggacgaacttctcgccgtgattccatcatcggctcccgcggggcggccggattccgatctggtggaaagttgggggaaaggagagtgaacaacgagttcgattacggctgatgcacgtagttctgtagtttgcgggggtggaatgggctgagcgtcacggaacgcgagccttcatggaaccttgcgtgtgttgtgcagtcttatggagccttgcggatatgcggatgatggcggtcagccgcggaactcgcggtcggcgatgatgcggccggaacggtcgagctcggtggagaatcggccgtaatcgctgaggatcacgctcatgtacagcatgtcgacggtgatgctgtgcgccacgcgcgagaagatggcgttgccgtaaatcgccatgtcgccgcgaccggtgagcagcgtcacgtcggcccagttggccagcggggtgccggtgttgttggtgacagcgatggtgtgcgcgccggcggatttggcgagtttcagcgctttcacggtgtcggcggagctgccggagtgagagaacgcgatggccgtgtcgtccttcgtcagatgccccgcgccgatctgctgcaggtaggcgtcggcgttgaaccggcattgcagtcccagataagtgagtttggtgcacaggtcgagcgccggagacatggagttctccacgccgtagatgtcgatcatcctcgattgcgccagcagcgtcgtcgccttgtgcagcgccttgccgtccatggccgaatgcagctcgtcgatgagcgtcttcgcccgggtcatggccttgcccggcacatcgtcgggattgtcccacggattgaggtcgaagccttcgagcgggtcgaaggtcaccgagcgttcctcctgcgggtggcgcagcacgtatcgcagctcacggtatccgccgaagcccagtttgcgggcgaaacggatgacggtgggctgactgacccgggagacttctgcgagctggccgaccgtcagtcccgcggcctcgtcaaggtgggaacgcacgtatcgtgcgaccgcctgttccgccgggcgcagggaaggatacacatgatcgatgcgttcgcgaacgcccaccgaggattgcacggtactatctccttgtttcggaaccagtcttgagactactgtgccgagttgaggggatgactgcctgcggttggagcgcagatgaacggaaattgaattttcggtgggggagtctccgccggcgcccgcgtcagggcatgctgtagcgcgtggcccgggatctgccgcgtttgaggaccagtccctgctcgaccagatgatgcagcacgtacgtcatctggttcttggtcgcgccgagattgtcggctatctgctggcggctcaacggcacgccggcctgtgcgatgcagtgcagggtcacttcttcgagcgtctgtccggcgttcggcggcagttgggcggttgccgcgggagatgcgatgcgtcccggcgcgatgagcggcgacgtgcgcagcgccgacccgtccgacaggcgcacggggacgcacccgatgacgcgtgtgccggccagagccacggtcggatcgctggtggccgtcgtcatgatggtggggaatgcgtacatcttcgcgtggccttgggcggcgtcgtgcccgtcggcgccttgtgcggagccgccctttgtggcgtcgccgcgcgtgcgcgatccacccggcgacggctgcgacggcaacggcagcaccatcaccaccgaggacgtgcccacgcggatctgcgggttgtcggaggcctcgtcgtattcctccatgatgcggcggatcccggtgccgtaattctcgctgaatcccagtctggtgaacagttcggccagccgggggttcctcggctggctgatgccgttgagcaggtcgttgatctcgatgccgtccatcagcccacccagtgacacgatctcgacgcggcttgggaagatgttgaccagagtcgggccggggaatgcgtagtcgcgatgcagcacggcgttgaccagcgcctcgcgcagcgcgtccggtgggcattggcggccgtcgtcgcgtctgttgtgcccgttcaggaacgtcatggcgtcattgagctgtctgatcatggagccgctcagttcgatgcgctcgctgatgggtgccttgacgtcgccgtcgaacgtcgcgcatttgatggtgaacgggcattggtcggagatgatcagcgcggtgttggtgaacatgccgcgctccttgagatgcagcgcgtcatgatccggatcccacgggatgttcgctgaggcgaatgattgctcggcgtatgagaacgtcagatgctggttcgatgagatctcatggtcgaacggaacgatgccgtgcgcgaaagagggtgtggcatagggggcggcggcgtccgggctgccgccggccgtactgccgaccgagccgtcgttcgccgcggccggcattcgtcctgtgtcattccccatagtctgatagtaacgttgcgaggagacacgctgaatcatcatcgaaaatcagcgcagttcggcgtatttggccgcattagggccttgcgggggtggaggcttggccgctatgtggtgttcgcgcgcggcctgcgcgacgttgtcggccggtttgcgtccctaagtgcgcgccgaaacgacgaccgcgcgcactttgatacgcaaacaggatcatttgcgttcctatgttcgcgtactcgtcgtttcggcgcgcacttagcgacgcaacaggagatgccggttccgtccgcggctcgtgcggggagtcgtgcagggccggccacgtccccgtagccgttgacgccgcgcgaggctacgatggagatagatgtgaggaggcgtcatgatgatggttgtttccgattccggcaaggaggccggcaccgtccgcccggccgccgtagccggcgcgttctatccggccaacgccggcgaactgcaggccatgattgaccggcagatgaaccatgcgcgcagactggtgtcgtccctcgcgccgcgtctgccgcagggggctccgaaggcggtgattgtgccgcatgccggatacgtgtactccggttcggtcgccgccctcgcctacgcgctgctggagcggacaccacattctgcccggcgtgcggggcgagcctgatcgtgcgcgactggtacgcgatactgtccgaccgcatcggacccgacggatgctgccccgactgcggcgcagtggttcccggccactggtgagggggcggcggatatgacttgccgcgccgcccgcggacacatatccctgaacgtgccgcggtgatggtacactgttctttcgttgttcggccccgtagctcagctggatagagcatgtgacttctaatctcaaggtcgacggttcgagcccgtccggggtcacggtgaagcccgttggaaccaataaggttccaacgggctttctgttccttttcgacgtccttgtgggcctgacggggcctgataagtgcggctttcagcctcggctctcgctgcggatgcgcgcggtgatgttgccgacggtcatgccataacgctcgttgagcgcgtcgagcggcacgcgatcggtgaactccttcgccgcgccgaaattcagcacgcgcatgtcgcgcagcccggcattggcgtagaaggcggtgaccttgtctccccagccgccttcgagctgtccatcctccagcgtcacgatgatgcggtggcacccggtcagctcggtcagcgtcgcggcatccagcgtggagaactgctgcggatcgatcagtgtggcatcaaggggatgccggacatccgaagccagagcctcgaccacgcgccatcccaacggcagcgtgttgcccaatgccaggaccgccacagtcgtgccgcggcgaatcgtgcggtaacgggaccacgggcaggtggctgttccatcggccgtggtcttttcgctgcacgcattactgcacgtatcgtccgcggagcccatgtccgtgacgtcctgcgcgtcgccgggcaagtcgcccgagcgctcccggttgagaatcgtgtcgcccggcacccggatgacgaccggagaggtgttgctctggctcgtcgaccaggcgagcatgtcgaggaacgcgcggccgctggtcggtgccaggcaggtcagcccggggatgttgccgaacatggcgatgtcgaatgcgcccgaatgcgtgttgtcggctccggacagtccgccgccgaagtcgagcagcgtcactggggtgccgttcagcgacagctcctgctgcaactggtcgaacgtgcgctggaagaacgtcgcggaagtggccagcaccggtcgtccgccggcccgtgcgatgcccgaggcgaacgccacggcgtgctcttcggcgatgccggtatcgacgtagtgccgtccggcccgttcccggaacgcgcgggtgatgccgttcgagcccggcgtcgcgggggagatgaccaccagtccaggttccgcggcgaaccgcggttccaatgccgccatcgccatgctcccgtaatgcttgcgcgctcccaaaggccgcccggtcgtgctgtcgggatcctgccaatggttcgcctcatgtcgtccttcgaagaccatcgagtcctcggcggcgaccgcggcgtcaccctccatgggaatcccggagtcgcgggcttccgcggattccttggcgggcggcaatcccagacccttgcgcgtgtggatgtgcacgacgaccggatgatcggtgtccttgacctgttcgaacgcctcgatcagagcgaacacgtcattgccggcctcgacataccggtagtccagtccgaacgccatgaacaggttcggcccacccctgccgccggtagcgcgcagacgggcgagcgtgccatacatgccgccgtgatcctccgcgatcgacatctcgttgtcgttcacgatgatgatgaggttgccgccctgttcggcggcgttgttcagcccctcgaacgcgatggcggaactgagcgagccatcgccgatcacggcgatcacattgcgtatgccgctgccgccgtccatgccgcccgtcaggtcacggctcttcgccaggccgcacgccagggaaatcgacgtgccggtgtgcccgagcacgaactggtcatgggcggattcggcgggattggtgaaacccgtcaccgagtcatgatgcgccgggtcgagatacgcgtcggcgcggcctgtcagcatcttatgcacgtagctttgatgcgacacgtcgaatacgatgcggtcgcgaggcgagtcgaatacgcggtgcagggcgacagtggcctcgaccatgccgaggttcgatccgatgtgcccgccgtggacatggccgtacctcaccagcgtcgtgcggatctcaccgcacagcgccggaagctccgcggcgtcgagggcatgcacgtcggctggtccgtgaatcgcactcaatatgccgacgctcatacgcatatgtcctttcctcggatgtttcaaaagcgacatgataatcgatgccgtcgcatcgggccgctggcacgagaaaatgcccccaacatctccgtatacggcaggagtcctgggaggcattgcggctccgttccgcctgtaccgtctgtcgcgtcccgctcccgttgcgcatgccgcgcccggcctccgcgcgggcgtgtgcgcgtggttgaatggtatcgacgatggatatccccgaacaaggaggggccaatgaaggccgtatttgccgcaacgatcaacaatgccgaccccttggccgcgctggaggtgggggagctgcccgagccgcagcctcgcccgttctggtccaccgtgtccgtcaaggccgcgaccgtcaaccatcatgacatctggagcctcaagggcgtggggctcgcagcggaggccacgccgatgatcctcggtaccgacgccgccggcgtgctcgacgaggacattcccgtgcgcaaggggctcaaggccggtgacgaggtcgtgctgtacaccgtgatcggcgccgatggggccggcgtgatgccgggggagcggcgcacgatcctctccgagcggtaccccggcacgatggccgcgaagacccaggtgcccagcgccaacgtgttcgccaagcccgcgaacctgacgctcgacgaggccgccgcgctcggcaccagctggctgaccgcctactcgctggtgttcgcttcggcgggcgtcaaaccgggcgacacgattctgattcagggagcaggcggcggcgtgtcgaccgctgccgttcagctcgcccacgccgccgggctggaggtgttcgtcacctcgcgcgacgagaccaagcgcgagcgtgcactggccctcggcgcggacgccgcgttcgaggccggagcgcgcctcccgcgcaaggtcgacgccgtcatcgagtcggtgggcgccgccacatgggggcattcggtgcgttccgtgcgccccggtggcacgattgcgatctgcggtgccaccaccggcgaccagccgggcgccgaactcacccgcgtgttcttccaggacatacgcgtgcagggcaacacgatgggctcgcgcgaggatttcgtccgcctgctgcgcttcgtggaacatgccgacatacacccggtgatcgactcgacgttcgggctcgccgacgcccgcgcggccttcgccaaggttctttccggcgacgtgttcggcaaggtcgtggtgaggatataggggattgtacagttgtaacggtatccaagaggaggttcttcttatgacagacagcaagcccgaagtcgccgtgatcatgggatcggccagcgactgggagacgatgaagcacgcctgcgacatgctcgaccagttcgaggtgccctacgtcaagcaggtgatctccgcccatcgcacgcccgaactgatggccgaattcgctcacggcgcccgtgtcaacggtctcaaggtcatcatcgccggtgccggcggcgccgcgcaccttcccggcatggtcgccgcccagaccacgctgccggtgatcggcgtcccggtgcgctcgcatgcgctctccggctgggattcgctgctgtccatcgtgcagatgcccggcggcattccggtggcgaccaccgccgtcggcaattccggcgcgacgaacgccggcctgctggcggtgcagatcctgagcacgaccgacaagcgtctggccgacgcgctgcaggaataccgtgacgctctcaaggagaaggtggccgaatccaatgcccagcttgtctgaggagacacatggcgcggtgaagatgctgcagcccggagcgaccatcggcatcatcggcggcggacagctcggccgcatgatggcattgagcgcgaagtacatgggcttccgcatcggcgtactcgacccgacgccggactgcccgaccgcgcaggtggccgattttcaggtcgtcggtgagtacgacgacaagaccgccatccatgatctggcggagaagtccgacgtgctcacctatgagttcgagaacgtcgacgccgaatccatcgacgaggtgcgtcacctggtcgcggccccgcagggcaccgacctgctgcgcgttacccaggaccgcatccacgagaagaccttcatcaacaggcacggcatcgagaccgcaccctggcgtgaggtcaacaccttcgaggagcttgacgccgccatcgacgacctgcattacccgtgcgtgctcaagacccgctccggcggatacgacgggcacggccagcatgtgctgcgcaatgacagcgacctggagaagattcgcgcccgtggcgaccgcggcggcggcttcccaccgtccatcctggaggggttcgtcgatttcgcgttcgaggcgtcgattctcgtgtccggcaacggcaaggattacgtcacgttcccgatcgtgcgcaacgaccaccgcaacaacatcctgcatatgacgatcgcccccgccgaggtgagcccggagatcgcgcgcaccgctcacgagatggcgctggccctggcccgcggcttcgagctggctggcacgctcgccatcgagctgttcatcaccaaggacggtcgcgtcgtcgtcaacgagctggcaccgcgcccgcacaattcggggcattacaccatcgaggcgtgctcgatcgatcagttcgacgcgcacatccgcggcatcgccggctggccgctgatccagccgaagctgctcagcccggcggtcatggtgaacgtgctcggccagcatgtcgcgcccacgagggcgctgattgccgaccatcccgagtggaacgtgcacgattacggcaaggcgcaggtgcgtcataaccgcaagatgggtcatatcaccgtgctcacggatgacactgcggcgaccgtcgaggcgttggaggccaccggctgctgggatgacctcaagtagtctccggtagttttggcggttcgggagcgaggggcgtgacgctgcggcgtccgcccctcgtttcgttgtatgtgcggcgcgctcgcatgtcgccgtgaattgcgctattatcattaatggttgttaaatgataatacttgaggagcgtgtgatggcgaacgggccggtgaggcatacgaagcagaaggatgccgtgatggcgcagcttcgcggctgtgatgatttcatttccgcgcaggagctgcatcgcaagctggtggattccggactgcgcatcggcctcgccacagtgtatcggcagttgaactcgctggtggattccggagcggcggataccgtgcgcatggatgggcagcagctgttccgcctatgcggcgatgatgcccaccatcatcatctggtgtgtcgcaaatgcggcaagacgatcgagatcgatccgccgagcgaatcctgggtgcgcaaggtggccgacgggcatgggttcacggtggagtcgcatacccttgaggtgttcggcctatgccccgattgtcagggaaaacgctgacctttccgcggattcgcccctgctggcggagggctgtcggccgcgggctgactggggtggtccggcggcgtggcactcgcgcgcggaggagccgataacgacgaatggcggcgcgaagggatgccactcggtccctccatgccgccattcgcctatatcatgcggccagttcggccttgagttccttgaggtcggcgaggatttcctcgtggcacttctcgctggtgtcgaaggcgaggtggcagaaggcgcactcgtgactttcgcggttctcgtggcaggtgtgcacgcaggccttgccctcgcactcctcggtggagccgtgctcgcagtcggagtcgtcgtagcagtcaccggtgacgcagcggccgcagcaaaagccgaccgtgctttcggcggcggggattgccgccgaaagcacggtcactgccagtagaaatagccggtgggcgcggctttggcggtgtgcagcgacgtgatcttcagcatcggcccctgccgcgtatgcccggcgatgccgtacgtgccttgtacgagcgtcgcgtcgacgctcacccagtcatgctcctgaaggtgcgcggtcttcgcatagtgcgtggtgaatccgaacggcgtcatatcgaggatgcaacaggacatgaattgccgtgacagctcgaactcatgggcgccgagcgtggacggcttgtagacgaaaccggtgagacgcacccgatagccgatgtatcgctgcggattgtggtcgatgtgggagaaccacgaaccgaattcgtcgtcgctgatggtgatggtcttgcgctcctcgtcgagcccgtggagatgagcgaatcccgccggcttgtgcgcgtcccggcgtatggcgatggcccgtcctgcggcgtacgtgtcgaaaccggtgccgttgccgggttggaacggcacggcgatgagcagcgcggggatgacgagcgcgaccaggaaacgaaacgaggatcgctcgtcggcatggaacacgccgagccacgcggcgacggacagggcgaacagcagtatcgcgccgacgatcagatacggcagcgatcggggcgtggtgagcgtgatatacgagccgctcgtagtcgaatacacgatggccgcgcccagtgccgcgaaacagatcgcctcgatacggtcgggaagcgcgggagcatgccgtgccgccggggcatgccggtcggagccgggaaagttcagagtattcgtcattgcatcacgctcccgtcgtcagatggatggcgacggcgaccaggaaacaggccgccgcgacggtcacgacaaagcggatgatgaaccgcggacggcattccgtgaccagcatcaacgtgttcttgagatccagcatcggcccgaaaagcagaaaagcgagcatggcggaagccggcaacacgccggtcatactcgcgacgatcaccgcatcggacgtggagcacagcgagcagaggaaggctatcgccatcgccgccgcaatcagcgtcacggcaccgatgccgtcgatcgtgccggagccgtcggtcagtggggacagcgcggtgcgtacgatggatgccgcaatcgtgccggacagcagaatcggcatcatgcgcatgacatcgtcgtgcgtgtgcctgaggaagtgcatgaagcgggaacgcccatcctgccccgcatgttgtacggcgcagccatcacaggccggcgtccggcccctcgtcagcggaaggtcccgtacggcgggggagcgggacgggcggacggcgaacgacaatcccacggcgctcgccaccagcatgcccagacccacgcgggccgccaccatccatggactgcccgtgaacgcgaaccacgtggaccagatcgccatcgggttcatcaccggggccgcgcacagcagcgccgtcgcgtacggcagcggcagccgcttgcgcaccagattcgcgaacgtgggcaccaccatgcaatcgcataccggcaggcacagcccgccgatcatcgccatcgccagtccgccggccagcgatttcggcacgtgccgctccaacgcatcggcgctgacgaatgtgctgaccgctgccgacatcatcgcgcccaccagcatgaacgggatcgtctgcaatatgagcccggcggcgccggtgccgatgcgcaccagcggaatcggcagaccgcgcgattcgaacatggcggacgcggcgatgaggaacgccaccagcggcgtgccgatgatgagaaaaaggtaatgcgccgaatggtcgcgtccatcggcgctgttggcgtcaatgggactgccgccatcggcgtggtgtccccgtccggtgccgtcatgaaccgtgccggtgtgatgtccccatgacattatgacgctccttgaattgccggcatgggctgtcggtatgggatgatgccgccatatcgtaccacggtgataatggttcccaatgcaaaaaggtgccgcctctcgtcttgagaagcggcaccctgcatataagtccctgctgaggccatgtcactggtcttggcggctggttcgcgtggattgacccatcacgcatcgggtcgcgggtctaccgcggcttcacgtatcccttgcgcacggccttgaccagactgtgtggcacgtgcaccacctcgccatcgggcatgtgcacggcgatcagctgcgcggcctgcgccttccattgtgacctgcgcgcatgcgtgttcgcgcgcgacgttctgactttcggcagtgccatcagccttgcctcgctttccagtgggggttcttcttgttgattacataaagatgcccgcggcggcgcacgacgtacgagccgtccttgcgcgccaacgagcgtatcgacgatttgaccttcatatcgttgctccgtttcgtgttttcgatgggtttatgcagtgttggtgggtttatgcagtgttgatgtatgggctgcgccggtcggccgaccatcctcagtctcgcttcgcgagccagctcccgccagcgggggcttccgcgtagcgggtggggatggttcgcgcattgggatgccggcattcgccggccctgtcagctccgtccgtagcgcttgttgaatttctgcacttggccggccgtgtcgagcacgacgttgcggccggtgtagaacgggtggctgtagctcgacacctccacgttgaccagggaataggtgttgccgtcctcccattcgatggtcggcaggctcgcggccttcgcgaccagcgtggaccgcgtgaggaacgcctttccggtggaccggtcgcggaataccacgtacccgtattgaggatggatgttgtctttcatatgatgatgcctttctgatgatgcgatgttggtgcgccgcgctggatcaccagctgctcttcaccacgccgggaagctccccgcggtgcgccttttccctcaggttgatacgggacagtccgaatttacggttgaaggcgcgcggtcggccgtcgatgctgtcgcggttgcgcagcctggtcgggctggcgtcgcgggggatcgcatgcagtcggcgcatcgcctcggcgcgttcgtcggcggtcaggtgcgggttgaccgagtcccttttgcactgtgcccgtcgctgcgcgtatttggcgacgatctgctcgcgttgcagttgcttgttgattttgctggtctttgccattgaggctccttgatgatggctgtgtgtcgggatgacgctcggacggccgcggttcgtgcgggccgtcggaacggattcagcgggtctcgcggaatgtgacccgcttgcgtatgaccgggtcgaacttcgtcagttccagacggtccggcgtgttgcggcggatgcgtgccagggccgcttcgatgccgatgcggtcgatggtcttcatccctttgacactgacggtcagcgtgacgtgacggccgagcgagggaacccagtaccgcttggtctgcaggttcgggttgaagcgtcggcgtgttttcctgtgcgagtgggatacgcggttgcccgttgaggcgcgcgtgcccagaatttgacattgtttggacatggatgccaatatatcataatgataatcattatcaaaaagaaaggcgatcatgattcatccgacattgcaatcacggggaaacgcgggtacggcggtggtgctgctgacgggcgccgatcggctgagtctggactccgtggcgttctccctggccgactcgtatgcgtccgtatgcgcgatctcgtacgatgtgcgcccgaatggcgaggcggatgccggtctgagcatcgtcaggcgtgtcagccgcccggtggggcagggcgtcggggtgggcgacgcggaaatcttcgatctgtcggattgttgtctgagctgctcggtcaagcacgacgcgggcgggacgctcgcctctctgcgaggtcaggcccgtgtgttcctggtgagtcttccggtgggactggaggcgacaccggtcgcccggtatctcgaagacatgatgcgccttgattcgtggggtgatggcatgggcgtcgcggccgtggtcaatgcggtcggtctggacgagttcgaggagcggttcttcgacgacgaccgtctgtgcgtgtatggcacgggtgacgaggatggcgtattcgacgagcggtcgaccggcgcggtggtgtcgcgcctgatccgggaggcgacgcatgtccttgagctgccggtggtcggccggggctgcctgtcgcggcatgtggatgccgacggcgaatgcgcgtgccgcgacatcatccgcgccgtggccaggcggggcgccgtggtggtcgaggatgcccatgaggcggacctgtgcgacatcgccggcctgtatgaagtcgagtcgtccgtcggtgcgtgatcggccgcgcgacacgcccatttgataacgataatgataataaatctcaataacgtgtatactgtgaaccgaaagaacgggagaaagcccgtcatcatccggagaggaacggaataacaaatgcagatttcatctatcatcaggcgcaccgtcgcgggtgtggcggccgcctctatgctggtggccgtcgcggcatgcggaacgagcaaggacaacaagaccgccgggggagaaggcggcggcaccatcgaagtcgtcgccagcatcaaccagtggggctccgtcgccaaggacctcggcggctcccacgtcgacgtcaccaacatcatgacgaagaccaacgtcgaagcgcacgactacgagcccaccagccaggacgtcgcgaagttcggcaccgcgaaggtcgccgtcgtgaacggtgccgactatgatccgtgggcgtccaaggccgcatccgcgacgaaggccacgctggtcaccgcagccgaaaccgccggcatcaaggaaggcgacaacccgcacgtctggttctccgccaaggtgcgcaacaacaccgccgacgccatcaccgcggcctatcagaaggccgacccgagccacaaggacgactacgccaagctcaataaggaatggcacgccaaggaggatcagctggaaagcaagatcaaggacgcctccgccaagaccaaggatgtgccgtacgccgcgaccgaatccgtcgcatggtacctcgccgacgacctgggcatgaaggacgccaccccgaccggctacgcgcaggcctccgccaacgagagcgagcccaccccgtccgacatcaaggcgttccaggacgccctcaagggcggctccatcaagatgctggtattcaacacgcaggaagctaactccaccaccgatcagatcaccggtgccgccaagagcgccaacgtcccgatcgtcgagctcaccgagcagatgccgaaggaatacaccaacctgctcgattggatgagcgccctcgtcgaccagttcgccaaggcgtgatgccggcgcgctgattttatctctatctatatctccttcaacggcggggccttcttgcgggggccccgccgcttttgcgcatggaggggcatcattccgtgaggggctcttcggagcagtctccgattgcttcgcgacgggctccggggagcgaatcatccgattcggccgggctggaatggcgtcattttcacgatgtggatgccgtttcgtctgatggatgatctggccgtcactgtgcgcgggtaccgtcaccgtgcgagggctcgcacagtgacgcgggcggtagaaacccttattttccaatgatttccgtgacgcagtcacgctgcgagggcacgcacggtgacggtacccacgcacagtgacgcttgacccgtgtaacagttgagctcgtccgcgatggaactgcgaaatcccgccggacgcatatacgggcaagatgatggacacgccggccgtatccggattcacgcggcgggtgcacgatcatcgtcatcggccgaacatgcgtcttatgggagacacgccaaaatgcgtcgcagggctgccgggaggacggttgggatggtgaaatcctgcgattgttgttttttatgcgtggcaaccctgccgtgtacacgggcgacgaccgtcacggcgattgtccgtaacccataaagggccggatggccggctaccgctgcagtgtgcgcagcatgcccatggcctccttcgccgtcagggacggcacgtaggcgcggacgaccgccagcccgatttgggccagcacggccggatcgggatagcagatgtacaccggctcctcggtcggctggaacttgcgtttgaaattgaacagcgagtggaatccgtatgcgggctccatccaatccgccacgatctgcagcgcatgctgcagcatgacggtgccggtatccatatgtccggtctcgtcggcattgtcgcgctgcgggttcatgccggccagcggcgcggcggacaggctcatgaactcgacggcgcactcggggtgctccagcccctcgtcacgcagccgctccgccatgcgcgcgatcaggaactccatgatgccgttcggactgtcggtgcgatgccgcatgaaatcaagcgtccagccgatgatgcgcccgtcgcgccacgtcggcagccagctggtcacgcctagcaccgtcccttcggcgtcgatcgcgtacaggatgcgcacgcgcgggtcgtgcagctcctcgacgccgcccagcgtgaacttcatctccggcagcgccttgagctgcgcccactgctcggagatctcctcgatctgttcgcgtatgtcgttcggggcctcgttgaaggtcgacatcacgtcgctgatgccggaacgtttcgccttgttgatggcggtgcggatgtcctgccatttcttgccggtcgtcttccattgccggggatcgaccaccatctcgctgccgacctccagcgaataccagcccatggcggcaagctggtcgcgctgctcgcgatgcacgctgtatagcacgggcgaccatgactgctgcatgctgaaacgagcgaactcgcgcaggtcggacgaccattcgccacggtcgccgaacgggcccgtggtcgtcagcgcgatgccgtggatcacccggtatgccatggccgaccgtccggtggcggagaaccagtaatggttgccctcccacgtggtcatgaagctcatcgactcgccatccagctccaccaggcggccggcgttggcgcgggcgcgtccgtcgaccagcaggatctcacgcatccatcggaccgcgacgaccagcaccacgagccagaagaccagtcccacggcctgatcgaccaccgatgcggccacggtgcgcggcaggaacgacggcctgctgcggttgaggaacccgatgggaatgaaccgtgacggcagctcatgcatcaggccatgccatgtcgccggaggccggaaatcgccggggcgcaacagtccgaagcccagatacgccgcgatgcagacggccagggcgatgacgaccgccgcgctgcctcgccgcagacgccccgcgtccgtgcggatcgggaagtggcgcatggagcaggcgacggcgatggcgaacaccatcggcaacagcacgttggcgatgctcgccggaatcgcgccgtgcagcagcagggaacgcaacccctgcggcgcgtgggacagaggcgccacgaaatagtacagcatcgcgatgcaggattcccccagcccgacgatgatgaacgcccacgcggcgagacgcctgccacgatacaggccccaggtcatgatgagcatcaccgcggtcggcagcagggaacgcaggaccgccccaggcatggacacccgcagcagattgaactggaagaagcagtcggtgcgggccatgccggcaaggcaggaggcgagcttgccgtcatcgggtgaggccgggctcataatcagtcccaatgagctcaacgggccgatatgggttggtgaggagatcgcaatgatcgggccgagcgtgagtaccagcgcgatggccgcgaacacgcgacgggtctcgtacgacgtgctcagctgccagtgcagcggatccgccgccgaagcgtcgtccagctgtcggacggtcttccgcttggatgtcagcgcgcccagtacatggccgaatcccgccgccgcgagcaggcagtagtcaccgggattaccgctgaacatcacaaccatgattatggacacatagccgatcagacggatgcgccgcctccacaggcggcgggtgaacgcgctggccgccatcatcgcgcccacgcccagcgtcagcgggctgagcgcgaaacggatgcggcccaccaccggagtgccttgcagcagttgggcgatgcctccgcacagcagcagtcccagggccgttccggcgagcgtgcagatgaaggccgccgtcagggtgcggcggcggcccagcagcgtctcggcgatggcgaacatcaccaacagcgcgatcgtgtcgacgagcagctgcaggattccgcgtgtcagcagcagcgtggccagcagatgcagcaggttgaactcctgcaggctggtgcgcaggctgcgcagaggcagtggacggccggccagcgcgaagccgatccacatggcgatgttgagccccgcgaacgtgcaggacaacgtcactgcgaggcgatgcccgtgaatccagacgctcacgtcctgcaccaaggcatgcatcctgccgtgggtacggcatttgcggcggctttctttgccgctctccggttcgactttcgtgtcgctcattgcagaacctcgattctcggatagtcggaccatgtcaggcccgtttcgcccagaccccagcggtgcgcgcacagccaggggacggccgcctctaatgtcgcgttgacggaatgccagtcatggccggtgtcaggcacgacgatcttcacgacgtgcatgccggccttgacaccggcctggccgttgacgatgacgttttttatggatctcgcgtcgcgcttgcccgcccccagaatcatgatctggttggaaggcgcgtggtcggcgatggcgttggccggcacttgagcctcataggcgctgcggtcgccgttgaaatattcggcgaccatatgctccacggatccggcggtgggcttcagctcgccgtccacggcgatgatggagccgaatatgtccgggtgccgcggtcccaactgggtggcacacgtgccaccctgcgagaacccgccgatcgcccaatcccgcgcctgccgggacacgggcagatgcgctttgatccaccgtggcacgtcgacggtcagatacgtctccgcgcgtccgaccttggtcgtgtcggcgcacaggctgttcaccgtgttgtcgccgttctggtcgggcgagatgacgatgggcgccagaccgtgatgcgccttcgcatactggtccaggatcgcggcgatgccgctggccgcgaacacgcggtccggattgcccggctgcccggcgagcatgacgagtaccggcagctctggcggtgtgtcgctcagggcggctggcggcatgtagacggccgcggtacgcgcgcggaatccggaggctgtgttggatatgtccaccgaatagaccttgccgtgcgcggcggcgggcggcagtttgccatcgagcacctcgcgcagccattcatcgacggtcagggtccccttctgcatgtgtgacgtgctgagcggatgatatgacgaatagccgatcagcgagccgatggtctgatactccccgtaaatcgagtcgatacggagcgcggtggagaccagcacgaatgggatgagcaccgcggccatcaggcgccgggcgcgccgggcgtgcacgatggtcgtcaccagcagtcccaacagcgcgcagcacgcggccgcagccatgatgacgggccagcccagcgatacgccgaataccatgaatttttcggaaagcagccacatgaccagcaggccgaagccaccgcagacaagcatgatgggcacctgcctcgccagcttggaccgatcgctcctgaagacctgccacagcagcaatatcgccactcccacgccgacaatcacccatatcgtggttggcaacgggcctgagacgagtcgtatatgcagtaacctcgtcacccaactcggcaacgattccatgcgatcatcccccttgtaagtgtcatcggttgatattacccggtatgacccggcgcctttcgtccgtctcagggatgatattgcccgatgctgtatacggggcccacttatgcggatcatgcggggctcttccgcgcggattccaacgggcggcgagtggcccatacgggtctcagactggtctcatacggggagattcagggaaatatcagtgaacgtgatgtaccattgtcgtcgtttctttactagaatgtcattcggtattcatcatggcggcgcatggccgttcccttccgcgcgtgacgcggcggaagaaccatgatgacgtgtatatggccgataacgaattgggcatgggtcggatggcgccatgcgaatcacacgaagtgcgggtatatgagcgacgaaataaacgacaagaacgatgacggtacgaacgtggccgatgccgtcagcccgtccggcgagatcgaggtgctggatatcaagcgggccgactcctcttccggcaggaacggcggcaaaggcggcagaaacggcggtcgccgtgagtataagccgttccccggctggctgtacggtgtcctgttcgtggtgttcgacatggcggcggtcgctgcgctgcagtggggcgtcagccagtccggcacgcgcgtgcagctgtccagtcccgtcgtgggctggggtttcgtgtcgaagatgtggaccaagggcaacttcgtgttcgtgctgaacctgctgctcatcggcgcgctgtatctggcgctgctcatgctgttcaaccggttctggatagccacgccggtgctgctggccgtggccatcatcgtgggcgtcatcgagcatttcaaggtgtccatacgctatgaggcgattctgccttccgacctgggcttcctcggctcgaataccggcaatctgatgagtttcacccctccgggggcccattggatcatcctcggcgcattcgcggtgttcctggtgttcgtcgcactgttcgtggtgctcaaccatgtcgatggccggcatggtcgcatgatccgtttcgacaacaaggggttggccgccggaatccgtctgatggtgttcctgctgccgtcgttgttcttcggcctgtactgtgaccaggtcagcactgtcggctcgtgggcgaacggtttttccaaggccctgggcgacactccttcgatgtgggattccgtgtatgacgcgcagcgcaacggtccgctggtctcgttcacccggcagctcaacccgacgatcatggatgagccgagcgattacagcgaggccacgatgaaggaggtcgtcaagaggtacgaggtcgccgccgagaagatcaacgcctcgcgcacgaagaacatgaccgattcgacggtggtctacgtgctgtccgaatcgttctcagaccccgcgcgcgtacccggtgtgaagctcaacaaggacgccattccggaggtccgtgccatcaaatccggcacgaccagcggtctgatgctgtcgtccggatacggtggcggcaccgcgaacttggagtatatgggattgtcgggcctgagcatggcgaatttcgactcgtctctgaccagcccgtaccagcagctggtaccggggcagcattggacgccgacgatcaaccagatgtggggggctccgaagaactccatcgccttccacccgtatgagccgtcgatgtattcgcgcgcgacgaactacaagaagttcggattcgcgcatttctacacgctgcagggcgacgacatcatcaagcatcgggacaagatcgaccgttccccgtacgtgtccgacaaggccacgtatcagagcgcgttggaggacatcagctcgaccgattcgaaccagttcatccagatcatcacgatgcagaaccatatgccgtacaacgactggtatgccgacaacgagttcaaggccaccgcggccgacggcgccgattccctcggctccgacgaagtgacggccatcgacacgtatgcgaagggcgcgagcatcaccgatacggagacgaagaacttcctcgatgagctcaacaagctcgacaagccggtgacggtcgtgttctatggcgaccatctgccgggcatctacgaaaccgccagccaggatacgaacaattcgctggcgctgcatttgacggattatttcatatggtccaacaaggcgtccggctcgcagggcaagaaggtcgacaacagcgtgtactcgtcgccgaactatttcgtggcgcagactgcggagcacatgaacgcgaaggtgtcgccgtacctggcgttcctgacgctcatgcacaagaaggtctccgccatggagccgccggtggtcaacaagatccagggatgggaccgcatccccgaggggcaggatatctatcttgacgcggcgggcaacccgatggccgaggacgagttcgacgagcagaccaagcagctgatgaccgattacaagctcatccagtacgacatcacggccggcaaaaactatctgaaagacaccgacttcatggatctgccgtaaggcctcacaaaatagcaattgcccccgctactagcgggggcaatttcataggcatgccatacacggctttttaccgcctgaagtgagttgtgtggtgcagatgcaaggcgcggaatgcgacgacgtacgatggtacttcgagcgctccgcaacgcagcagatgcgccgcacaactcacttcagcgctttggcaccgatgtcgtggcggtaaaacattccctccgtgtccagcttgtcgatgattgcgtagaccttgtcttgggcggacttgaggtcgggggcggtggtttcgacgaggaggacgcgtccggaggaggcgacgaggccttggtcgctgttggagacgccggcgtagtagacgtgggaggcgtcgtcgacggggatggaggggattttggcacccttgatgacgttgacggggtagccgttggaggcgaggacgacgccgagggtggcgttgttgctgtcccaggtgaaggcgggggtgccgccgtcgaggatggcgctgatggctgctccgagatcgctggtgagcttggggaggacgacttcggtttcggggtcgccgaagcgggcgttgaattcgatgaccttggggccgtcggcggtggcgatgaggccggcgtagaggatgccggtgaagggggtgccttcggcggccatggcttcgacggtggggcgcacgatggtgtcgatagcggtgtcgatgacgtcctggccgatctggggaacggggctgtaggcgcccatgccgccggtgttgggtccttcgtcgttgtcgtaggcgcgcttgtggtcctgggagatgggcatgggccagaattcggtgccgcggacgaagctcatgagggagaattcctggccttcgaggaagtcttcgatgacgaccttggcgccggccttgccgaagcggtggtcgatgaagatgtcgtcgagagcggtgatggcggtgtcgacgtccatggcgacggtgacacccttgccggcggcgagtccgtcggccttgacgacgatgggggcgccgtgttcgcgcacgtaggcgacggagtcttcgaggttgtcgaaggtgcggtattgggcggtggggatgttgtggcgggccatcagctgcttggcgaagtctttggagccttcgatctgggcggcggccttgttggggccgaaggccttgatgccggccgcggcgaagtcgtcgacgagtccttcgatcagggggacttcagggccgacgaacgcccagtcgtactggttgtgctgcatgaagctgatgaaggcggcgtggtttgattcgttgatttgggtggtgcggatgccgtccagttccatgccggggttgccggaggcgacggtgacttcgctgacgctgtcgccgcgcagcagcgcgtgcgcgatggcgtgttcgcgtgcgcccgagccgatgaccaagactttctgacccatgatgtgtcctttcttcaggccccgctggcggggctgtccgttgcagacggactggggggggggcgtgccggccacccccggattcgcttgtgaccgcactccccatcagtggggagtgcgggagtggatgcttacttcagcgtgatctgcgtgccgtcggtgtcggggacgatcgtgccgatcgcatatccggcttcgccgttgtccttgagcagggcgagcgtctcgtcggcgcgttcggcggagacggcgagcaccatgccgatgcccatgttgaagatgttgtacatctccttgtggtcgatgtcgccggcgcgttccaggacgtcgaagatgggaaggacgggccaggatccgagcgtgatgtcggcggcgaggccgtcggggatcatacgggggatgttctcgatgaaaccgccgccggtgatgtgggcgacgcccttgacgacgcctgccttgaacaggggcttgagtgtcttgacgtagatcttggtcggggtgagcagcacgtcgccgagcttggctccgccgagttcggggagcatggtgtcgacggtatagccggcctgctcgaacagggccttgcgcacgagggagaagccgttggagtgcacgccggtggatggcagtccgatgagcacgtcgccggcggtgatgccggagccgtcgacgatggcggacttttcggccacgccgaccgcgaatccggccagatcgtattcgtcttcgtcatacatgccgggcatttcggcggtctcgccgccgatcagaccggcttcggactgcacgcatccgtcggccacgccggagacgacctgttcgagcagcgccggatcgttcttgccgcaggcgatgtagtcgaggaagaacagcggctcggcgccttgggcggcgatgtcgttgacgcacatggccacgcagtcgacgccgatggtgtcgtgcttgtcgaccatcttggcgacgacgagcttggtgccgacgccgtcggtgccggagatcagcacgggctccttgtagccgagggacgcgaggtcgaacaggccgccgaagccgccgatgccgccgacgacgccgggacggttggtgcgggcgacgtgcgatttgatgcgcttgacgacctcgtagccggcttccacgctgacaccggcgttttcatatgcttgtggcatgacgtacctttcttggatgatgcttgttgggttgtgtcgggattgggattggtctgtggtgctggaacgcctttattgctgcgtcggcgcggtggtgtactcgttgccttcgtacttgctcttgtagagcgcgaattcgggcagacggacacggtcctcgggggtgagggacttgaggaagtcggtctcgtagtcgtcgagcgcggtcgggtagtcgccgttgaagtaggcgacgcacagtccgccgtagggtgcctgcgcgttgaggccgatggattcgaccaagccgtcgagcgacaggaaggcgagggagtcggcgccgatgaagtcgcggatctcctcgacggatttcttcgcggcgatcagctccttggtggtggagatgtcgatgccgtagaagcacgggtatttgagcggcggcgagctgatgcgcatgtgcacttcggcggcgccggcttccttgagcagctggacgatgcgcttggacgtggttccgcgcacgatcgaatcgtcgatgacgatgacgcgcttgccgcgcacgacaccgcggacggcggacagtttcatgcgcacgccctgctcgcgcagctcctgcgtgggctggatgaaggtgcgggccacgtactggttcttgatcaggcccatttcgttgggcaggtgcgcggcctcggcgtaaccggacgcggcggacagcgacgagttgggcacgccgatgaccatgtcggcgtcgaccggggattcctcggccaggcgcgcgcccatgcgcttgcgggcggagtgcacgttcacgccgtagatgttggagtccgggcgggcgaagtagatgtattccatggagcagatggccagctgcgtcttgttggtgtactgcacgatcttgtagccgtggtcgttgaccacgatgatctctccggggcggatgttgcgtaccagttcggcgccgacgacgtcgagagcgcaggtctcggaggcgagcacgtaggcgccgttcttcatcttgccgagggacagcggtcggaagccgttcgggtcgagcgcgccgatcatcgcgtcctcggtcatgatgaggtaggcgaacccgccgtgcacggtgttgagcgcctccttgagcttgtccatgaaggtcggcttggaggagcggcggatcaggtgcatgagcacttcggtgtcggagttggagtggaagatcgcgccttcgtcctccagcttgcgacgcaacgacacgcagttggtgaggtttccgttgtgccccagcgccacgtcgccgtcgtggaaccggaagatgaacggctggatgttgtcggtggtgcccgatccggcggtggcataacgcacgtggccgatcgccttgtcgccggtgagccgtccgatctcgcgctcgtcgccgaacacctgggtcagcagtccgaggccgcggtgcccgatgagatggccgtggtcgttggagacgatgccggcgccttcctgaccgcggtgttgcagtgcgtggagtccgaaatacgtcaggcgggcggcgtccgggtggccccatacgccgaagatgccgcattcttcgtgaatgtcttcgagttcagctgacaagccaaagctccttccaaaacatgggggacaggggattcgctacctatccacagtaccaatcggcggctacatccgcgctcgggggtgtggcagatgggcctcatgggcggcgacatactatcgaacatatgtctcataatgattgtactctgaaacgaaagcgcgaaagggggtggtgacgatggttcggggcgagcatgtgtatcttgccatagacctgaagtctttttacgcttccgtggagtgtcacgaccgtggtctcgacccgctgcgcacgcatctggtggtggcggatgaggagcgtacggacaagaccatctgcctggccgtgtctccttcgctgaaggcgtatggcattcccggacgcgcacgtttgttcgaggttcggcagcgcttggcatcggtgaacgccgagcgggcgatgctggctcctggtggacggctgtccggtgaatcctgtgattctcgggatcttgaacattccccgagattgaaggcgtcgatggtgatcgccaagccgcgaatggcgcattatctggaggtgagcggcagggtgtacggcgtgtacctgcgatatgccgcgcccgagcacatccatgtctattcgatcgatgaggtgttcatcgatgccacgccctatctgcgcgcgctgggcatgggcccgcacgagatggcgagggccatcgtgcgtgacattctcgcgcagacgggcatcaccgccacggccggcatcggcaccaacatgtatctggcgaaggtggcgatggacatcgtggccaagcacatgcccgccgatgaggatggcgttcgtgtggcggagcttgacgagatgtcgtatcggcgactgctatggaaccatcgtccgcttacggatttctggcgggtcggtcgcggctatgcccggaagcttgagcatgccggcctgctgaccatgggggatgtcgcccgatgctcgatcggccgggcctccgactactacaacgaggatctgctctaccgcatgttcggcaggaatgccgaactactcatcgaccatgcgtggggctgggagccgtgcacgatcgcggacatccaatcgtatgagccggatgcgcacagcatcagcagtgggcaggtgctcaccgggcccgccgactatgccacgggacggctcatcgtcaaggagatggcggacgcgctcgccttggatcttgtcggcaagcgggtgctgacgaatcgtctgacgctcgcggtcggctacgacatcggcagccttgactcgaccaaactggattcctgcgcggattcggcgatgaaacgggcctccgatcaggcgggcaagagctatcgcgggccggtgtccgtcgaccggtatgggcggcgggtccccaagccggccaccgggtcgatcggactgggggagttcacctcgtcttccactcgcatccgtgaggcgatgacgatgctgtacgagcgcatcgtggatccgcgtctgttggtgcgccggctcaccgtcatcgccgatgatgtggccacggcgaatgagcttgcggccggcaaacgctacgagcagcttgatctgttttcccggatcgattcgtccgcggaggagggggacgatggccatgtcggcatttcgaacagtgatgtgcggcgtgagcatgacatgcagactgcattgctggaggtcaagaggaaattcggccgcaatgccgtcatcaaggcgatggacatggaggacggcgccaccggccaggaccgcaatcggcagatcggaggccatcgtgcatgagcatatcgagcgtattgcgctatcgggcgtgaaaaggagtccatatggcattacatgagacgcataaatatgacgacatcatcgatatgccgcatcacgtgtcgcgcaggcatccgcagatgtcccgtcatcagcgggccgcccagttcatgccgttcgccgcgttgaccggctacgagcgggtcatcgaacaggccgcatgcgatgtcgaggctgccgtggcccgggccgacgccgccggcgacaccgatttcggcgcctgaaacggggctttacccaaagctgatattcacccgcgtcacgagcgatgcaaggataatggaatagtcatccacatggtcataggaggttcatcatgatcgatcacatcggactgttcgtcgccgacgccgccaagcgcgccgatttctacgagaagctgctggcgccgctgggctatgtcaagaaggccgcatacccgactgcggtatgcttcgccaacgacgaggacggcgatggcatctggctggaatcgccgaaggacggcaatccggtcgtgccgtcacacgtcgcgttccgcgccaagaccgccgacgccatcaaggcgttccatgaggcgggtctcgcggccggcggcaccgacaacggcaagcccggtccgcgcccgaactacgggccgggctactatgccgcgttcgtccatgatcccgatggcaacaacatcgaggccatgctcaacgactatcaggcgtgatccgacggttccggccggaatcatgccggtcaatggtgctgatgctccggcgcgcgcagtcgatgaaatcatcgaccgcgctccaccggtagtcgcaggcggatatgccgaagctgatcgcgtatgaggttcccggcccgcagccacgggagcgaatccggctcggcggaacagcatgtcgccgatgcgtccgtcgatgtcctgcggattgcccggcaggaacgggcagcgctccaaggatgacaggtcaccggcgccgatggcggtctcatccggcggcgtcccgccgccggcgagatccagtcacagcgagttcgcgatgaccaacaccatacgttcctgatagaaatccaccagctccacgccggtcggcatgccggtgaagtccgccaccgccacatcgagattgccgtccgccagccaatgccgcaattgatcgttgcgtccatcagttgtgctccggcgcatatcattcggctgaggctgacgattcgcggcgccgttcctgtatctcatcccggtctgccggttgggcgcgtcgattgcccgtcgccgccgtccacgccgcgatcgcgtcagagaccagtgaccgtttcatccgccatttcaagagcgcctgcgctctggaaggccagtcggtaggcgtcgataagcgccggcagccgcatcgaggcgttggccggactggtggaggggagcggagtcatgccgatggtgatgccggttgcggccagtcgtggttcgatgagtctgcgatagagttgcgccgacttcgctccggtggtgaatatgcgagcgatcggcgcatcgcgcagcaggggcgtcagatcgttcggcgtggcgttgcggatgctggcgtcgctggccccggtgatgtcgcaggactcgatgacatcccacaaggcgatatggtggcgcatcgcgaatgcgcggcgggattgcagcgagtcgccggtgacatcagacggatccgccgggtcggcgaacaacgcctgcatcaccggccagaagcgattctgcgggtgcatatagtagaatgccgccttccgcgatttcggactgggcatcgaccccagtatcagaatccgcgattcgctgtcccacaccgggccgaacccatgctccacatgctcgctcatatcccacattgtacgttccccgccaatcacggctccggccttcgcccctttccaccgggcagccaaatcggtggcaaagcgcatgatgcgcgcccctgtattcgacgagtcttgtgcagacagcgttatcttcgactcgtcaccactgccgttcacggttgctgtcaggacatcgtcgctgtcgtaacgagtgaatgtcgttttcatttcggtgtcatttgcttcgcgtagtgagaatgcggcgccgcatgacaacatggatcggacggcttcgtgcaatttcgcgggagatactgggaaatcgaacttctcggtgatgtcattgtcgttcccttcttatgcggctcgtgttgatgccgaccggtgcatgatggttcggcaacgttgccagcacaaggatcataaccaagctcagatatagcattatgtcgcaatatttacgttataattattgtgttgctgattgtgcatcgctaatgtgttgcataatcggtgagaaccagctcgaattcagtcgacgactgatgtctcgtcgcggttttgcccatacattttgtagacgtatgccagaactggattgcatcagatgccacatgaattgagatgacgagagtatgaaagagaaaaggtgaaaaatgcgcgcacgcgtcgacaaagatggctcatcattcaagatgagcctgaaagcaacaatcattctggcggtcgtcgtcgccgtcatctttatgttcgccggaggatggattcgtggtgccatcaccaagttcttcaatcctcaacaggaattgaccaatgaagtcgtcgttaagcagctggagaagatccaggatcttaccacggctaaggaaacggattacggcttcgagaaatacgaagacggtggtattgcgttcctgaacaagaagcagttcacgatgttctacacatacgaggtgcgcgcgggggtcgatctggccaaggcccagataaaaatcgacaaggactccaaaacagtgtctatcacgctacctgcaccgaaaatccagtcggtggccgtcaatccagattcactgcgtttctttgacaagtctgattccttctttaacgcagcggatgtagaggacactaaagctgcgatggaagacgccaagaaaaagaccgaagctcggctagaccgaacacaactgctgaaaattgccaataaacaggctaaagatgtcatcgagcgcttgtatgagcctactgccgaagccgaaatgtacacggtgaccgtgacgacgaccaatcccaagtgattgatacccgatgactaagcacttcgtgcacagtatcacgtgcacggtcacaacccgtcatcaaacatgatacgagaacacaggaaagaaaggtgacaatatgggagatatagcacaaggccaacaggtctcgaagaagctccccgccaagcagctcattccgtatgtgctgttggtggtcggcgcagtggcgatggcggtgtcgttcttcctgccgttcgcctcagcaaagggcgattatgcagaatacctgaagcagtatggtgatcgggtatacaccgcggaagccggtctacacaacaaggatgtggtggggctgtcgctgctgacattcctgcgcatctacatcgcgggtctccagtccgggaagctgctcggcggcatgtacctggaagctgtcatatgcattacgctcatggcggtcatcgcggtgtcttcgctgcttattctgctgttcggagtgttgaagaagccgatcgcggccatcgtattctcggtgcttgctgtagtcgctttctatgcactgcgttgggattttgacgatcgtggcgtactgccttcctcgcagtatggatacggaatcgctgagtatatctatccgatttcgtttgtcgtggttgtcgccggggcgatttggttcatggtcagccgtcacatcgcgaagaccgtgcatcagcaactggccaacaacactactaacagcactcctgttaacagcgctcctgtggcgaacggtgcggcggtcgcagaacctgtcgcgccctcaaaggccgagtaattcataccgccgcgtatcgcgcggaggccatacttcatcaacaacagactggggcgggaacccgagaaggttcccgccccagtctgctatcagtcagtcatcaccgtcacgcggcgaagtacccgacgccggcctcgaagatcggctggtacttgtcgccgggcacattgacgtacaggccgttgccggagcgctccgagtgacccatcttgccgaagacgcggccgtccgggctggtgatgccctcgatggcgagcagcgagccgttcgggttcacggtcaggtccatgccgggcacgccggcctcgtccacgtactgcgtggcgatctgtccgttggccttgagcaggtcaagcaccggttcggcggcgacgaagcggccttcaccatgcgagatggccacggtgtgcacgtcgcccacggccgtgcgcgacagccacggcgacaggttcgacgcgacacgagtgcgcaccagacggctctggtgacggccgatcgtgttgaacgtcagcgtcgggcattcggcggtcatcggcacgatgtcgccatacggaaccagacccagcttgatgagcgcctggaagccgttgcagatgccgagcatcaggccatcgcggttcttgagcaggtcgcgcacggcctcggtgaccgcgggcgcgcggaagaacgcggtgatgaacttcgcggagccgtccggctcgtcgccgcccgagaatccgccggggatcatcacgatctggctcttgttgatctcgtccaccagcgcctgcgtcgattcggcgacggcggccggcgtcaggttgttgacgatcagcgtggtcacgtccgcgcccgcacgctcgaaggcggcggcggaatcatactcgcagttgttgccggggaacaccggaatcacgacgtgcggcttggcgacgccggcgcccgtgtacacggtcttcttcggcgcgtcgaatgtgatggtttcgacgctcttgccggcttcgtcgctcttggaacggtatgggaacacggattcgataccggactcccacgcctcctgcacgttcgccagatccagcgtctcgcccgccgccttgaacacgtactcggcggtggtggtgccgatctcgccgacctcgaccaggttggaggccacccggattttctcgttgtccgccagctcgatgatgaacgagccgtatgcaggcttgaacaggtcgtccgcggcgatgctctcgttgagcgtcaggccgatgcggttaccaagcgtcatcttgaacagcgcctcggcagtcgcgccgtagcccggcgtggagacggccaacgcgatgtgatgcgacgggtcggtaagctcctcgaccagcgagaacgcctcaagcagcgcattcttgtccggggtcaggccgtcggccaggtaacgcggcgcgatacgcacgatgcggtggccggcacccttgaactcgggggaggtggcgcgcttcatgctgcctacggccacggcgaaggagatcagcgtcggaggcacgtcgaggttctcgaacgaaccggacatggaatccttgccgccgatcgcgccggcgccgaggtcgacctgcgctatcagcgcaccaagcacggcggccgttggcttgccccagcgttccggctcgtcgcgcagcttctcgaagtactcctggaagctcaggtacgccttctcgtgttcgaaaccggccgcgaccagcttcgacagcgactcgacgaccgacaggtatgcgccggtgaactggttcttcgacatgatgtacgggttgaagccccacgccatggccgaagcggtcgtggtctcgccgaacacagggagcttggcgaccatggcctcgttcggggtgagctgcttgcgtccaccgaacggcatgagcacggttccggctccgatcgtcgaatcgaaacgttcggacagacccttgttcgatgccacgttgaggtcggtgacgaccgcgttcatgcggtcggccagcgagccttcgcgccacgaggcgggcacctcgtacgcctcctgctcctcgacgcgcacgacctgatgcttggaggcgccgttggacgccaggaactcgcggctcaggttcacgatcttgtcgccgttccaggtcatcaccatgcgcgggtcctcggtcacggtggcgatcaccgtggcttcgaggttctcctcgcgggcgtaccccaggaactcgtcgacgtccttggctgccacgtccacggccatgcgctcctgcgattcggaaatcgccagctcggtgccgtcaagtccctcgtacttcttcggaacggtgttgaggtccacgtacagaccgtcggccagctcgccgaccgccacggacacgccgccggcaccgaagtcgttgcagcgcttgatgagtcggcaggcgtcgccgcggcggaacaggcgctgcagcttgcgctcgacgggcgcgttgcccttctgcacttcggcgccgtcgagttccagcgactccacgttgtgagccttcgacgaaccggtggcgccgccgatgccgtcacggccggtgcgaccgccgagcaggatgatcctgtcgccgggggccggggtctcacggcgcacatggtcggccggggtggcggccacgaccgcgcccacctccatgcgcttggccacatagccggggtggtagatctcgtcgacctggccggtggcgagcccgatctggttgccgtacgagctgtagccggaggccgcggtggtcacgagcttgcgctggggcagcttgccttcaagcgtttcggagaccggcacggtcggatcggcggcaccggtgacgcgcatcgcctgatacacgtaggaacggcccgacagggggtcgcggatgcatccgccgatgcaggtggccgcgccaccgaacggctcgatttctgtggggtggttgtgcgtctcgttcttgaacaggaacagccagtcctcgtcctcgccgttgacgtcgaccttcaccttgacggtgcaggcgttgatctcctcggactcgtcgagaccggtgaggatgccgttcttcttgagccacttcgcgccgatcgtgcccatatccatcaggcacacgggcttggcgtcgcggccgagctcgtgacgcatctccagatagcgttcgaaagcggccttgaccgcggcgtcgtcgatgtcgaccttgtccagttcggtgccgaacgtggtgtggcggcagtggtcggaccagtaggtatcgatcaccttgatctcggtgatcgtgggctcgcgtccctcttcggagaagtacttctggcagaactcaagatcggccagatccatggcgagcccgcgctcgtcgatgaacttctggccggcagcggcgtccatctcgttgaagccggcgatggtctcgaccttgccgggggtgggcacctgggtcttcagcgtggtcttggcttccagcgacgcctcgcgggcctcgacagggttgatcacgtaatgcttgatggcatcgacgtcggcctcgctgagcgtgccttcgagcgcgtacaccttggcggagcgcacggtcggacgctcaccctgcgagatcagctggatgcactctgcggcggagtcggcgcgctggtcgaactgtccgggcaggaactcggtggcgaacaccgtcgcgtcgccgaagtcaggcaggttcgcggaggcgtcatccacctgcggctcgctgaacacggtaggcgtggcctgttcgaagagctcctgggagatgccctcgacgtcatagcggttgacgatgcgcaccttgcgcaggccatcgatgccgaggatggtcttcagttcggtgccgagctgctgggcttccacgtcgaagccgggcttcttttccacgtacacgcgaaaaaccatgggaatcctttcttaagaagttattcaaaaaatgaagaggcgtggtgaaagaacttggctcccctctggaggggagccaacattatgttctgctacttgcgcttggatgaattactcggtgacctcgatgccctcggacttggcgagctcggcaagtcgctcctcgatctcctcgtaggcggggatgatgctgcccaggccgcggcggaacaggtccttgtcaaggtgctcgaccttgccggagtgatccttctgatcccacaggcggcaggaatccggggtgatttcgtcagcgagcagcagcgtgccgtcggacgcgcggcccatctcgatcttgaagtccaccagcttgacgtcgatcttggcgaagatctcgatcagggcctcgttgatcttgcgggcgagcggcgcgatctcggcgaggtcctggcgggtgcacacgcccagggcgaccagatcgtcgtcgttgacgaacggatcatgcaggtcatcgttcttaatgaagtattcgagcaccggctccttgaggggcagaccttcctccacgcctagacgggagcagaagtggccggccgcgacgttgcgcagcacgatctccagcgggaacatgttcaccttgcgcaccagctggccggtcgcgttcacgcgcttgatcaggtggctgtcgatgccgcgcttcttgagcaggtcgaagatgatcgtggtgatgaggttgttcagtcggcctttgccggtgaagtcctccttcttctcgccgtcgccggccgtggcggtgttcttgtattcgacccacaggacctccgggtcgtcggtcgcgtacagctgcttggctttgccctcgtagagcttttccaatttctccataatcgccttccaaatcatgcttgaggagcggaatttctgggtgaactaacggtaaaagaataccaatgggcggctacatgcgcagcgctaacacgctcgctgcggctgctatccgcgcatgatcccacctgtaccgtccgaaacgggactttgacgggatgaaggaggcctatggctgtgtacttggtcgcgcgtttggctgtgtgttcagctgcgtgttatccggcgaaagtcccattggagttgaaccggatgggactttcgccggatagagatgaaagatgtaccgcggtcttcgtgtggcgctagcgcacggtgatggtcagcgcatcggcgacatcggcggccttgcgccgcgcgtcaccggcgtccgtcccgatggccagcgacacggccatgcggcggtgtccatgcactcgcggcttggcgaagatccgcaggtcggtgccgggttcggccagcgcattctccactccggtgaattccgcctcgccgtcgccggcgaccacgatggcgtggctcgcggcggtctgcccgtcgcccatcgccagcgccacatgcccttcggtgacgggcaggccgaggatcgcccgcgcgtgcagcgcgaactcgctcagcctctgggagatcagcgtcaccatgcccgtgtcatgcgggcggggggagacctcgttgaacaggatcgatccatcggtcagtacgaacagctccacgccgaacacgccccatccggtttcgcccgatgccgtggccttgtcgaccagcccctgcaccgcggtacaggcgatggcacgcgccctttccagcacctcgccatcggccgccgcgggctgccaggattcccggtagtcaccgctttcctgcctctgcccgataggcgcgcacgtgaccacgccggccgacgagctcaccgtcagcaccgtcagctcataatccagcggcgccaacgcctcgacgatcacgcgcgacacgtcgccctcgtcggcggcgcgccgaccctcctgcgcctcgacccatgcggcgtcgatcgcgtccgccccgcgcacgaccgactgcccatgcccggacgagctcatcaccggcttgaccacgcacgggtacccgacctcccgcgccccggcgcgcagctcctccaacgacccggcgaaacggtacggcgtggtcggcagccccagatcctcgtgcgcgagcacgcgcagccgctcgcgatccatgcagatggcggcgatttcggcgctcggcaccacctggacgccgcgcgccgcggcatccgacagctcgccggtcgcgatcgcctcgacctccggcacgatgatgtcggggcgcacctcgtcgaacagcgcgcgcagccgggccgcgtcggccatatccagcacgcgtgcctcgttcgccacctgctgggcgggcgcaccggtgtacgagtcggccgcgcacacccatgcgccgagacgcatcagctcgatggtgacctccttgccgagctcacccgagccgaggaacagcacgcgggtgggatgtgcccccagcggcgtgcccagcgggcgatgggaggggagggaacttgcaaaagcgctggtttcagtcatggtctcattgtgccaccggggggataccgtatttcgacgtttcgacgccgtgtcttaatgtaatgccaatatagtatacataatcaggagccgtaaaaatcatggatgatacctgtgcggttccgtctgcggcgtgaggacggcatagaggtcgccttccttgccgcgcctgtcataatcgacaacccctgagggaaggaagcaccatgagtcgtgctggatatcataggagagcgtataggagagcggccggggggggtgacggcggccttagtggcggctctcatatgcctggcgccgttgttctccacgaacaccgcgcaggcggccggaggagacgtcgtctcggtcgccgattacggggccgccgccgatagcggcgaagacagcgcccccgcaatcatcaaggcggtcgacaaagccaaggaactcgccgccgaaggcaagaacgtcaccatcgcgttccccaaggggcgctacgacatctatcccgacaaggccgagcggcgcaccctgtacgtatcgaacaccgtcggcacgaactcgtcctacaaggacaagaagatcggcatcctgcttgaggacacgaagaacatcaccgtcgacggccagggttcggatttcgtgttccacggcaagatgacgacgttcgcggccatcaacagccagaacgtgacgttcaagaacttcagcgtggacttccaggtgccgacggtcatcgacctgaccgtcgaaaaggtggatgcgggcgccaagaccgcgaccgtgtacgtgcccgaggaatacaactacaggctgtcgggctcgaacatcgaatggtattccgattccagcccgtacaccggcgccacgtactggacggcaagcaacgccctgccgtacgtgcagctctatgacacgaagaccggactgaccgtgcgcggcgacgtatggaccaaccccatattccagaacgtcaccggcatcaccgacgccggcaaccaccggctggtcttctcgtactcgtcgatgagcgacaagctcgccaacgccacgggcatcagctatcagatgcgacagaccacgcgagaccacccgggcgtgttcctgtggaaggacaaggacgtcacgctcaagggcatcgacttccgcttcctgcacggcttcggcgtggtcggccagtcgaccgacaccatcacgatggacgggctgcacttcggtaccggcgaaggcaccggccgcagcaccgcaggatacgccgacttcgtgcagatgtcgggctgcaggggcgtcatcaccgttgcgaactccagcttctccaacccgcatgacgacccgatcaacgtgcatggcaccttcctgcaggtggtggagaagatctccgacaccaagatcaaggtgcgctacatgcacaacgagaccgctggattcccgtcgttcttcgtcggcgaccaggtcgagttcatgaccaagggcgacatgctcccggtctccgactccgtgcgcaccgtcaccgccgtcgacgggcccgacggccagggcggtgacatgggcgcggggtcgggcagcctgaccgacatcgtcctcacgctcgacagcgccatcccctccgccgtcgcggtcaacagccacgtggtggagaacatcacgtacacgcccgaggtcaacatccacgacaatgtcttcaaggagacgccgacccgcggcatcctggtcaccacccgcaagaaggtgaccatcgagaacaacctgttcgacggcatgggcatggccggcatctacatctccaacgatgcgcagagctggtacgaatccggcccgacccgcgacgtgacgatccgcggcaacacgttccgccgcagcggatccgacgcgatcctggtggagccgacgaacccgaccgtgtccaccaccgacaccgtgcacaagaacatgacgatcgaaggcaacaccttctacgtcaatggcaaccgggtgctcaacgcgaagagcgtcagcgacctgaccttccgcgacaacaagatctaccgtgagaaccccgacgatacggtcacgctgggcggcgacgcggacgtggcgctcgccgttggagacacccgccgaatcgatgcgaccgcgtcggtgagccaggtgtcgggatcgcgcctgttccgtctcaacggatgcaagcaggtcgtgttcggcggcaacacgtacgacgtcggcgtcaaggccggtatcgacctggccaatatgggtgcctccgaggtgaacgtcagcgacgattcggccaaggtcggcgcggacggtctcgtccccgtcaccggcagcatcgcgtacgtgtccgacgacgcggcggtcgcctcggtcgaccaggacggcacgatcaccgcggtcggcgaaggcgagacaacggtccgcacctacgtcatcgccggcgcccggcgtatgcccggctccgtcgtcaacgtacgggtgagcgcctcgaccgccacggcgccgacccccggcacgtccgccgacccgctggacgggcacccgtcctcggtggccacgctgtcgtccgccaccatcgacggcctgtccaagtcgttcgacttcaagccgggcacgctgtactacttcggcgcggactcggccctcaccgcacgcgcggcgttcaaggcgacggatgccgatgccagcgtcaaggcgacgttgaacggcaaggccatcgacgccgcgggcgccgacgtgaagctggcgcgtggccgcaacgtcatcgaagccacggtcaccgcgaccgacggcatcaccgccaacacctaccgtttcgtgatcgaccgcattggcggcgttgacacgggtctggcagcgctgtcggtcggtggcaacgccatctcggtggagcacggacgcctgcagtatacggcgtcgacgatgcgctccaagacgcaggtcgtcgcctcgtccttcgacccgactgccacattgcagctgatgcgggtgaacggctcgaagagggtcccagtcggcgatgcgcagcagggaagcctcacccgggacgtcaccgtataccagggcgacaacacgttcgagctggacgtcacgtccggcggcagcaccgtctcctataaggttgccgtgaccggcacggacagcgtctacgcctccgatctggcgtgggagtcggccacgtccggcgaccccaacaccaacccggtgcgcaaggacaagagctgcggcaacaacacgatcacgctgtgggacggcgagaaggagcagacgttcgacaagggcatcggcacccacgcggcctcgcgcatcgtgtacgacgtgtccgatctcggggcgatccgcttcgaggcgtacgtcggcgtggaccgcgagctgaccggcgtcgaccgcgaccacgcaaatgtcgacttccaggtgatgatcgatggtgaggtcgtcttcgagaagacggcgatgcagcacgacacgccgatggcgaaggtctccgtcgacatccccgaaggcgccaagaccatcacgctggccgtcggcgcgggcagcgagacgtggggcgatcacgcggattgggcggacgcccggttcgtcggcgatgagatgccggaggcgcctcaggtcaccggcctcgccgtcaccggcgagggagtcaaggacggcaagctggacatgaccgtcggccagagcgttggtctcggtgtcacggtcacccccgaggatgccgtcgaccagtcggtcacgtggacggtcgcaggtgacgcggtcagcgtcggcgaggacggcacggtgaaggcgctgaaggccggtacggccacagtcaccgtcgcatccgtcgcggtgccgtcggtgacggcctcggtgacggtcacggtggcggagaaagccgatcccgacccggatccgaagcctgatcctgaacccgatcctgacccgacgccgaagcctgatcctgacccggatcccaacccgaatccgggtccgggcgacgagccgggtacgacgactccgggcgacggccagaagccgaacaccgacaaggatgccgacaagaacgccggcaaggacaagaaccagtccatcgccgcgaccggcgcctcgatcgtgccggtcggcgtgctcgcggtctcgatgatggccgccggctgcgcgctgacggggcgcaagaggcgcgagtcctgacggcaaaccgttctccgggcacgtatcgcacggctcgaggaacggcgtgtcggtaaatgatgccgacgtccggacatcctccggacgtcggcatcgttcgtcatgataggcggtcatggatttcccgtatgaccggacgcttgcgtcggcaatccgcccgcgtgacaatagttcttaccgggcggttaacccgcgccgggccaacgttcagggggggggaggccgagtacattgcgtcaacgaggacgcggccatggagacatgcggcgaaggcatgcggccggccaccgtgcgcgtctcggtcgtgattcgcgagactgcgagataggatgaaacaatgcgagacaacaagaacgaagaaccgcgcccccaggacaggtcggctttggatcgccccctgaccatcgtgctggtcatggacaccatcggcaacaagggcaacggcacgtcgaactccgcattgcagtatgcgcacgaattggagcggcagggtcaccatgtcagactcgtcggcatcggcgcccccgaatatccggcacgggtcaacaaggtgccgctggtctcctgggtggccgccaaacaacagatgcagttcgccaagccaagcgatacgctgttccgcgcggcgttcgccggagcggatgtcgtgcatctgtatctgccgttcaagttcgggcggtgcgcgtacaaggtcgcgcggagcatgggtattcccgtgaccgcgggattccacctccagccggagaatgtcatgtattcggccggtccgctgaaatacctgcctgggatgtcgggttttctgtacgccctgttccgcttctggctgtaccggcgcatcggccatatccacgcgcccaccgaaatgatcgccggacagttgcgcgcgcacgggtacaaggcgaagctgcacgtgatatcaaacggctacgtgccgcggttcacccccaaacggcagcgttcggacggagcccccgcgccggtgccgttccgcatcgtcgcctcggggcgtctttcccatgagaaggaccagatcacgttgatcaaggcgatttctcgctgccgtcacgcgaaggacatcgaactgatcatctgcggaaccgggccgttgcagcattacctgcggttccgcgccgaccggcttctggagcgcaaggcgcaaatcgggttccacaagaacgccgagatgccggcgctgctgcgctcatgtgacctgttcgtgcatccgtcgatcgtggacatcgaatcgttgagcgtcatcgagggcatggcgtcggggctggtgcctgtgatcgcatccgccgagttgagcgcggcgagccagttcgcgttgttggacgagtccctgttcccggctcgcgacgtggcgatgctcgcccggcgcatcgattggtggatcgatcatccgcacgagctggccgtttggggcggacggtatgccgaacacgcgaaggccgattattcggtcgaggcgtcggtcgcgaagttcgtcgccatggagcgcgaggccatcgccgacgcgaaggcctaggcccggcgtcggcctcgcggctgttcacagcaacgcgatgagctggtcaacctgctcgtcggtcgtcgcccagctggtgcacaggcgcatcaccgtatgctcgttgtcggccttctccatgaagcccatgcgtacatgggcctgcagccgttcgatggtcggatggtccaaggtgacgaagacctggttcgtcggcgcctcgaaggtcagtgtgtagccgcgctcgcgcagcgcctcgcggatccggtccgcctgccggttcgcgttggctgcgatgcgcaggtacaggtcatcggtgaacagcgtgccgaactgaagcccgagcagccaacctttggccagcaatgcgccgtgctgcttgatctgcgtgagaaaatgcttcggcgtattgcccttggtgaagatgacggcttcgccgaacagcgcgccgaccttggtgcctccgatgtagaacacgtcggcgatgcgggcgaggtccggcagcgtcacgtcggtgccggcggcggtcagtccgtagccgagtcgtgcgccgtccacgaacagcggcatgccgtgccggtgggcggtctcggcgatgacctcaagctcggccttgccgtagatcgtgccgtactcggtggggtgcgagatgtagaccagtccggggaacaccatgtgctcgtggttgtcgtcggcatagaaggtggcgcaatagtcgtcgagctcggcggcgtcgagcttgcccgcgtgatgggggagcgtgatcaccttgtggccggtcgactcgatggcgccggcctcgtgcacgttcggatggccggaatcaacggtgacgacgccctcgtacggggcgagcatggtgtcgatcacgatctggttggtctgcgtgccgccgacgaggaaccacacgtcggcgtcgggtgcctcgcatgcttcgcggatcctgcgcttggcatcttcgcaggccgcgtcgctgccgtatccggggaacgccgtgtcgttggtccgcgcgagacggtcgaggatctcggggcaggccccataggaataatcgtttccgaaagacagcatgtcggctccttgtcgcgctgtgtcgtggtgcggatgcatcagggtatgtagcgagtgtaccgcgcatgggtcatgtacggccgcgtgacgcaggccgcgttccgcagaccgcgcgccataaacaagggcgccggatgtggatcagcatccggcgcccttgcgaaaggagtctcttctgttatgaaaggtgtggtcacgttgcagcagagccggcattgtgccgcttcctcgtcaactgcggccgtagctgcgttgccggctctgcggattctctgcctcttcgctgttgtactcttcccgtctgcggctcacaactaccgcggatatctcaggctgagctgctcagcgtaatacgctccacactgtgtcaccgaacgatgatgtcgttgccgtatggcgatgtcttctgatggcgtactcatcatcgtgtcgcttcgcactgcttcgcttgcgtgctgcattgtttctgtttgcctcggtatttaattatcgtgaagacgttgcgctactgctttgtgcgcttcattgcaatcaacaggattcccctgatgataacaactccggccttcgtgtttcattatacctatggaaacgaacaagttcaagtttgaaagccgtaaaaacataatgtttgcaggtgttttcatgtgcccaaaaaatcgcacagaagtgaacatatcgcccgtctgtcgaggtggaaacgcacaaaatcgcgcagtgaatgatactgggcggctgcgcgacacgccgcggtgacgcggcttgatatttcgtgtatagtatccctctgttgcggtaatccagttcgctggaatgactcacatggtggatatagctcagttggtagagcatctgattgtggttcagaaggtcgcgcgttcaagccgcgttatccaccccactgaaaaccctcccatgcggagggttttcgtttatctgcctgtcttgtctgccgtcacgacaagcgtgtcgttgtccgcggtggaagtaatatagatacttgtgtgtgccagtggtgcgccttatgtgataggagcacgcgctgggatatcccggatcttgattggatcgcgcgcagcaatgcggactgtgaaagagatacgggccatcgggccggtggactgtggctgcttatgacgattcatggtcgtgggcgtgggctgcagtgcggcggcttcacgaaaaggaagaaaccactgaatcggagaattcaagttgcctactattgaacagctcgtccgtaagggacgtcaggcaaagccgaagaagtcgaagactttggctctgaagggcagcccgctgcgccgcggcgtgtgcacccgtgtctacaccaccaccccgaagaagccgaactcggctctgcgtaaggtcgctcgtgtgcgcctgtcctcgggcatcgaagtcaccgcctacatcccgggcgaaggccacaatctgcaggagcactccatcgtgctcgtgcgcggcggccgtgtcaaggatctgccgggtgtgcgttaccacatcgtgcgtggcgcgctcgatacccagggtgtcaaggaccgcaagcagggtcgttccctgtacggagcaaagaaggcgaagtaagagaaatgtcacgtaaaggacctgctaagaagcaccagctgctgcccgatccgatctacggctcgaccgtcgtggcccagctcatcaacaagattctgcttgacggcaagaagtcgatcgccgaggacatcgtgtactccgcgctcgacatggtcaaggagaagaccgaccaggagccggtcgccgttctcaagcgtgctcttgacaacatccgtccgtccctcgaggtgcgttcccgccgtgtcggtggcgccacctaccaggtgccggtcgaggtcaagcccgcccgcgccaacacgctgtcgctgcgctggctgaccgacttctcccgcgcccgtcgcgagaagacgatggccgagcgtctcgccaacgagatcctcgacgcctccaacggcctcggtgcttctgtcaagcgccgcgaggatactcataagatggcagaggccaacaaggccttcgctcactaccgctggtaatttcgagatcgagagcaaggaacagcaatggcactagacgtgcttacggatctgcgcatgatccgcaacatcggcatcatggcacacatcgatgccggtaagaccaccaccaccgagcgcatcctcttctacaccggcaagaactacaagatcggtgagacccacgacggcgcttcgacgatggacttcatggctcaggagcaggagcgcggcatcaccatccagtccgccgccaccacctgcttctggaaccgtcagtcccacgacaccaaggaaaagttccagatcaacatcatcgacacccccggccacgtggacttcacggccgaggttgagcgctccctgcgcgtgctcgatggcgccgtcgccgtcttcgacggcaaggaaggcgtggagccccagtccgagaccgtgtggcgtcaggccgacaagtacggcgtgccgcgcatctgcttcatcaacaagatggacaagctcggtgccgacttctacttctcggtgcagaccatcaaggacaagctcggagccaagccgctcgtcgtgcagctgccgatcggcgctgagaacgacttcgccggcgtcgtcgacttgatccgcatgaaggcgtacgtctggaacgacgtctccaccgatcagggtgcccactacgacaccgtcgacatccccgccgacctgcaggacaaggccgaggaataccgcgctcagctgctggacgacgtcgccgaggccagcgacgagctgaccgagaagtaccttgagtccggcgaactgaccgaggacgagatccgcgccggtatccgcaagctcaccatcgagcgcaaggcgtacccggttctgtgcggttccgcgttcaaggacaagggcgtgcagccgatgctcgatgccgtcatcgacttcctgccgtctcccaaggacgttccgtccatcaagggcttcaagccgggcgacgagtccgtcgagatcgaccgcaagccgctgacctccgacccgttcgcggccctggtcttcaagatctcgacccacccgttctacggcaagctcgtgttcgtgcgcgtctactccggtgccgtcaagcccggcgacaacgtgctcgactccaccaagggcaagaaggagcgcatcggcaagatcttccagatgcacgccgacaaggagaacccggtcgacgccgccgaagccggcaacatctacacgttcgtcggtctgaagaacgtgtccaccggtgacaccctgtgcgacgagaaggccccgatctcccttgaatccatgaccttcccggatcccgtcatccaggtggccgtggagccgaagaccaaggccgaccaggagaagatgggcatcgccctcgcgaagctctccgacgaggatccgaccttccaggtcaccaccgacgaagagtccggccagaccctgatcgcaggtatgggcgagctccagctcgacatcatcgtcgaccgtatgcgccgcgagttcaaggtcgagtgcaacgtcggcaagccgcaggtcgcctaccgcgagaccatccgcaagcccgtgctcaacgaggtctacacccacaagaagcagaccggtggttccggccagttcgcaaaggtgttcatgaacttcgagcccctcgacaccgaggccggcgagaccttcgagttcgagaacaaggttactggtggccacatcagcgccgagttcatcggacccatcgaggccggtgtcaaggaagccatggaatccggcgtgctcgccggcttcccggtggtcggcgtcaaggccacggtctacgacggccagatgcacccggtcgactcctcggaaatggccttcaaaatcgccggttcgatggcgttcaaggaagccgctcccaaggcgaagcccgtcatcctggaaccgatcatggccgtcgaagtccgtactccggaggagtacatgggcgacgtcatcggcgatctgaaccagcgtcgtggtaacatccagtccatgaccgatgccaccggcgtcaaggtcatcgacgccaaggtcccgctgtccgagatgttcggctacatcggcgaccttcgttccaagacccagggccgcgccatgttcaccatgcagatggactcttacgccgaggtgccgaagtcggtctcggacgagatcatcaaggcccagcgcggggagtgacacgcgcagctgttttgaagccgtaagtgtctccagtcagcggtaaaatcatataccgctgactgggttctggctccaaagtggcaagaaacccagaaacccagtacaatgtagcgagtgtcttgtgccgcaagcgcaagccaactacacgagacgtccaggaggacaattacatggcaaaggaaaagtacgagcgtactaagccgcacgttaacattggtaccatcggccacgtcgatcacggtaagacgaccctgaccgcggccatctccaaggtgctgcacgaagagtacccggatctgaaccctgagtacgacttcaaccagatcgacgccgctcccgaagagcagcagcgtggtatcaccatcaacatcgcccacatcgagtaccagaccgcgaagcgtcactacgctcacgtggactgcccgggccacgccgacttcgtgaagaacatgatcaccggtgctgcccagatggatggcgccatcctcgttgtggccgccaccgacggcccgatggcccagacccgcgagcacgttctgctcgcccgtcaggtgggtgtcccgcgtatcctcgtcgccctgaacaagtgcgacatggtcgaggacgaggagctcatcgagctcgttgaggaagaggtccgtgacctcctcgacgagaacggcttcgaccgcgactgcccggtcatccgtacctccgcctacggcgctctgcacgatgacgctccggaccacgacaagtgggtccagaccgtcaaggacctgatggatgccgtcgacgagtacatcccgaccccggttcacgatctggacaagccgttcctgatgcctatcgaggacgtcttcaccatctccggccgtggtaccgtcgtcaccggtcgtgttgagcgtggccagctggccgtcaacaccccggtcgagatcgtcggcatccgcccgacccagaccaccaccgttacctccatcgagacgttccacaagaccatggacgcctgcgaggctggcgacaacaccggtctgctgctccgcggcatcaaccgtacggacgtcgagcgtggccaggttgtggccaagccgggctccgtcaccccgcacaccaagttcgagggcgaagtctacgtgctgaccaaggacgagggcggccgtcactcgccgttcttctccaactaccgtccgcagttctacttccgcaccaccgacgtcaccggcgtcatcgagctgccggaaggcgtcgagatggttcagcctggcgaccacgcgaccttcaccgttgagctgattcagcccatcgctatggaggagggcctgaccttcgctgtgcgtgaaggcggccacaccgtcggctcgggccgtgtcaccaagatcctcgcctgattcccatcagcgaagaactcgacacgcttgaactagcgttctgagtgggtcctgaaaccttgcttgaggtttcaggacccactttcgtattccagggacccatacaggcgaattccatacaggtggacaacgatgtcgccgtcttttcatgtatcgttcatctgcagacgcgtgattattccccttcccgataccttgcagagccagcatggccatgtgaacggtacgttcggaagggaaaatcatgaacaagagaatagccgcggtgacggcgacggcatgcatgctgttcgcatccgtcatgattccagcggtatcagccgagggtacgactgatattggcgcacagaatcaggtcaaggccgttgcctacagcgatgcgctggacaagctcgattataaggggattcgagtcgggggactgtcgggtctcacgtgggacaaaaccgcggattcatatgtggcgcaatccgacaaccatgggagtgacgaatctcgggtgtggttcctcggcaaggacctgcacaacccgtccatcacgcgtgatccggtgacgtttaccgatgttaacgggactccctataacggcaacacgacggacaacgagggcatagcggtgctgcccgacggcgatttcgccatcagctcggaaggcattccccctgcgggcaggaatcaggccgaacacccgacaatcaggatcttcgacgccaatgggcggcagaagggggagcttgaggttccgcagctgttcgacatcaacacgcccaagggtcaggcgtcgcataaccttacgctggaaggattgagcctgtctccgacagggcacgaactcgtatcggccatggaaggcacgctcaagtctgacgtctaccagaaccggagcgacgcgcggcgcttcctcgtataccgtgacgacgtgacgggcaaggccggccagtggacgctcgtcaaacaggtgggcttccacacggtaccgggactggacatctccgatatcgtcctcgattccgaagactccctgtacgtcctgcaacgttcatggaacagcgagaccggcaacaaggtggcactctcgtacgtctccgggctgaatagcgcgccggatgtttccggtgtggcgaacctcaacgacccgaagaatgcatccgagttcgtgaaatcccgccagatcggcgagctggacaagttgccggatctgggcgcctccgcgaaacccggcgctcatcaggcgaaccctctgatggataactacgaagggctcgtcatcacgaacctcgaccagctcgccactcccgatgcctcgtggcatcgcggtgacggcgaatacaaggccgctatctccatcatcagcgacgacaactacagcgccacccagaccacgcgcatcctcgacgtcgaagcggaaccgttccagaagacggcggcaggattcgacgactcggcaagcggtcgcctgtcacagtacgtcacggcactcggcagaaacgatcgccttgactactggtcggctaacggattcagcgacggcaccggcacgtcggagccgatagcgttcggcggactgtcctcgacggcgtacaacaggaagcttggacaatatgtgtccgcaatggacaatcatggtaccgatgtcgctcgcctatggctgctgggcaacgatctcgacaaggcggctccgaccggcagcatcgtcctgaccgatgagaacggtacgccatacaacggcgaaactactgatgatgaggggctcggcgtgctgccgaacggcgacttcctgctcacctccgaaggccatccgaacgcggcagaaggcgagcatgagcagccgaagatccgtatcttcggcatcgacggccgtcagaaggacgagttgcccgtgcctgaactgttcgacatcaactgcaggggacaggccgtgcacaacaagagcctggaagcgctgacggtatcgccgtccggccatgagatcgtggtcggcaacgagtacgccctcaagaacgattcgcccagcggcaaggacatcgccaccatagcccgccgcgcgctggtctaccgtgacgacgtgaaaggcgccaagggacagtggaagctcgtcaagcaggtggcgttcaaggccgccgacgtgaacatgggcatcaccgagttcgcggcgattggcgaggacggattcctggtgctggaacgctcctgggaccagacccatgggtacggcataaagcttgcgtatgcgcacggcatcgcagccgccccggacgtctccgatgtcgcgtcgctgtcgaagagcgccgactcgtcgttcctgccggtcacggaactcgccgatttcggcggcaagctgacccttggcgcccagttcaagccgaatgcgcaatacatggacgccaacccgttgcttgacaacttcgaggatctggtcatcacccatacggacgacaatggccggctcgatctgagcctgctcaccgacgacaacttcgacaccacagagacgacgcgaatcgtcaacgtgcagatcgaccggtcagtgtttgtcgccgacccgagcaacggcgatgggcagcagcatggtgcaactattcagaggccttcaggtgcgggtctcggcggatcgaccgtccggctggctcacacgggcgcggccgtgacggcggtcttcatgctcgcggctgtgactctcacgtcggggctcgtcctcattgcgggtaggcggctgcggatatcgcgagagtagtcagcgccacggttcaaggttcgagaaagccgccttgtcaggtatttcacgaataccgttactcatgaaggccagtaatacggtacctgtcatgattgcggcggtggtcgccgccgcaatcatgtaccccagagaggaaagcatgattcccgcaataccggacgccaatgaggcaagcgtgatgttaaacaaggagaacactgagaacacgcggccacgcaaatcattcggaatgatcagcgacgcgtaggcaccaaggacggaattggcgggaacgaccatgagattcatgatcgccatgcatccggccagtagatatgtattctgggtgaatggctgtaaagcgcatcctaccaggatgatgatgaaggagacttgtactgttctgcctcccgtcagacggttggcaaggggagtggtcagaaacgacccgctcagcagtccgacaccgcttccggttgagatgagcccaatctgccagccgggaatgttcagcatctgttgattcagaatcacaatgctgaccatcagggtgaggacacaattcaacaagagcacactgctgaatacggatactgcttgtggccatcgcgtgtaccatgcaaagccttcgatcaacgatgaatgcgatgaactgccgccaatgtggtttcgtggtgttttcttcgtggaatcatcggaatccgatggggaggcgtcgttcttgggccgtagatccgaacgaatcagcggagtcgcaacggacatcagcgcatacaggacggcgctgatcaggaatggaatctcggggcctaatccgtacaggaaccctgacagcggtttggagaacaattggatgcatgcatcgcgcgattcattcgcggaataggcttgcaccagctgattcccggtgacgatttgaggcaagatgatattggacacattggaaaacacaccggaagtgagtccccgtacaatggcaaacaggaatagcagaggggccgacatcattttcgcaaccagggccgatgtcatcacacacagtgttgcagccgatataagaccgaaaacaatcatgagtttcttgcgatcgattctatccgacaggtgcccgcctggaagtgttcccaaaccttcgcacagtgcgaacacggtgccgaccatacctgccgtagttacatcatggcttaccgcatatgccaccagcgtgaacgcaaatccgccgattgtggttcccagtgctgacgcagtgtcagccacgaaccaggaccggtaatccctcaccctccatggtgagattgttgattctttttcctgacgtttttcagtcacggttttttcttctttctgttgatatgaatagttcgattacatcgaagagactgttgacgtcatctccatatacaggatgctctgctgtatcgttccacccataggggatgagggcttcccttttgaacgtcagatattgtatgcacgattccaattgctgttgaatagtatttgagggaacgtcatatccggcaatttgaaatcggcttttctcatcaccaggaagtcaactattgattgaatgtgtctttcgtagtcgcgaggaggaagcgagacatgtaacttccagaagaaggccggaaactggttgtctgtaaacacagcggtgtaataaatgcggcaacactatgttagtgaaaggaggcgaatgattatggataccgaagtcgagacgttaccaagtaagtcgactaggcaggaaggatatgttgaggcgaagcattgcctgtgcatagaattactgccagacgtcaatgagtgcgcgacgcgtatcttcgcgccgcaggttcgtgtttcagaccacatgcttgattccgttctttgcatcaacactataaactgcatcgattgattacgtgagaatggcgtcatgtcggttgtctcctatcggttcagccgacatgtcgtcattgtcattattatgttcgttattcagctactaagtcattaggtgaattgtcgttaaccactattgcttgttccgtttcaattgcatgaggaacagctgatgcagccggaagatgccattgggggattgttcggccgcgacgcgctgtatagacggtatggcataatagacaaggctatttttgagctttgccgaaattgaaaacatgaaaaggtgagttactgtggcacagactaccaatgacatcaagaacggatccgtcctgaacctggacggccagctgtggaccgtcacgaagttccagcacgtcaagccgggcaagggtccagctttcgtgcgtaccaccatcaagaacgtgctgagcggcaagatcgtcgacaagaccttcaacgcgggcatgaagatggagttcgagaccgttgacaaccgcaacctgcagtactcctacgaggacggcgacaacttcgtcttcatggacatgaccacctacgatcaggtctacatccccaagaccctcgtcggcgatcaggccaagttcctgctggaaggcaccgactgcgtcgtgtcgttccacgacggcaccccgctgagcgtcgaactgccggcctccgtgatcctgaccatcacccacaccgagcccggcctgcagggcaaccgctccaacgccggcaccaagcccgccaccgtcgagaccggcgccgagatccaggtcccgctgttcgtgggcgaaggcgagaaggtcaaggtcgacacccgcgacggctcctacctcggccgcgagaactgagagtaaggacaacaggcttccatggcacgttccaccgctcgcaaaagggctctgaacacgttgtatgaggcggacgagaagggacaggatttcctgtcccttcttgctgagcgcatcgaagagcctggtgcgcagaccccgcttcccgactacgccatcgagatcgtgcgcggcgtcgccgatcaccggcgtgagatcgactacatgctcaacgagcattccaccgggtggaaggttcgccgcatggccgtcgtggatcgcaatatcctgcgcatcgccgcatgggagatcatcttcaacgacgacgtgcccgatcgcgtggccatcgacgaggcgctcggcctggccaagacgttgagcgacggcgactccccggcgttcatccacggcctgctcagcgcgatttgcgatgacaccgaaggacgcgaggccattctccaccccgaaaacgacgagcccgacgcacagccgagcgacgacggtcatgagcctggtgagcctgccggtgaagcgtcgcatgcggaagccgaaaccggcgattccgaagcgtccgaggacgatgacatcgccgacggcgtcgatttcgacgacatgacgttcgacgatgtatccgatgacgttgccgaagctgcatccgagcagacgtccgatccacaagccggccagcaggacggcgagtccacaagtaaatgacgagaaaccagccgaattgccggtggggcgcgtccccgccgacagttaaggttggtacgaatatcctgagaaaataagggggttttggtgaaccagattgattccgaaaccgtgagttttgcccctgatgacgccgtgcttgtacttgaggacgggcaagtgtatgtgggtgactcttacggcgcgatcggcaagaccactggcgagatcgtgttcgcgaccggcatgaccggttatcaggagactttgaccgatcccagttacgatcggcagatcgtggtgcagacgttcccgcacatcggggacacgggaatcaaccgggaggatccggaatcctcccgtatctgggtggccggatacgtggttcgcgatcccagccccaccgtcagcaactggcgggccacgggcagccttgacgacgatctcgtcgccgagcacatcgtcggcatcagccacatcgacacccgcaagctggtgcgccatctgcgctccgcgggcgtcatgcgtgccggaatcttctccggtgacgcactgctcgacgacgaaggacgcctgaagaccgtcgccgcgctcatcgacgaggtcaaggccaccccgcagatgaagggtctgagcctgtacgacgaggtcagcaccaaggagacgtatacggtcgagccgtgtggcgagtacgagggcaaggagccgctctacaccgtcgccgccgtggatctcggagtcaagggcatgaccccgcatcgcatggccgagcgcggctgccgcgtgcacgtcgtgccgtccaccatcactttcgaggaactcaccgcgctgaacccggacggcgtgttcttctccaacggccccggcgacccggagcaggccgaccccgaggtcgagctgctgcgcaaggtcctggacgccggctacccgttcttcggcatctgcttcggcaatcagctgctcggccgcgcactcggcttcggcacctacaagctcaagttcggccatcgcggcatcaaccagcccgtcaaggacctgaccaccggcaaggtggaggtcaccgcgcacaaccacggcttcgcggttgacgcgcctatcggcgagaccatcgacgccccgttcgacaacgggcacttcggcaaggtgttcgtcagccacatcgatctgaacgacgacgtggtcgaaggcctgcagtgcgtggacatccccgcgttctccgtgcagtaccatcccgaggcggcggccggcccgcacgacgccgcatatctgtttgaccgtttcgtcgatctgatgaagacgtccaaggaggaaaaccgcaatgcctaaacgcaccgacatcaagtcagtgatggtcatcggctccggcccgatcgtgatcgggcaggcggccgagttcgactactccggcacccaggcgtgccgcgtgctgcgcgaagagggcatccgcgtcatcctcgtgaactccaacccggccacgatcatgaccgacccggagatggccgacgccacctacatcgagccgatcgccacgcccatccttgaacagatcatcgccaaggaacgccccgacgccctgctgcccaccttgggtggccagaccgcactgaacgccgcgatgtcgctcggcgaggccggtgtgctcaagaagtacaacgtcgagctgatcggcgcctcccttgacgccatcgaccgcggcgaggaccgcgagctgttcaagaaggtcgtcgacgaggctggcgccgaatccgcgcgctccgaagttgcccactccatgaaggaagtggacgccgtcgccgccgaactcggatacccgttggtggtgcgcccgagcttcaccatgggaggcctcggctccggcatcgcgcacgacgaggaggagctgcaccgcatcgccggcgccggcctgcattactcgccgaccgacgaggtactgctggaggagggcatcgaaggctggaaggaattcgagctcgaactgatgcgcgaccgcaacgacaacgtcgtggtcgtctgcccgatcgagaacgtcgacccggtcggcgtgcacaccggtgactccatcaccgtggccccctgcttcaccctgaccgatcgcgaataccagaagctgcgtgacatcggcatcgccatcatccgcggcgtgggcgtcgacacgggcggctgcaacatccagttcgccgtgcaccctgacaccggccgcatcatcgtcatcgagatgaacccgcgcgtgagccgttcctccgccctggcatccaaggccaccggcttcccgatcgccaagatcgccaccaagctggcgctcggctacaccctcgacgagatccgcaacgacatcacccagtccacgccggcctccttcgagccgaccatcgactacgtggtcaccaaggtgccgcgcttcgcgttcgagaagttccccggcgccgacccgcgtctgaccacgtcgatgaagtccgtcggcgaggccatggcactcggcggcaacttccaggagtcgctgggcaaggccatgcgctccatcgacaagcgccacatgggcttcagctgggatggtgacaagccggacgaagccgaggtcgccgaactgctcaaggccatcaccgtgccgaccgagcaccgctatctgcagattcagcgcgctctgtggggcggcgccaccgaacggcagatcttcgacgccaccaagatcgacccgtggttcgtcaagcagctggccctcatcaaccagaccgcgatggaagtgcgcgacgccgagaaactcaccgccaagctgctgaagaaggcgaagctcgccggcctgtccgacctgcaaatcgcccacctgcgcaatctcggtgacgagggcgagaacacgattcgcgagctgcgctggacctacggcctgcgcccggtctacaagaccgtcgacacctgcgccgccgagttcgacgcggtcacgccgtactactactcctgctacgccgacgagaccgagctgcgcaagcgcgaccgcgaggccgtcatcatcctcggctccggcccgaaccgcatcggtcagggcatcgagttcgactacacctgcgtgcacgcggtgcaggagctcggcaaggactatgacacgatcatggtcaactgcaaccccgagaccgtctccaccgactacgacatgtcgaaccggctgtacttcgagccgctcaccttcgaggacgtgctggagatctatgaggccgagaagaagatgggcccggtcaagggcgtcatcgtccagctcggcggccagacgccgctgtcgctggccgcgcgactcaaggccgccggcgtgccgatcctgggcaccaccccggagtccatcgacctggccgagaaccgcgagctgttcggtgaggtgctgcgtcgcgagcacatgaacgcgccgcgctacggcaccgcgctgtcgctcgaagaggcccgcgaggccgcccacaacatcggctatccggtgctcgtgcgccccagttacgtcctcggcggacgcggcatggaaatcgtctacgacgacgcccagttgaccaagtacgtcaaccgtgcgctcgacgaggccaaggccgacacggtcgtgtccggacgcctgccctccccgctgctcatcgacaagttcctgcaggacgccatcgaaatcgacgtggatgccctgttcgacggcgaagagctgtacatcggcggcatcatggagcacatcgaagaggccggcgtgcactccggcgacgccgcatgcacgctgccgccgagtacgctgtccgacgaccagatccgtcgccttcgcgaaggcacctacgccatctccaagggctgcggtgtcaagggcctgatcaacgtgcagtacgccttcatggccaacacgctgtacgtcatcgaagccaacccgcgtgcctcccgcaccgtgccgttcgcatccaaggctaccggcgtggccctggccaaggcggccgcccgcatcatggcgggggagaccatcgccgatcagcgggccaacggcctgctgttgcccaagggcgacggcggtgacatccaccgtggccagcaggtcgccatcaaggagtccgtgctgccgttcaagcgcttccgcacgcccgtcggcaagaccgtcgacatcctgctcggacccgagatgcgctccaccggcgaggtcatgggcttcgaccgtgacttcccgcacgccttcgccaagagccagctcgccgcatacgacggcggactgcctaccagcggcaacgtcttcatctccgtcaacgacaccgacaagcggcagctgccgctgatggccgtccgtctggtcgagctcggattctccatctgggccacggagggcaccgcgtccgtgctgcgccgttacggcatcgactcgaagatcgtcgacaagatcagcacccgcgtcgactccgacccggatgcggccgtcaaggtcgagcacgccgtcggtggcatcggaaagaacgtggtcgagctcatcgaagaaggcaagatcgacatgatcctcaacacgccgaattcccggggatcgcgttccgacggatattccatccgcgctgcggccatcgcggccgacctgccccagttcaccaccatgaccgagttctccgccgtgctgatggccatcgaagccgtcaagcacaacgattaccagatcatgagcatccaggagcacgccaagcagctgttcgagttggagagccaggaataagttaggccaggagcaatcatgacacacgccagcagtgaggaagaaatcaaggccatgcggtcggatttcggactgcgcctcagcagttcgatggcccagtacggccccttgtgcgtcggcatcgacccgcacaggaaaaacctcactgactgggggtataacgtcgacgcggaaggcgcggagctgttctccatgcgcatgcttcaggccatgcgagatcgcgccgccgctgtcaaattccaggagcccatgttcgagcgctacgggtccaagggattcgcggcgctcgaacgagtgctctacgccgctcgtcaaatgggcatcatcaccatcgtggactgcctccatggaggcctgtccaccaccatctccgccatcgcggacgcatacttcaagccgggcgcccctctgctggccgacgccatcaccctgctgccgtactatggcgcacgctcactgcggggcctcaccaatgaggccctcaacaacggtcgcggcgtcttcatcgcctccctgacctccaatcaggaaggcgccagcatgcagacggccatccgccagagcggcgacttcaagggcaaaaccgtggcgttcggcatcgccagcactgcccagaagttcaatgacgacatcgacggtatgggctcggtcgggctcatcatcggcgccaccataggccagtggatcgccgacagcggtgtcgacccggcgaaattcaccggtcccatcctttccccgggctacggctggcagggcgccgaggccaaggacctcaaaaccgtcttcaaaggcaccaagggcaacgttctggtgaccgtatcccgtttcatcgccgcccatgggcccgatatttccgcgcttgcccaagccaccgaggccatcgccatcgacgtccggcaggcgctctacgaagccatgaaagaaggcgaggacaaggagaaagacggtatgggaaccattaccgcatcactgcagcagaccccggccgagccagcggccactcccgacgatgatggcacacctcgcaagcgcctcgtcgtcctcaccggccccgccggtgtgggcaagggaaccgtcgagaacatcctgcgcaagaaccatcccggcgtctgggtctccgtgtccgccaccacccgcaagccgcggcccggcgaggtcaatggtgtcaactactggttcctcgacgaccagcagttcaccgacaaggaagaggccggcgattttctcgaaaccgccacggtccacggcctggcccgctacggcacgcccctcaagcccgttcaggaacacctcgccgaaggcgtccccaccattcttgagatcgacctgcaaggtgcccgacgcgtcaagcagcgtgccaaggagctcggtctcgaagtcgtctatgtgttcatcgccccgcccagcttcgacgagctcgttcgccggctcaagggacgcggcaccgaaactcccgaggaagtcgccaagcgtctggaaaccgctcatgtcgaactctccgccgaaaacgaattcgacgtcaccatcgtcaatgatgatgtcgataaggcggcggaggacctgtggcgggtcatcgcctccgaatacggcatcacggagtgaccgccgagcggcacatctgactgccggaccgttgccgctggttgccgctgtattatgcgccccttatccagccagagtcccatccgcatgcactgcgatgggactttttcggtatacgcatcatcttccatccgcccacagtcccatttatgtcgtctgatgtgggatcatggccgggtgagggatatgggaatggcggacttgtcgaagtgccgtggtcgtggactggcagccaggcgtctagcgggtgcgcagacggtaggctttccagatatcgctgagtttttcgccgttcgacgtacgcttccacacatccaatccggcgctgcgaccgcctgccgcgcgtgccgcggccgtgggcgacgcatattccgagccgtcctcaagacggaagcgcccctcctgggtcacggtcaccagccaacgttcgcccttgcgcggtcgctcccataccaaagtctcgccgggaatcagcagaccggcggcgacgacctgcttgatggtgacacgctgtgaaccgcgcgtctgccgggagcctgcgtcgccggaaagctgctccgggggtttgctcgtcagatcggcatggctctcgtcataacggatgtcccagtattcggcaagcaggcgaatcgtctccttctgccggtattccagcatcgccggcgtgcattcgttgaagtcggcaatctgcttggtcagcgggaaacggcaggagtcggcacgcagcagcacgcggtcgcgacggcgcccgtactccgtgagccggtcgatctgcccctccttgccttgcatcagcaccatattgcccagacgatacatccaatagtcatgcaggtccgccgtccaggaagagaacgacgccgccgacgcgatatccagaggcatgatcggtacgaccgccagcgcacgcgggcgcggaatgcgagccccggcacgctgctcgttggcccgaaccaacagcagacgcaccagatcagggtctccctgcaactcgccatgcagcctgatcagggcacctgcccggtcggcggcgctgacggacagtccgcgtaccaagcgaacagggaatcccttatccagatcgcggatcgcagctgcggtgtgcccacgacggtcaatggcactccgacgattcagcatatcgacaccggccacctgttccaaagcgcacagaatctcgcccaagcgctgtcggtcatgcgaccccaacgggtcggccgtcctgccgcagtcccgtgccgaatgcgaaccacgttgggcgaagaacgagacctcggggtcgccgaggttcctgaacgaatgcgtcagcgcccacatcgccacggctttccactcatgatgccgatagtcgttcagcgcctccagcctgcctcgaacatcatccggcagcacggtatccgacgggcgctcaagaatgcgccacgccatggcatacggggcgagaacaccgtcgatgaacgcctcaatggaatgaccggcgagatactggttcagcacgtcggaaaggaagtcctcgatcagtttgcccgtcgcgggcttgtgcgtgaggatgagatgcagataccggaagaactcctccacgcgggcggcgtcatcgcccagcggatccatgatgtcatcccaacgggaggcgtacgtgtccaccgcggcggcgggcagtcctgacatcgcccgggccttgaacacatccgatggcgtcagggggaggccgcgcatgttcatgacgtcgaaaatacgatgcgctccatcaaggtcatcggtggtgacgatgaccaaggtcaccgaattgaccagataagatgcgaaccggtggcgttcctcctcgtcaagctgtgccaatgcatcgtatgcctgctttgtgttggcgatgatgttgcgctgcgcattcgaggagcagtcctcatcgttcatgtcgaacagcgcctccagattgccttcctgaacgtattcgcggaaaaatgcggcgtcgcgttcacggagtgtcagccggggttgcgaggtgatgccgcgcagcttgtctccgggctcgacgatcagagcgtccagcagacgcatccattcctcgtcatgttcgaggtcgcgcagcgcggcgatgatgattgacagcgagaccagacgctgctggccgtcgatgaccgagaagctggtgtcgccttcccgcacgagaatcagagaaccgaggaaatacggcgtttccggtgatttgcatgcctcctcaaggtcgctgatgagctgcaggatgttctccggtttccagatataggcgcgctggaaggatgggatggacaactgatagtccggagtgaacaccttgcccagtggtttttccgtcgcgttgattgccatgacgccccctcatcggtagctgctgagcatcagcgtaccagcgggtcggtatggatgcgctggcggcgacttgcgtgacggcgccgttacaggtccgctcgttcgacaagccgtgccatctgcacgcgccccatgtcgagtttgtccgcggcactggagagatgcgctttcgcggtgcgttccgatatgaacatgcgtcctgcgatctcggcgttggtgcagccttcggcggcgagcagcacggcttcgcgctcccgggagggcagcgtgtccagcagggcccgagcctcgtcacgcctggactggggacgctgcatgctcagatcattgatgagctgtctctggctggccggattgaactgcggggtcccctcgcatatgccgactatgcggcggatgatgtcctccggcgcgtcggtcttggatacgaatccctcggcgccggcctccacggagcgttccaccgtgttggacgggttcaaggatgtgaggatcagcacgtgaggaggattgcgaagcgcgcgaagacgacgggtggtctcgatgccgtcgatgccgggcattgccacatccatgagaacgacgtccgggtgttcgctgtcggcgtttcgcacggcggtggctccgtcggttgatgtggagacgacagagacacgcccctgcgagtaatcgcggagaatcatactcatcgcctggcacaccagcggatcgtcgtctatgacgctcacggtgatgacgtgctgttcggaatcgttcacggcttcattctatcggcttgacaggcgatccacggcattgccacgtcgagatggaagacatggtggtcgtcgtgcccgtatcggcatgtcccgccggccgtctgcacccgtgccgtcaggccggcaagtccgttgccgtccgttgcggatgggatctcgcgctcgttcggggcggagagaccgcgcttcatgggattgctgatgtggatatggatgccgttgtcggggttcatcgtgacttccacagacaccggctcaccctcggcgtgtctgcgggcattggtcagcccctcttggatggctcggtatgcgattttccctgtgccctcatcgaggtcggagagctgctggatgtctatccaggtgttgatgcgcatgccggcggagcgcgcatcgttgatcagggcgtccaatgacgggcgtgtcattgacgtttgcggggcgggagcgagctgctgacgtgcctgttgggggtgacggagcatgccgatgatggaatgcgcctcatccaaggctcctgcggattgccgtcgaatctcctcggatttctcctcgataagcgaagcctgattccgcaattcgggggtcagcatctgccccgtctcatgtgggttcgtcgcatcggcaagctggatgaacgcctgtgcctcgccctgcagggcactggcgttcaaggcgatgagggacaaggaatgagcgagcgtgtcgtgggcttcggctgcgatggcgtcggccagctgctgatcggtgagattgcgatgcaggctcaccgcataatcgctgatggactgggtcttggtagcggcctcgtccaattgcactcgtgaccggatatacagtcccgccagaatggcgatgaggacggctatcagctccaccacaacggctgtggctatgatggtcggcctcccctcaagcatcgcggcatggcccgaggcgacatccgaatccggcttgatgaagatggccgattgccacatcgaggagttgaacgggcgcaacgtgtcgcgcatctgcccccagaccccgaccagcgtcgccgcgacgatggcgcggatgatgcgctgcctgccgcggcgtcttgcgatcagcgatgtgagcgccatcagcatcagcatcggatcatagggaaagatcaatatgacggcgcagcagatccagaacaccggttccgggtgcttgtcgcgtgcaagcacccggaacgggaacgcgaaggccagtagggaactcgcgatgaaccagacgtacatggcgttgaccggattattgatgtaccgggtggctgcgaatgaagtctgcaccaggcacatgaacgcggaaacggtgatcatcaccgcggtgcaccatacgcgcgtgcgcacggcgacggtgtcctcgtcggacgtcgtcgccgggagcggtcctcccgcgcgggggtggggcgagaaatcattcatggcatccactctacagggtcaggtctttccgcgccatcgaacgcgggttcattcttatctgcccgaaagggcaatcggaaatgaacgttcgtccactgatgcaaacgtgcgaactccgatagcgtggatggtgcataactcaccgagatcaagaaggagaatgctatgtcgcacggtatcaagggggagacgcccgcacaggatacccccaaaggaaccacgatctgcggtatcgtaggcgtcgtctttggcgctttggggctggtcctcagctttatcccgatcgtgaacaatatagcggccatcctaggcgccatcggcgtggtgctggcgatcatcgccatggtggggacgttccgcggcaagaaggcgggcaagatactttccatcgtcgcggcggtgctgtcggtgctcgccatcgtcatcactctggccatgcagtccgcagccagcaaggccattgatgaggccattaacggttccggcacgtcacagagcaagtcgtccgacgcgaaaaagagcggcgacgattcctccaacgacggttccgcgaacaacgatccgacgaacaatgactccaccgatacgaccaaggcatcgggggagcaggaccaggagggtgatctcaagaacctccatgtcacgatcgtctccgcggcgaaatcgggcaacgactatgaagacaagcctacggtgatggtcacgtacgaatggaagaacaattcaggcaagaacaactccttcgccgcgctggcgcatccccaggtgttccagaacggacaggccctggacaccgccgtctatcttgaccagccgaccggatatgacatgaattcatatacggcggagatccagcccggagcgacgggaaaggtgaccctgggatacgtgttgaaggacgagtcgaccatcaccgtcgacgtgaccgacctgttctccatcgatgactcccggaaggtcgtgcacacgttcgacctgaaatagacgaataggcaggcgttgctggtgtgatgctcaaggctgaacattaatgatttgttcagccttctccgttacgatgaagcgtacgcaaacaaaggagccagcatgacatttggacagcagccaggcaacggcgatccctattacggcggcaatcagcagcagcccgcatatgggcagcagcaatacggacaatcacagtattcatacgcgcccaacggcactgcggcgatcaacgcccagaccatctacagccgtgagcaggtgcaggcggcccaacgggcatccgtcaccagggcatacggcgagatgacgctcggccttatcatcacggccgtcgtcgcggtcgtcgcgcagatgaccggcgcatacgtctccttcatcgagtcaaccggcctgatcggcttcttcggattcgcgatcgtacaggttgtgctggccgtggcgctgggcgcccgcatcatgaagatcaaggcatcgaccgcccgtgtcatgttctacgtgtacgcggcgctgatgggattcactctcagctccatcttcctggtgtacagcatctccgacatcggcgtggccctggtcctgtgcgcggcgttcttcttcgtgctcaccatgttctcgttgaccacgaaattcgacatgctcaaggccggccccatcctcatggtgggcctggtggtgctgatcatctcccagatcgtgctcatgttcgttccgggcagcacgaccgggatgcgtatcatctgcgccttcggcctgatactgttcgccggcatgaccctgtacgacgctcagcagacccgtgcgctgttcagcgcctatgaggctcaggggccggagatgatcaagaagatctccatcatctgcgcgctgaacctgtatctcgacttcgtgaacatgttcctgtacatccttcaactgttcggcagccgagactgatatcactggaacggtaccgtcatagccgattccgccaatacggatattgtcacgacggcagatgcgatggaccatcccgcagccgcgggatgggccatcatcgttcagatgcccatcgcgcgaatcagcgagaccattccatcatcgttcgggaccggtcacggcgatacgctagcgtgaatgctcatgaagcagcaggaaatggccggtatggcatgtcttgtattgacctcgctgatttggggattcgcgttcgtctcccaggtgcagggcatggcatcgatgtcgccgttgttcttcaacgccacgcggttcaccttgggggcgatttcgctgatcccgttgctgctgtggaagcgtttgcgacgatgccgggaatcggggaagacggttggcgcggggaaccgtgaggccggcgatgacgaacatgacatgatcgtcggcagcgcactgtcgaacccgctcatcgtcggaatgatatgcggtgtgtttctgttcgcggcgagcacgctgcagcagtacggcatcatgttcggctgttcggccggccgcgccggattcatcaccgcgctctacatcgtcatggtgccgttgctggcgtatctcgtccttcgccgcgcagtgcgcatgatgacttggatggcggtgggcgtggccgtggccggattctacctgctgtgcatcacggacggcttcggttccctgacgctggccgactgcctgctgctgttcaccgcggtcctgttcgccgctcatatcctgtcgattgatacgctgggagcgtgcgtcgacgcgctgacactgtcattcatccaattcgtgacgaccgcggcactcagctgggccggcacgctgatcgaaggctccatggactggaacggggcagggcaggcgtggatcgccgtgctgtatgcgggaatcgggtcagtcggcgtcgcctacacgttgcaggctgtaggccaacagtgggtgccgccgacccgcgcatcgctcatcatgtcgctggaatcggtgttctcggtcatcggcggcgcattgctgttgggcgagacgatgacggtacgcggatacctcggctgtgcgctgatcttcgcgggtatcgtgctcgcgcagacgcccggtgtcggccgcagacgattggcggtgaacaagaccggaaaacgggatcagtgaacgcgatcggggaatgcgaccggaaaacaagaaagacagaatcccgctgatcggccgtcagacggatccgttcccgtcagcgagggcggaggatgcgtgacgggggccgattcgaccagcttagtcggctttcggtgtctcctcgacctgcggcgcgccgttgatgtcgcggtggatgttctgcatctgggtctcgatgttctgcaggctccgcgcgcaatcaagcagcgtctgcgagtgctcggcgagctttgcgtccggcagatcggtcttgtagcgcagggcgtgctccagactcgcccagtaatccatcgcgatggtgcggaactggacctccaccggggtgtagtgggcgccggatgagaggaacacgggcaccgcatagatgacgtgcagcgaccgatagccgttctgtttggggttcttgatgtagtccttgacccgcagcacggagatgtcgttctgcgccgacagatagttcgacacggagtacacgtcgtcgcggtagttgcagatcacgcggatgcctgccacatcgaacaggttgtccttgatcgacgacacggtcaccggcagcgtcttgcgcttgagcttgccgaggatcgagttcaccgacttgagacggcgttccatgtgatggatgggatcatgcgagaaccgcacctggaactccgaatcaaggatctccagtttggtgcttatctcatacatcgcgccttcgtagacttgcatgagattcacgaattcggtgagttcttccggtgaaaaagacccccggtccatgcccgcggcatcgagtcgggttttcaggtcattcgtgttgatgcggctttgtcggtcaagtatcacggttcaccatcatagccgaactcttgcggaggaactgaaaaatcgcagcacgctggtgctggcttgggcaatcgttacgatggttgactatgaatgaagacatgatgaccgagtcggagcgcacctccacattgacggacccgacccttggcgccacaacggggcgcggcaagggcgtattttacgtgcacacgctgggatgccagatgaacgtgcatgattccgagcgaatcgccggtgtgctcgaagatgacggatacatgccggcgaccgaggaacaggcggcggacaaggacgtcgacctgatcgtcatgaacacgtgcgcggtgcgggagaacgccgcggaacgcatgtacggcaccatcggcctgtgggcggacctcaagcgcacgcatccgaacatgcagatcgcgatcggcggatgcatggcccagcttgaccgcaagaggatcgcacagaaggcgccgtgggtggatgcggtgttcggcacgaagaacatcggctcgctgccgcgcctgctggatcaggcccgcatggcggggacctgccaggtcgaagtggccgacaggctggactatttccccagtcagctgccggtcgcccgcgcttcgaaggtgtcgagctgggtatccatctcgatcggctgcaacaacacgtgcacgttctgcatcgtgcccaccacgcgtggcaaggagcatgaccgccgtcccggcgacatccttgcggagattcgccgatgcgtggatgaaggcgccaaggaggtcacgctgctcggccagaacgtcaactcgttcggttacggcatcggcgaccggtatgcgttctccaagctgctgcgggcctgcggagacatcgagggattggagcgtgtgcgtttcacgtcgcctcatccggcggcgttcaccgacgacgtgatcgcggcgatggccgagacgccgaacgtcatgcaccagctgcacatgccgttgcaatcgggctccgacaagatcctgcgtgcgatgcgtcgctcctaccgttccgccaagttcctggatatcctgcgcaaggtgcgcgaggcgatgccggacgcgcagatcagcaccgatatcatcgtcggattccctggcgagacggacgaggatttcgaggcgacgatggatgtggtgcgtcaggcgaggttccagtcggcgttcacattcgaatactcgccgcgtcccggaacccccgcggccgaaatggagcaggtcccgcatgaggtcgtgcaggaacggttcgaccggctggtgaagcttcaggagcagatcacggaagaggagctcgccaagttcgagggccgtgacgtcgaagtgatgattaccggggcccaaggcaagaaggattccgcgacacatcgcgtcaccggtcgtgaacggaccggcgtgctggtgcatatcggcgtgccggacggcgagccgatgccgcagatcggtgatttcgtgaccgcgaccgtcacccatgccggtcgccacaacctcatcgccgacccggatgtcaacgccggccagacgtatgcggtccgccggtgagcgggacagacaccgcgatataagcgagacgacatcatgagtgagaccgtgaacgagaccatgaacgatgtgaccatgaccgataaattgacgaataatgacatggcgtcgaacgtgaccggcccggcctcgtcaggctccgaaggccggtcagcaaacccgtccgtggcgatgccgagggtcgtcagcatcgtcgggccgaccgcgtccggcaagaccggcctcggcatcgccgtcgcccgggcgctggcggaacggggggagcgggccgagatagtgaacgcggacgcctaccagatgtaccgcggcatggacatcggcacggccaaaccgaccgcggacgagcaggcggcggttccgcatcatctgctcgacatcatcgatccggacgaggccatgtcggtcgccagattccagcaggtagcgcgagccaccatccatgacctgcaatcacgcggaatccgccccattctcgtcggcgggtccggcctgtatgcgcgggccgccatcgacgacatctcgttccccggcaccgatcctgatgtgcgcaggcgactggaggaacgtgagcgcagcgagggggccggagcgctgttcgacgagttgcgggcgaaggaccctcaggccgcgtcgcgcatggacccccacaacccgcgtcgtaccatccgcgcgttggaggtcatcgaagtgaccgggcgtccgtattccgccagtctgccccgctaccggtacgtcatcgcctcagtgcagatcgggctggacctgccccgcgaggagctggaccagcgcatcgacatccgcaccaagcagatgctggagggtggtttcatcgaagaggtggagcggatccgcccccatctgggagcgaccgccgggcgggcgctgggctatcagcaagtcatcgattacctggacgggctgtgcgatctggatgacacgttccgagacatcgcgcagaagaccaaacggctcgcccgcaagcagatgggatggttcgggcgtgacccgcgcatccattggctccatgcgctcaatccgcgactggtggataacgcgatggccgttatcgaccatgccgacgcgggcgattacgacccgatcgatgcgcaggcggacgagtatacgcaacatcatctgggcgacctgcagtaatggcagagcggcccgtggcgaccggtaccccgtggtgaccggcaacagagtcgccgcggcttcggtcagtgggcgggcccctgctcccagccggcgatcaggaagacccgcgtggggttcgcggggcgcacgatgtcggcgaacatctggctgaaggcgttgatgtcacctcgatatgcggcgtgtttcgcctgcttgtatgactcgcgcgtcacgcctccccagtcgagatcccacccggcgtcatgcgcgagacgggacgcgaagatgcgaagcgtcatggcgttgcctcccttgaacgggtgcaggtagcccagttcgtcgtagacgtgggcgagctcccggacgaacacgccccggtcgaggttgtccaggttgcgtttgtcggcaagctcggtcgagatgttcaaggcgccggtctcgatcaattgcgcgggaaagaacgcctcggggttcttggcctgatgccgcttgtcggtgacctcgcgggtgacgttcgaggtgcgcagctgtccggcgtcggagaacacgccgtcgaacagtccccggtggatggcgatgagctcggcaatgtcgccgctcggattccaacggcgttcagccaacagcaccgttcgggcgaacacgctgctggcgtggtcggtggcatgatcgtcaaggctcccgtcggcgagcctgccgctgacgatcccggaggtctcccggtccgcggtgtcgatcagagcggatacgtcgttgtcgccccgctcgtatcccgccgcggcgcgcatcgtcgcatcgcccggcgtcatcgcttccaatgcgcagtttttgagtgcaaatgcgactgcgctcgcacgttctgctggagtcatagttagatggtacatgcgccgatgcccctcgcgcgggttttgacgcgaattgatcgggaaaataacgggtgatgggtagaatctgaagacgctatggcacgaacaacatcctcatcaggcaatggtccttccaacgactcgccgcgtggcacccgcacgcagcgtgcttcgtcgcgcggcggcgagaccgggaagagagcttccggcgggcgtggcggcatgggggacgatgcccgcaccccggtcgaggagccgctgtggaagcggatcattctcgcggttccgcgcggcttcggctcactggttcggtcggttgccggagtgggtgaattcgaccccgtgtatcgccgggatggcctgtgcttcctgctgatcgtgctcgccgtattcttctgcgcttccgaatggttccgcgtgaacgggatcatcggccgggtgctgcatgcgttctcggccggcgtgctgggcgtgatgagcgtcgtgttgccggtgctgctggtgatcgtggccatccgtctgatgcgcaacagcggcaagaattccgacaacccccgcgtggtgagcggctgggcgatactgttgtggtccgtctgctcgatcatcgacgtggtcgtggccgccgacgcgcgttcgttcgacatcggcctgctgcaaagggccggcggactgcttggtttcgtgctgggctcgcctttggcatggggattgtcgaaggtgttcgccgtcatcgtcttcgtagtagtcggcttgttctcgctgctgatgatcacccgcacccacgtcactcaggtgccggatcgcgtccgcaccatcgctgccatgatctcgcagcgttccctgcatcctcggcaggagccggattcggccgcgcaacaggatcagttccccaacgaggtgcgtgtgggtgacggcgatgagactctggcgttcgccgagggcgtccccgcccatgacggtatggacgaaactgagtcggactccgtgggcgcgaagggcggatggttctcccgtctgttccggcgcaagtccgcggagaagacggatgacgcgtcacttgaccggtatgcgggggatgacccgttctcccacgcggcgagtcggcatgggcaggccgccgagacatcactggacgcacgcggcaatgtcatgccccgcacggtgtcctccaccatgggcgcgatggccggagcagctgccggcgccatgtccggcgccatgtccgggggcgtggcggcggcccacgccgccgatgccgtcgcgacgatgacatccggcatggccgccgcacaccccggtgccgcatcttccggtacctcaggcgtaccggcgtatgcgacggatcccgacggggcggccgggagtgcgaggttggtctcatcgacggttgccggtacgtccgatccgtgggcggcgatgcccgccgcgggcgctgccggtgcgatttcccccatgtccccggatgcctcctcgggcgcatcggccggtgcgggcgagaacatgaatcccaatgtggacgaccctgcgcttgcggcgccggacgccccgtaccaactgcccgacctgaacatgctgtcgcacggccagcctcatgccgtgcgcacgccggccaatgaccgcgtgatccgcgcgctgacctccacgttccagcagttcaacgtcgacgcgaaagtcgtcggcttcctgcgcggcccgtccgtcacccagtacgaggtcgagctcggcgcgggcgtcaaggtcgagaaggtcacgaacctgcagcgcaacatcgcctacgcggtggccagctccgatgtgcgcatcctctcgccgatccccggaaaatcggcgatcggcatcgaaatcccgaacgatgaccgcgagatcgtccacctcggcgacgtgctgcgctccgacaaggcgatgaacgacccgaaccccatgctcgccggcgtcggcaaggacgtggagggccatttcgtcaccgccgacctgaccaagatgccgcacctgctggtggcgggcgccaccggctccggaaagtcgagcttcatcaattcgatgctcatgtcgatcatcatgcgttccacgcccgagcaggtgcgcctgatcatggtcgatcccaagcgcgtggagttgagcgcgtatgcgggcatcccgcacctgctcacaccgatcatcaccgatccgaagaaggccgcacaggcgctcgaatgggtggtcaaggagatggacgcgcgctacgacgacctgcagttcttcggattccgccacgtcaaggacttcaacgaagccgtgcgcgcgggcaaggtgcatgcgccagccggttcgaaccgcaaggtcgccccgtacccgtacctgctcgtcgtcgtagacgagatggccgacctgatgatggtcgccaagaacgacgtcgaaagctcgatccagcgcatcacacagctggcgcgtgccgcgggcgtgcacctggtgctcgccacgcagcgcccgtcggtcgacgtggtcaccggcctgatcaaggcgaacatcccgtcccgactggcattcgccacatcctccgccaccgattcgcgagtcatcctcgattcggtgggcgccgagacgctgatcggccagggcgacgccctgttcctgcctatgggctcgatgaaacccatccgcgtgcagggatcgtgggtgaacgagtccgagatccgcaaggccgtcgagttcgtgcgcacacagcgcaagccgcactaccgcgaggacatcgagcagatggcgcaggaggccgagaagaaggccgtcgagccggatgaggacatcggcgacgatatggacgtgttgctgcaggcggccgagctggtggtcaccacgcagttcggttccacatcgatgctgcagcgcaagctgcgcgtcggcttcgccaaggccggccgactcatggatttgctggagtcgcgtggcgttgtcggcccgtccgaaggctcgaaggcccgtcaggtgctcgtccagccccaggatctgcctgcggtgctcgcgttcattcgtggcgagaccgatgcgatgcaggcctctgcgcccgccgcggccgcgcagcagggcgaattggcgtagtgggtgccaagtcggcctgaccggcaggcctgacccggccatgatgcagccatatctgacgggattcccagagaactcgaaccgcatattcatccaaggtaggagtgtgggggtatcgtgaacactatggaaaacgatatgcaaaacgatacaacggaacgctcggcgaccgccaagaagtcgctgctggacggctggaacgcaccgccgaacctcgtcacgtattcgcgcatcgtgctggtcgtgatattcctcggcctgtacatcgccgcaggctcgtggggagagaacaacatccccatgcgatgggccgcggccgtgctgttcatcgtcgccgcgtccaccgacaaggtggacgggtggatggcccgcaagtacaaccaggtcaccgaactcggcaagctgatggatcccatagccgacaagctgctcacctgcgccacgctgatcgtggccgcggtgtttggcgagctcggtcccgtctggctcggctggatcatcgtcgcgctgtttctgctgcgtgaggtgggcatcaccgtcatgcgcttctttgtcatcgacaagggcggcaaggtgatcgccgccgcctggccgggcaagctcaagacgctgttccagtgcatcggcctgtcgatgctgctgctgcccgtgtgggtgttcaatccggcccagaccgcgccggtgtggatgacgggatattacacgctgacgtacgccctgatatacatcgcgctgatgctgtgcctgtattcgggggcgatatatctgatcaacacgttcgggagccgcaaggactgagcgagtggacgccgtcgtgcctgcgcacggcggcgtttttgtttgatggcgtttgatggagggggattgcgatgaatgatgccgattcgtgccgttgcgacgacatggccgcgcggattctgcggttttgcgaggcgcatgacgtgaagatagttgcggcggagtcgttgaccggcgggctgctggccgatgcgttcgtgcgcgtgccgggcgcatcccgcgtgtttctcgggtcggcggtcacctacgacattcgtgccaaggcgtcgattctgggggtcgaccgcggtttgttggaacgcgaaggggccgtgcatcccgaagtggcccgacagatggcggcgtcggtcgccgggctgtacgggcagcccgaatacgctgaccgtgtcatcggattgtcgaccaccggcgtggcggggcccggaccggatggagacaagcccgcgggactggtgtatgtgggagtgcggattccagccgccataagccctgacggcgtgccgtccgtgaccgcccacgagcttcatctgacgggtgggcgcgaggaggtccgtcgcggtgccgtattcagccttgtgcaaatcgtgagccatttcacaggagatatgcaggaataaaccgccgccggcggtgttgaacacagtggaagcacttggacgatatgaaaggagggtctcatggaaacgatgacccgaacgggcgagcggatggaaacggctggcatccccgtcaagcaggtgcagccgggtacggccaggatgcgtgatctcacgccggcgcagcggcgtgccgtgttgttcgcccagcagcaggtgctgcgggtgcgtgcggcgaagaaggccaaggatgaacggcaggcggaactgaatcgtatgcgtatggaggaggattccttcgaaccgcgtcagcgcgcggtctcgcgtggcgtcgaggcgttgcccgagggaaaggatgtgtcgctgcgcgaggccatcggccatgtgctgcgcgatcttcgcacccgcgacaacaagacgttgcgtgaagtgagtgagaaggccggcgtgtcgctgggctatctgtccgaggtggagcgcgggcagaaggaggcaagctccgaactgctgagctccatcgcgggatcactgggtgtaagcaccgcgcagatgctgcggctcgtcgccgattatctggattcgatcggcgaatagcgatttgcggcgccggatgccgcgtgcatatgcatatcgtcgtatcgtgtgcatgagaggaaccgtccgcatgggcttgaggcccggcgggcggtttcgtcgtgttcgggggtgtggcgtcgattggtatgccggcattcgcagcggcggggccgggttagactgggagacatgcgagaacgggaattctgggaactggtggatgaggtgttcggtcatgggtatggccggagcctggtccaggatcagcatcttgacgcgctcgcgggacttaccgcggcgcaggcgctgtctgcgggggagcagccgcgcgtggtatggaacgtgctgtgcgaccatatggacgttcccgatccccagcgttggggctccgatcacaacgcgcctccgatgccggtccgttgacgagacacgcggaacgggtgatatcgaacaggtgttcgcctattggggtatagttatccacagtgcacgatgatatgacgtagtgcgccgcacggttcgacacgccgacgaattccttgcgacagtaagggggagtcggtgcggatcgatggatgccggggagccttcgaccacattggccggattcgtttgcgccggggttcgtatgttccgtacggttgatgcatgtggcatatggcgcatatggatgacaacgtaaggagattgacatggcacagcgtacgacctcgaaaggtggggcgggcaaggccgcatcgaaggtctctgttcgtgaggccgcaagcaatgggccggtgggggacggcatcgatccccgacgcaaggcggctttggactccgctctggagcaagtggagaaaagcttcggcaagggatccgcgatgcgcttgggcgacaagcccgagcagaacgtcgaggtgattcccaccggatcgctggcgttggatctggccctgggtatcggcggtctgccgaaggggcgcatcgtcgagatctatggccctgaatcgtccggcaagacgacgctggcgctacatgtggtcgccaacgcacagaagaacggcggggtggcggcattcatcgatgccgagcacgcgctggatccggtctatgcccggcatctgggtgtcgacaccgattccctgatcgtctcgcagccggacaacggcgagcaggcgctggagatcgcggacatgctcatccggtcgggtgcccttgacgtcatcgtcatcgattcggtcgcggccttggttcccaaggcggagatcgaaggcgatatgggtgacagccatgtcggtctgcaggcccgtctgatgagccaggcgctcaggaagatgaccggcgctctggcacaggccggcaccacggccatcttcatcaaccagctacgagagaagatcggcgtgttctttggcaaccccgaaaccacgaccggtggcaaggcgctgaaattctatgcgtcggtgcgtctggatatccgccgcatccagaccatcaagaacggcgaggaggccgtgggcaaccgcaccaaggtcaaggtcgtcaagaacaagatggctccgccgttcaagtccgccgagttcgatgtgctgtatggcgagggcatctccaaggagggatccgtcctggacatggcattgcagtgcaacgtggtcaagaagtccggctcatggttcacgtatgacggggaccagctcggccagggccgtgagaacgtgcgcaagttcctcaaggacaatccgcagatcaccgaggagatcggcaacaaggtcaaggcggaattcggcctcatcgaagtgcccgatcagctggccgacggtgagtccgcgacggacggggatgcccctgaaacggcgccggaggatggcgcgcccgctgccgccgcatcgcctgccgcatgatcagcgcagaagcgttcctcgccgctcatggaacatgtgagacgccggttgtcgaaccgggcgtcgactccccgcgacgcggaacatggtcacatgggaaccgcccggctcggcgctccgcgcggagcatgtcgcggcctgggcgggagccggaggatccctgcgatgtcgatgcgtgtcgggagtccgcattgcgcctgctggatgcggcggatcgtccatcgggcgccctgcgagaccgcctgatcgacaaagggtatgacgatgagacggtcgccgcagtggtcgacaggctgatcgaggttggtctggtcgatgatgagtcgtacgcgcaatctgccgtgcgctactgcgtcggccgtctgatgggataccgcggtgcggttatggaactggctcgcaagggggtcgaccgtccgctggcggagcgggtctgcgacgaggcccgcatgagcggtgtcttcgaggacgccgcatgggagttggggcggcgcagcgccgccaagacacagggcatggacccgaaagtgcgcaagcgccggttctggtcctcgggcgggcgcaaggggcacgacgccgaaaccctgcgtgccgtagcccatgagctatttgattagaatgaactatctcaatgaactatctcttagatgagatacagcgcggggcaagcgggggagatgccccggtggcttggcggggtggcgggttgccggcccggtggtttgtcgatccggtggtcttaccgcattgccggcgtgagaacaccctccgacgcttcgcgccatctcccgccagcgggagggaacggggctgccggcattgcgttgtttcgttcgcgcgccctcatattggtgggaggaatgtgttggcgggaggtatgcggattcggggggggggtaaagaaaagcgagacccccgataccccgggttctgtcgcgtgtcgccacgcggatggccatccatctcgacctgacgttgccgccaggctctagcggcctacccgaagacacgggcgagcagcccttgccgtcttctgcttggccttgctcccgatgaggcttgccatgcgaccgactgttaccagcggaccggtggtctcttacaccgccgtttcacccttacccgcttgcgcgggcggtctgttctctgctgcgctatctctcaggtcaccctgggcggacgttatccgccatcgtgctctgcggagcccggaagttcctcagccttgccaaatgaatgacgcggccgcggccatctgggggtctcgaatcagctactatacggcaggccagggattttacgcaggagaatcagggtgggccggcgcaccgggcgagacgatgaacgccgaatgccgaattgctgtcggtgggggggtgctcatcctcccgctggcgggaggtggcgcgtggcgccggcgggtggtgaccaccccacagtcggccgccgacaggatgccgcagatccgcagccgcatcggctcatggatcacaggatcgaatcgtggctcgactggcacaggcacctcccgaacattccataccgttatatcgctggccttgcttgcatgctcgattctgtccgaatggtcttataccgtcagcattgccttgcgggcaagcttgtcgtgccagcgttcggtgacgacgaagtacacggaccacacgacctctatgacgaccatccagggcaagacctccattgatgtgatgctgcggctcagcgccagcaataccagcagcgcaacaatctgtgtcgccagaccaaaaagtataacagtttccttcaaggaaagtaagccgcacagtataagcacagcaacgttacgggaacctgtgaaaaaaagaaacgtatttctctgggcgagttccccgccgtttaccctctgttcggctacaatgaaacttacccgggtggtgatgacgccattcggcacacatatagcgggtgacaccgcttgagtatagggaggtccacatggaaatcgtcgttaccggacgtcatacgcaagtcaagcagaagttccgtgatgtcgtcgaaagcaagatgaatcgtgtgaccgctatcgcgccggatgcgcaacgagctcagatcgtgctgacgcatgaggggaatccgcgtcaggccgacaccgcgaagcgtgtggagatcaccgtgatcgcaggcagcaccgtggtgcgcgccgaggcttccagcaccgatgagttcagtgctctggacatggcgctcgacaagctgacgctgcgcctgcgccgcacccgtgaccgccgcaaggatcaccgccgcgggtacatcaacccgacgcccgtcgatctgggagcggtcgctccgccggaaccggaagaggagccggagccggaagagccgaacaacagccccgaagccgccgtcgcctccgacctcggtccgggcgagtcggtggaggtccaggtcggtgacacgccgatcgtgattcgccgcaagctgcacatcgccgagccgatgagcatcgacgaggcgctgtacgagatggaactgatcggtcacgacttcttcctgttcgtcaacaaggagaccggccgcccgtccgtcgtctaccaccgccacggttggagctacggcgtgttcgagatcgacaccccggagaacatcaagaacaagtaagtgttccgccacgtgatacatggcctgcccggcatatccaggcaggccatatttgcgtgtcggcacacgacgaaacaagtatcgatgggcgtgtccagcgggtcggaacggcaaaaatccgagtgttcgcatatcatggatggagtttgtgcctgatgtcgggcatcaggctatgctcgttgacgtacgaaagcttaaacagggagcgaatgtggtagatatcgttgacaaagccctccgcatgggagaagggcaccagctcaagaaactggagaacgtggccaaggccgtgaatgcccttgaggacgagatttccgctctgtccgacgaggaactcaaaggccagaccgccaagttcaagcagcgactggacaacggtgagaaccttgacaagttgatgcccgaagcgttcgccaccgtccgtgaggtgtcgaagcgcactctgggacagcgtcacttcgatgtgcagctcatgggtggcgcggctctgcactggggcaatatcgccgaaatgaagaccggtgaaggcaagactctggtcgcgacgctcccgagctacctgaacgcactcgaaggcaagggcgtgcacgtggtcacggtcaacgactacctggcaagctaccagagcgagctgatgggtcgtatctaccgcttcctcggcatgaacgtcggctgcatcatcaccgaccagaagccggcggagcgccgcaagcagtacaacgccgacatcacctacggcaccaacaacgagttcggcttcgactacctgcgcgacaacatggcgtgggagaaggccgatctggtgcagcgcggccaccattacgccatcgtcgatgaggtcgactccatcctcatcgatgaggcccgtacccctctgatcatctccggcccggccgagggcgacgtgacccgttggtaccgccagttcgcgcgtctcgtgccgaagctgacccgcgacgaggactatgaggtcgacgagaagaagaaggtcgtcggtgtgctcgacccgggcatcaccaaggtcgaggacttcctcggcatcgacaacctgtacgagccgagcaacaccgcactcatcggctacctcaacaacgccatcaaggccaaagaactcttcctgcgtgaccgcgactacgtcgtcacccacggcgaggttctgatcgtcgacgagcacaccggccgtatcctgccgggccgccgttacaacgagggtctgcaccaggcgctggaagccaaggagaacgtggagatcaaggccgagaaccagaccttcgccacgatcaccctgcagaactacttccgcatgtacgacaagctcgccggcatgaccggtaccgccgagaccgaggccgccgagttcatgggcacctacaagctgggcgtgctgccgatcccgacgaacaagccgatgatccgcaaggaccaggacgacctcatcttccgcaccaagaaggagaagctggccgccatcgtcaaggacgtcgccaagcgccacgccaagggccagccggtgctgctgggtaccgcatccgtcgagtcctccgaggtcgtctcctcgctgctcgacgtggcgggcatcgaccatcaggtgctcaacgcgaagcagcacgccagcgaggccaaggtcgtcgcggtcgccggccgcaagggcgccgtcaccgtcgccaccaatatggccggtcgtggtaccgatatcatgctcggcggcaacgtcgagttcctggccgaccagaagctcaagtccgagggctattcccccgaggacacgccggacgagtacgagaagcgctggccgggcaccttggccgaggtcaaggagcaggtcaaggacgagcatgaggaggtcgtcgagcttggcggtctgtacgtgctcggcaccgagcgccacgaatcacgccgtatcgacaaccagctgcgcggccgttccggccgtcagggcgatcctggcgagtcccgcttctacctgtcgctggaagatgacctgatgcgtctgttcaacacgcagctcgtcgcccgcgtcatggccaagggcatgccggaaggcgagccgatcgaggcgaaaagcgtgtcgaagggtgtgcgcaccgcacagaagaccgtcgaggcgcgcaacttcgaaatccgtaagaacgtcctcaagtacgacgacgtgatgaacaagcaacgtaccgtcatctactccgagcgtcaggcggtgcttaagggcgaggacattcacggtgatatcgagcgcttcattgccgataccatcgacagctacatcaagggtgcccagaagggttccagcaagccctccgactgggattgggacggcctgttcaaggccctcaagaccgtgttcccgttcgagcttgaccaggacgccgccaaggacgccgccgacaagctcaagggcgacaaggccgttgcggccgtgcgcgactccctcgtcgatcaggccagggaggagtacgccgaacttgaggagaaggtcggtgaggaaggcctgcgccagctggaacgccgcgtggtcctcgccgtgcttgaccgcaagtggcgtgagcacctgtacgagatggactacctcaaggatggcatcggcctgcgcggcatgggtcagcgcgacccgctggtcgagtaccagcgcgaaggttaccagatgtacaactccatgatcgaggcgatcaaggaggagtccgtccagctgctcttccacgtcgatgtgcagcaggtgtccaggagcgaggaagtcggcatcgagtccgatgacgccgtcgttgatgaggccgaagaggccgtcggcgccgctagctccgaagtcgacaaggccgaggacgccggtgaggctgagactgcggaggaatccgacgagaaggtcgccatcgcccagtccgccaaggaatccgccgcaggcgaggccactgcgccgatcaccggcccggctccgatcagccatgccgaaggcaaggtgcccgccaacaagcgcccgaagaacgaggagctgaagaccccgtggtccgacggccgtacgttccccggcacgtccaagaacgcgcagtgcccgtgcggttccggtcgcaagtacaagatgtgccacggccagaacgaagagtgatataagctctccggactagacgagtaagtggctcccctcgatgtgaggggagccacttgcgtttcgggggagagagaggaagggcttgtccgcgggttgagcccgtcgattattcgcggggccgtggaatcgaggttcgccgagccccattcgctgtacaacgcacgattttgatggattcgcgcgtgttgtacagcgataccgcaggacaacgcgtgcatcaatcggttgacgcgtgcattgtcccacgacgcaaatcgcgaaatcgttggaattctaccgtttgtaaaatgccgctatctggggttcccgatatcgtctcaggacaacgcgcgcatcaatcgatatatgcgtgcgttgtccgccatattcggtgcccatcagtgcaaaggcctggtacgcacgcggcgatctcattgaccctgcagcggttccgatctattgcccggcaaagccttgggatactgcatagcgtttcagtcgggactcccgtagcggcatcgtggcgatgcctgccgcgttgcctgccctgattgtcggcacgctgtccgggccggacaagtaagtggctcccgctgacgggagccgatgatgttttgcaatatggaagattacgggcgacgaaacgacaagccattacaatgaggcgacgaatacatatcacacggcgtgacgaaacgccaaggagggcatcatggccgagatcacatggaagtcgattctcaccaagctggtcgggggagaccacctgagcgctgaggaatcggagtggttcgtcgacgacctgatgcagggcaacgccgatccggccgccgtgggtgccgcgctcgccatgcaggagcagctgggactgaccgccgacgaggtgtgtggcgccgcaaaggccatggtctcccacgccgtgccgctcaacgtgtccggtgagaccaccgacatcgtcggaaccggcggtgacggcttcgccaccgtgaacctatccacgatgggttccgtggccgcagctgcggcgggcgtgaagatcgtcaagcatggcaaccgcgccgcctcctcgaagtgcggagccgccgacgtgctcgaggatctcggcctgccgatggatctgaagcccgaggcggtcggggagatcggcgacgaggtaggcatcacctttgcgttcgcccgcaccttccacccggccatgcgctttgttggcccgattcgcgccgcgctcggcatcccgtgcgtgttcaacatcctgggaccgttgaccaacccggccaatccggcgcacgtggccatcggctgcgccaaccgcaagctgagtccgatcatggccgccgtgtacgccagccgcggccagtccggcctggtctacacctcgcacgagggcctcgacgagcttgctcccaccggcccgatctccgtgtgggagattcgcgacggcaaggtcaccgaaaccgatttcgacccgaccgtggatctgtgtcttgccaagatctccgtcgagcagctcaagggcggcgaacccgatgtgaacgccgccgcgttcacggacttcttggccggcaaggacatcccgtcacgcaccaccgcgttgctcaacgctgcgtctgccatcgtggcagacggcaacctggtcggcggcggcacactcgccgagcggttccgtgaggcgtatgcgctcgccgagaacaccgtcgattccggcaaggccgcggccctgttcggcaagtggatcgagaccgccaagtccaaggcctgaccattgcggtgcccgtccgatgaggacgggcaccgtcgtcacacccgcgcgccgtcgtcgaacatgtcggtgcgtgtctcggtgtgccccttgtgttggaggatgaggccggcgccgccgaccagcgcgcacagaccgaatatggagcccaggaacgtcgccagggcgggtacgaacacggatgcgatgatacccgcgacgcctgcgaccagcaggatccagaacaccagcttcgaggcgttcacgcggccgattttcgggttcggcggcacgaagtcatcgccgtactcgtccatgacgtcatcggtatcgagccagctgcggccgccatggtcgcgggggccgcgctggtgcagcggcaccttgtcatcggtgaacgtgccggcgtccagatcgtcgaccgacagcagcgcctccttctccttgcgctgcgcatgcttctcgaagcgccgcgcgttgcgtgagcgctcgacgtcctgcaggtcgttggcatgctccgcggcgaaggcggcccagtcgagatcgtcgccggcattggagcctgtgtcatacccgtcatgtccggcgcgcggcgtggtgtttggatgttcttcacccgcgttggtatcgttgtggttgctatcgtgatgatcggtcataccgtcctactgtaatcaggcggacggccaaacttgggaggtgtcatcgtgctgtactggttctttgtcaaaggtttcggttggattgcccgtcgtcgtatgggaccgacggcgatcggactggagaacgtgccgcgtgaaggcggtgccatcatcgccgcgaaccatctggcggtcatcgacgatgcgctgatacccatcacctgcccgcgcatggtgcatttcatgggcaaggccgagtatttcgaaggcaagggcatcaagggccggttcaagaaatggtggttcacgtcggtgggagtgttccccgtggaccgttccggcggctcgaagtcgctgggcgcgttggcccacgcccgtgagatccttgaggaaggccacctgttcggcatccacgtggagggcacgcgcagtcctgacgggcgactgtaccgaggccacaccggtgccgcgcgccttgctctggagaccggctgcccgctggtgccgaccgcgttggtgggaacgcgcgagatacagcatcccggtcaggtcatcccgtcgaagggcaagacgaaggtgatatacggcaagcccatcccggtggatcgcaaggacgccgacgagatcacccatgaggaggtacgggcgctcaccgaccatctcgtcagcgagatccgaaagctcagcggacaggaatacgtggacgagtacgcccagaaggtcaaggcggagctcaaggcccggcaggaggccgaagccgcaaccgccggcgaaggccactgaccgacgatcccgaacgcgaacgaagcggctccccctctcaaactgatagagggggagccgcttcgcgtatatgccggtatatgccggcgcgccgccgtcacacgacggtgagcgtgatgacggtcttgttgccgttcgtgtcgcgcagcctcgtcttgccggtggcgctctgctgctgcaccaggccgaggatgttcaagccgccggtcttgacttcgaaaccgagggattccagcgtcttgatggcgtcgctcttgctcttgccgacgaggttcggcacgtccgcggtctcgggccccttggatacggtcagcttcacggagtcgccccaatgcagttcggtaccggagtcgggcgaggcggagatgacgctgccggacttgacgctgtcgctgtactcctccgaaacggtggtcttgagcttcgcgttgtcgagggcggtcatggcctcgtccttggtcttgccgacgatgtccggcatggtgaccggcatgagtcccttggacagtaccacggtgatctcggcgttgtggtccagggtcgagccgggcgtctcggaaatgctttgcagggctccctccggcagcgtcatcgaatattcggctgaggagtcatcgcgtttgatgttggtgaatccggcgttctcaagcgctttgatcggatccttgccatcggccgacgtcggatccgcgatgtcgctggggatggtcgcctgcttgacgccaagcgacaccgtcaccgtgatgcgtccgttgtggcgcttgctgatatgggtgccgacgttctgcgggtcggcggagatgatgttccccttggcgacggtgtcactgtacgcctcggagaaggtgaacgggatgttcgccacgttcagcgtgctctggtaatcgctccacttcgccccgacgatggagcattcggtgttctccttgcaggagatgtcggtgggctgcggcagcgtccagtagctgcccggaccgaggaaataccaccatgagccgcctgcgccggcgacgagcgccacgacgagcaccaccacgagcgtgatgatcaagggtttcttcgagcgcttgcgcttggcgggctccgagccttggtcatcgagcgggcgcgcgtccatcagcccgatggtgagtgtggaatcctgcggcgtgattacctgggtggcggagacgtcctggggtgcggtgccttcaggcatcaccgaagtacgggccgtggcaggggcggtgccggtctgcggggcggtgccggtgcgcgaatcgaacagcggcggcgcgggcggggccgggatggcgcccaccagcgcgggggcggtcggctcctcggtatcgccgccggtgcctacgtcggcgggcttgcggtactgccatgcgtccatcggcaggttcgcggtcagctgttgcagctcatgcagggcgtcggatgcgtcggcgggccgtgcctcgacggcgcgggcggtcaaatgcgagacgaaatcggcgacctgctggttgatgcccgggcaggtcgaggtcagggacggcacgtcctcatgcacgtgcttgaacaccatggtgacgggattgtccgacgtgaacggcacgtcgccggcgagcatctcccaagccatgattcccacggaatacaggtccccctgcatggtcgccttgttgtcctcgatcatttcaggcgccagatacgcggcggtgccgagcagcatgccggtggtcgacagtgtcgcctgtgacgcggccttcgccagaccgaaatcggtgatctgcacgtgcccgcggtcgttgatcaggatgttctcgggcttgatgtcgcggtggacgacgcccacgcggtgcgccgctgccagtccgtccagcgtctcggagatgacgcgcagcatctcgcgcacgctgaacgtgccctgcaggttcatgtcgtgacgcaggttcacgccatgaacgtattccatgaccagatagtccagcccattgaattcgccggtgtcatacacctgcacgatatgtgggttcgcgatcgccgcggcggacttggcctcgcggtggaaccgttccacgaactgctcgcggtgcgctccctgcgccagctgcatgtgcatgatcttgatggcgacgcggcgttcgagcctggtatcctccgcctcgtacacggtcgccatgccgccttcggcgattttgcgtatgacgcggtatcgcccctctatcattcgtccctgcgactcttgcgacgtggctgcgacttcactcatggttgtatcgtaaggttctttctgctggaaaacggcatttccaatacatacgttggcgaaaactctacgctttgatgatcgggatgaacctcatgcatgcctcggtgagcgtgcgctcgtcctgcggtgggagccgcaggtcccctatggcatgaagcgtgccctgccacagtgcgcggatgcgccggcgggatcggtcgatggcgccggtgccttcgaacagctcgatgcaccggcgtacgtcgtcgtcgccccgcgactgcgacgagaacatgtcgatcagtgtgcggcgctgcctctggtcggcgccgctgatcgcgtccgcgagcagcacggtgcgcttgccctccctgatgtcgcctcccacgggcttgccggtggatctgctggatccgatgacgtccagcaggtcgtcggcgagctggaacgcctggccgagcggcagtccgatggacatggcgtcggcatgtgcccgcctggggtctcggccggaggcgagaagcgcgaattcgaggggcgcgatggtcgtgtagctggcggtcttccatcggaacacgttcatggattcccgtgcgagccgttccggctcgtccaatggagacaactcaactgcgaggtcgagcacctgcccgatctccacctcgcggtgcatgcgcaggaacgtcgagacgatcatgtcgggccggggcatccgttgcgccgcggcatgggcgatgtcgacgctggcggtggcgagaaggtctcccagcatgatgcccagtcctcggccgagcgacgcgctgtgcgacgtcgtgccgagcgccttgtgagccgcgggtttgccccgtcgcaggtcggagtcgtcgatgatgtcgtcatggacgagcgcggcggtctggaagacctctatcgcgcaggccaggtcgagcaccgcgtcgcgtctgcgggcatgggcgtcatcgtcgtcatgcccctgcgggtcggtcgcgtcgaaggcgtggagggccagcaacgccctgagccgcttgccgccttcgctggagaccagggcctgacgcgcgacctcgcgggatatggtcaggcacgggccttcgatggtgtcgtcggcgtcgagcgccatgaaacggtccaccgcgtcggcgatgcgggactcgatcagggccaaatcagatgaaacagtcatacctagaggttatccacagggttttacgaatacaagaactgcggatttgcaagcctgacaagccttcgaccacataggttggatttcgccctgaaaaccggcccgatacggcatagttgatggtatcccgtcgcgggggcggcggtcgccggcatcgtgcgccggcggtggatgagaccggtaagggggaccacgatatgggacaggagacgaacacgcaggccgtccggtatgcggaggcggtcgcggacgatgacatgctgcgcgaggacgatctcagacgcatgcgcgatgaatactgcgagcgccgcaagctcagcggcaccgtggcggcggacgcgcaatgggccgatgagccgttcgaccattggctggcgggcctgtcggcgcagccgcgggccatcgatgacgcctcgatcgccgcgctggtggtgggaatgacggtgacgttgtcgatcagggacgccctgatcatgtcattggtggccggggacacctgcgccgacaagcgcacgatgatggatttcgcgtcgcgctcgcatgcgccggatgtgcagagccgtatgtgcagggagctgcagggcgcgtttttcgacgagcgacgccggcccgacgaaccgagatgccgggccggcaccgacatgctcgtggccatggccgatcgcgttccggagagcttcagcgtgcagccgctggccgtgctggcgtatgtgatgtggtggatgggcgacagtcgagcggtggcgttcgcgttgcgctgcctgatgctggatgaggactgttcgctggcggcgatcgtgtgctcggcgtaccagcgcggcgtgatgccggcgtggatgggtgccggcccgcatcacgacgccgcatgacggctcgcgggagaccatcggttccacgccgcaacgagccgtgggaataatcgtccttggaagatggttaactcacatagttgacgatttgctcttgccagaagtgcgcccgatgtggtataagcacgcttggcatgatgatgcaggaggatgagtttggccacgaaggatacgatggcgacgacagtcccggacgatacggacgccaagacgaaatccgagaagaagggaaccgccgcgcgtacggcctctacggcagacaagaagaccgcagcgggcaggaaatccgccgcgggcaagaagacctcgtcgaggtccgccgcgtccaagtccacggcacgcaagtcctcggcgaaggcagccgcgcccgcgaagcccacccgcaagcgcgccgcgtccaagtcggcgaaggccgtcaaggacgagaccgaggagatggcgaagaccgaggaactcgccaacgaggattcctcggacgatctcgacgacgtccaggtcgatgaggatggtctggagagccttgacgacgatctcgacgatgtcgatgacggcggtctggatggcgacgatgatgacatcgatgacgaatccggtgaggatgacgacgttcccgaggacgaagaggacgacgaggggactgaacccgggcgcaaggagcctgaacagcccaaggagaagggcgcgttcgtggtgcgcgacgatgacgacgacgagaacctgaccccgtcgggcaatccgaagcgccgcgtcatcgctgcgggcgccacagcggatccggtcaaggactatctcaagcagattggccgtgtcagcctgctgaacgccgagcaggaggtggacctctccgagcgcatcgaggccggcctgtacgcccagcatctgctcgataccgagagcgacggcatggacttcaagcgcaagcgcgagctcaagtgggcggcgaacgatggcaagaaggccaaggaccacctgctggaggcgaacctgcgactcgtggtgtcgctggccaagcgctacaccggccgtggcatgctcttccttgacctgattcaggaaggcaacctgggcctcatccgagccgtcgagaagttcgactggaagaagggcttcaagttctccacctatgccacgtggtggatccgtcaggccatcacccgcgccatggccgatcaggcacgcaccatccgcgtgcccgtgcacatggtcgaggtcatcaacaagctgtcgcgcgttcagcgccagatgctgcaggacctgggccgcgagcccacgccggacgagctggcccgcgagctcgacatgccggtcgagaaggtgcaggaggtgcagaagtacggccgcgagccgatctcgctgcacacgccgctgggcgaggacggcgattccgagttcggcgacctcatcgaggacaccgacgccatcgcgccgtccgacgcggtcgcgttctcgctgctgcaggagcagttcaagcaggtgctggagactctgagcccccgcgaggccggcgtcatcaagatgcgttacggtttggaggacggccagcccaagacgctggacgatatcggccgcgtgtacggcgtgacccgtgagcgtatccgccagatagagtccaagacgatgtcgaagctgcgccacccgtcgcgctcccagaccctgcgcgacttcctcgatcagtgatcgcgccgctcggcagcgcgatcacgcgaggaggggcggtccagtggactgtccccccccgacggagccatccgttgatagctcccctcgatgaggagagccgcgagttatacagaaaataggatttgtatgcccaaacaggaatacggtgccgacagccttaccgtgctcgaaggcttggacgcggtgcgcaagcgccccggcatgtacatcggcaccaccgacagccagggtctgatgcactgcctgtgggagatcatcgacaacgcggtggacgaggcgcttgcgggcgcctgcgaccatatcacggtgaccctgcacgacgacggctccgtggaagtggccgacaacggccgtggcatccccgtcgacgtcgagccgaagaccaagctcaccggcgtcgaggtcgtgctgaccaagctgcatgccggcgcgaagttcggcaacgcgtcctataacgcggccggcggcctgcacggcgtcggctcgtccgtcgtcaacgcgctgagctcgcgtctggacgtcgaggtcgaccgcgacggcaaaacccatcacatggccttccaccagggtcatccaggcgtatattccgacaccgatcccgagcatccgtccccggacgcgccgttcaagcgcacccgcaagaaccgcccgaccgaactggagatcatcggcaaggtcagcccgaagaccacgggcacgcgcatccggtactgggccgatcccgaaatcttcaacgacaccgccgaattcagctacgagcagctcatcgaccgtgtgcgccagaccagtttcctggtgccgggactgcggatcaccgtcatcgacgagaacgtgccggaaaccggcgacgacagcgtcgacgagatgatggaagtcgacgccgcacagacgcccgccgacgatggaaccggcctgatggacgctgccgacatcgcctctgcggccgacacggccgtcgaagataccgttgaagcgggtgaagccgaagcgcgacctgccgcagtctccgccgcggtcgagacggcgaaggtggacgcggcccgccacacgcacgcccgcgtcgaggaattccgccacaccggcggtgtcaaggacttcgtcgatttcctgtccgcgggagaggcggtatccgacatctggcgcatcaccggcgaggacacctacgaggaggagacccaggcggtcggcgagggcggcgaactgcacgcccagaaagtcacccgcaaatgcggcgtcgacatcgcgatgcggtggaccaacgggtacgacacgacgatgcgcagcttcgtcaacgtggtcgagacgcccggcggcggcatgcacgtcgacggtttcctcatggggctcaccaagcagatccgcaaggccgttgaagacaacgcccgcaaactcaaggtgaacctcaaggactcgaacatgcgcgtcgagcgcgacgacatcctggccggactcgtggccgtcgtcaccgtgcgcatcgccgagccgcagttccaggggcagaccaaggacgtgctcggcaccgctcccgtcaagcccatcgtcaccaggatgaccgacaagcagttcggcgagatgatcacgggctccaaacgcggctacaaggagcagtccggtcgtgtgctggagaagattgtcggcgagatgcacgcccgcatccaggcgcgcaagaccaaggaggtcacgcgccgcaagaacgcgctcgaatccgccgccatgccgtcgaaactgtccgactgccagccgggcaacgacgatgtggccgagctgttcatcgtcgagggcgactccgcgctcggcacggccaaggctgcgcgcaattccggattccaggcgctgctgccgatccgaggcaagatactcaacgtgcagaaggcatcgttgagccagatgctcaacaacaaggagtgcgccgcgatcatccaggtggtcggtgcgggatccggcgccggtttcgacatcgagcagtcccgctaccacaaggtcatcatgatgaccgatgccgacgtggacggcgcccatatccgcatcctgctgctcacgctgttctaccggtacatgcgcccgctcatcgagcacgggtacgtctacgccgccgtgccgccgctgcatcgcatcgcgctcgccggctcgcacaagggcgagttcatctacacgtactccgatgacgagctcgccggccgtctggcggatctcgaacggcgacacatctcgtacaatcccgacatccagcgctacaagggtctgggtgagatggatgccgaccagctcgcggacacgacgatggatccgcgcacgcgcatgctgcggcgcatccgcatggaggatgcggcacaggcgtccgagatattcagcctgctcatgggcgacgatgtgccgccgcgcaaggcgttcatcgtcgacaacgccgacgatttcgaccgctccaagatcgacacctgatccggctttctgccggctgtgcactgcccgggccgccgtcggcttgtatcaggccggcggcggcccgagccgatatccgtctactgatgctcccggcaggtctggccgaggcggcgcgacagggcgatcgggtcgagcagctcgtcgagcgtcgacgcgggcaggtcggtgcgctcgccggcgacatcgcgcacggtgcgattgtcgttggccgcttcctgggcgatgtcggccgcgtgttcgtatccgatggcgccgttcagtgcggcggcgatcgacggggagtattcggcgtagcggcgccccgtcgaggcgttgatggtgatgccggacacgcagcgctcgcggaacatcgccatcgcgcgggtcagcagctcgatgccgttgagcagttcgtggatgatcaccgggtcgaaggcgttgagctgcaattgcccttcggatgcggcccatgtgacggtcgtgtccatgccgaacaccatgaagcagcattggttcacgcattcggggatgaccgggttcaccttgccgggcatgatgctgctgcccgcctgccgtgccggcacgttgaggtcgtcgaatccggtatgcgggccggaattgagtagtcgcaggtcgtcggcggcctttttcaggtgtatggcgaggttcttgactgtctgcgacgtggcgatgtatccgctcatatcggtcatggccgccacgggatccgacgccgcggtgatgggcagcccggtgatggcggccagatggcgtgtggcggtcgtgcggaaccgcaggtcggcgcagatgccggtgccgatggcggtggcgccgaggttcagcgtggtcagttgcgggacgacgtgttcgagggccaggaggtcgcttttcaggaagcttgcgaatgcgtggaattcctgaccgtaggtcatcggcaccgcatcctgcagctgggtgcgtccgatggtgacgtcgttcgtgtgcttgtcggcgaggtcgtggaacgcccgcgtgagtttcttcgtctcttccgcgagcggcccgatggcgtcgatcagcgcgagcttgcaggccgcggggtaggtgtcgttggtcgattgcgaatggttcacgtcgtcgttcgggtggatgaacccataatcgcctttgggatgcccgccgagctccaacgcccgattggcgatgacctcgttcatgttcatgttcgtcgatgtgccggcgccgccttgcagcacgtcgaccgggaactggtcggcgagctcgccgttctcgacgtcgcggcatgcggcgacgatgagccgtgccttgtcgtggtcgatcagtccgagctcgtcgttggcttcggcacaggcgcgtttgacggtcgcataggcccgcatcagctggggatgggtggagtccgcgattcgggagacggtgaagttaccgagcgcccgctgcgtatggatgccccaatacacgtctttcggcacatccatgtagccgatgcagtcgtgctccttacgcgtgaccgtgtgtatcgtgtcattgccgaccatgttgccgccttttctcgttcaggttttccgggtcaatcatctcgtttttattcgagaaacgctatggttgcgctgagcgcgaatgaccatgcgtccgtgaacgggtccggagcgcggcggaccggcgcgctcgttcggcctgcgagaacggatatcctgcggttcgcctagcatgtgtacgaacgtacataccactggataataccgggagaatcatggccaatttgctgctcgccgcccccctccctacggattgggcgcaggcggcgtcgatgcggcgctgaacaactgtgtggcgatccattacgcgagtcgtcacatgagctggctgtactgcatgtgggggatcggcgcttccgcggcggggcaatgcgccatggtcgtggtgtcgggcgacgtcgtgcaggccaacccggaattcgctccgtcgcgttgggtgtatgccgtcgcgggcatactgggcgtggcgtgcgtcgaggcggcgatggtgccgctgtggaatctgctgacgttggtggaccggcttgacgtgttttccggccgcgcggttcgctgggtcgatgcgatcatcgcatgcgcggcggtggaggcggcgccggtattgttcgtgacgctgtacggaggtctcgcccatgccgaataccgcgacccggcgtcgggtgcctatgtggatgtcgcgctgggggctccgggcgtggtcctgctgggcgcggtcggcctgctgctgctcgcggcgttcgtgctgctgatgctggtcatgcgctcgctgctgaagaacgggcgggccaaggccatacgcttctccacgcttgacggcatctgcgaggcgctggagtgccagtcgggcgatgtgctggagtgggtcgaggagtaggtcgcccgtcttcgagtggtgtgtcgtgggtctaggctgcatcgcataatcgaatatatgtacgaatgtttgaatctgttctcgggtcctaccagggcatggttcaaacatgcgtttgatgtacctactgcggcgcagagccaggcatggccggtcatccatgccgggggcaatgctctggtggtcgcgcccaccggctcgggcaagacattatgcgcgttcctctcggccatcgaccgcctgatgacgggagaggcggatcgtctgaacggctccggtgccatgaccgctccgaagggcgcggctgacgtttccggagagcggcatcggactcggcgtgtcaaggtgctgtacgtctcgccgctgaaggcgctggccgtcgatgtcgcgaagaacctccgcgctccgctcgacggcatcgccgccgaatgcgaggcgtccggccttgccgctcccgatatcggcatcgccatacgcagcggtgacacgacgacacgggagagacgcgccatcgcctcccatccgccggacatcctcgtcacgacgccggaatcgctgtatctgctgctgacgtccaaggcgcgcgtcatcctgcgcgacgtcgaaacggtgatactcgatgaggtccatgccgtcgccggcaccaaacggggcgcgcacctggccgtgagcctggaacggctggatgcgctcgccgggcatgcgacgcagcgcatagggttgtccgccacggtaaggcctgtcgacgaggtcgcgagattcgtcggcgggatccatcccgtgaccgtcatcaatccgcaggagaggcccgcgatggatctgcgcgtcgtcgagccgctggagaacatgagggacctccaatcagccaatgtgcccggccgtgcgggaggcgtcggcgcgtcggcggcatcggccccgcatatcagcggcgtgaccccggccatgagacggctcgccgaacggcgtggcctgccagtgtcgccggatcgacggtcggttctggtttcgccggaggattcgcaatacgattcgcaggcgatcaccggcgccgcgggggatcgggcgggcggatccatatggccggtgatcgagcgggacgtgctggatcaggtgctctcccaccacaccacgctggtgttcgtgaattcgaggggcctggcggagaagctcaccgccaggctcaacgacctgtatgcacaggatcatggcaccgatgccgtgcagacgcagtcaccggaggggcgcagcgggttttcccggcattacgatcccgtggtcggctccacgacgatgctggttcggtctcacgatgacggggacgtcatcgcgatggcccatcacgggtcggtgtccaaggagcggcgcaaacggatcgaggaacagctcaaacatggcctgctgcgttgcgtggtggccaccagcagcctggaattgggcatcgacatggggtcggtggatctggtgatacagatatcgcctccgttgtcggtatcgtcaggattgcagcgcgtcggacgcgcggatcatcgtgtcggaggggtgtcccatgcgctgatctaccctctgacccgggagcagatcatcggggcggcggcgagcgtggaaagcatgcgggccggcgacatcgaaccgatatcggtgatccgcaacccgctggatgtgctcgcccaacagaccgtcgcggccgcatcgatggaggacctcaggccggacgactggtatgcgacggtatgcaggtcggcacccttccgcgacctcgaccgcggcacgttcgactcggtgatgggcatgatgacgggggcctacgacagcgaggacttctccgccttccgtccctgcctgatgtggaaccatgatgaggacctgatctccgcccgacccggggcgcagcggctcgccgtgaccagcggcggcacgattccagatcgcggactgtacaccgtggtgctgcccgagacggatgggggcaaagggcctcgaagagtgggggaactcgacgaggaaatggtgtacgagtcccgtgtcggcgacatcatcaccctgggtacatccacatggcagattcaggagatcacccgcgaccgcgtgatcgtcaccccggcaccgggcaggacggcccgtctgccgttctggcatggggacggcagcggcagggactgcgggttcggtacggccgaaggcgctttcatccggcaggtctgcactggactgacggatgccgcagaagcgggccatccacggttcgacaccgccacggcagaccgcctgcacgatgacgggctggacgacaacgccgtggaaaacctcgcccgactgctggcggagcagaggaaggccaccggcgtcgtgccggatgaccgccgcatggtgatcgaacgttgccccgacgacgagggggactggcgggtcatcatccattcccgatatggccgtcgcgtgcatgagccatgggcgatggcaatcaccgcgcgtctcaagcagcgttatggattcgacggccaggcatacgccgccgatgacggcatcgtcctgaggcttcccgcccaggagcatgacatcgatgtcccggagctcatcaggttcgaccctgacgacatgcagcgcatgatcgagacgcaggtgggggagacggtgctgttcgcggcccggttcagggaatgcgccgcacgctcgctgttcctccccagaaccgatcccggcaggcgcgtgccgctatggcagcagagactgcgtgccgcgcaactgttgaacgccgcgcggctgaaacgcaatttcccgctgctgctggaaaccgcccgcgaatgcctgcaggacgattacgacatgcccgcgttgcgtcgcatcatgacggacattcagtcgggaaacatcggtctggtcgatgtgacgaccgacattgcgtccccattcgccgagaacctgctgttcggctatgtgggcaccgtcatgtaccagtacgacgtgcctcaggcggaacgatcggcgcaactgctgtcgatcgatcccgatgtgctggaacggctgctggggcaggccgatttctcggcgatcatggatcctcgagccgtgcatgaggtcgaggaggagctggggcgcaggacgttctggaacgagctgccggacgatgacatcgatggccgggtcgcaagatacgccaagacgcacgggcctttcaccgtcgaacggatgatggcggacctgtcgatcgacgcggccggcgcggtgcacgccttggacatgctcaaagcacgaggagaggtccttgacggcatcgccgccgaggacggaggaaaggcatggctgcacaaggaggtgttccgacgcatccgggccaggtcgctggccaaggcccgagccgagaccaagcccgtcgaattgagcgaataccagacattccttatcgggctgcaaggtgtcgggccggtgggcggcgaacgatatgacggcgaagacggggtgatgcgtgtcatcgagcagctggaaggcgtcgccctgcctccctcggtatgggaatcgtccgtattgccggtacgggtgcgcgactatcgtccggcgatgctcgacggcctgctctcctccggcgagatcgtctgggtgggttccaagaccaccggcagcaaggcgaaggaaccaggactcgtcgcattgcatccggcggactccctgcttctgacagtgcaggatggggagaagaacggcgaagcccccggggagccggtcacgctgccggatgcggtgatggccgtgctggcaccgggcggggcatatcatgcgaatcagctcgcagggctgacgcgcgcggcatgggacgcgtcgtcggaatgcgtggacgaatccaccggcgagatattgccccacccatgggccgactcccagttcgaggaggccctatggtcgctggtctggcaagggaaggtcaccaacagctcgttcgatccgctgagatccctcggagcgtcatcccatgcggtgaaggccccagcccgtgcatcacggcgcagggtgcgggtcagggtcagtgtcccggcgaacatgacgggactatggtccgccgtgcctcatgcagatatgcaggaggcgtccgcggagcgggtcgccatcgcgcggattgaggcgttgctggaccgttacggcgtcatagctccgcccatgatcgacaaggaacgtctggacggcggattctcgggcctgtatccggtgctcagacgcatggaagagcatggcgcattgatgcgcggcatgttcgtcagcggatgcggtgccgcacagttcgcgtcgcgtcagaccgtggatgcgctgcgggcatgcgcggcggaaccctccgcggtcgtgttggacgccaccgaccccgccaacctgtacggaagcgtcatcgcatggccacgaacgataggcgggttttcgatcaggccggcgcggcgctccggcgcatcggtcgtgctccggggtggacgattgctggcatacgcggtgccccgaagccatcatctgttgctcgcgcaagacgcggatcccgcattgcagcaggcctgcaacgagctcgcctacgcattgcagcgaaacctgcgtgacgggggtattcgcgggggtgtcaccttctgtgatgccaacgacgagccattgactgtgcgaggcgagtggtcgcgcatgctgcacgtcgcgggattcgtccccgtaccccaaggcatgaggctctactgctgacagccgccgccggtctccgatatgttccgccgccagcgccaggtcaccggcgtatctacgcgtgaggtacgccatccggcattgcgcatcatccgacacggcgtgccatctgatattgcgcgcctgcaggaactgcgcgtctgccgaaacgtggacggcacccccccctacgccccacaggtgtgtgtgggacgatgctcgctgaaggcaccggccccgaaacagcctcatccgcagaaggcgacaggcgcggccagatcgacaccggatgcgtcgcggcgcatgtcgggcttgggcagctccaccggcgagcctccctcggtggaggcgtgcagcgggtacatgccgacgcgggcgaagatcagggtgttctggcccttgaggaaacgctgcgacctcactccgccggtgccgcggcccttggtcgggtacatctctaacggcgtcaccttggccgcgccgttttcggtgccgggcagcgcgtccttgtctccggcgaccgtcagcacgacggctccggacgcggagaacatgccgttgtcgccctcttcgtacgtccacgcgatcttgcctgcgggcactacgttgaacgtgatcgccgtgcatccctcagccagacggattcccgccatgccgccggcggtgcgaccctgtgggcgcacattcccggcatcgaacgtcagcagcgaggagtcggacgcgacgaacacgaggcggtcttcgtccgccgcgtcggcggcgaacagcacggagtcgccgtccttgaggtcgatgacgctccaggagtccatcgtggtgggggcctcgcggttccagcgtttcaccacgccggcccgtgtgccgatggccaggggagcgggggtcgggccgtcgtcgtcgcgctgatccatggggatggcggcgacgacatgctcgccgggaatcggatcggtgctttcggtcatgccgatcagctcgtcggccggtatgccgccggcgacgttcgtctgcggcgatgcggcgagcgcgggcaattcgaccacatgggccagcaccagacgcccggcggacgtgaccagtccgtacgaggaccgtgtggtggtgcggaagatggacacgatgtggtcgtccttcgtacgttcgtcgctcgtcgaccgcgacttccaggcatccaatgcggccggggtggagcgcgctatcgtgccggacgcgccgagcatcaccgtgcacggctcgtcgtcgatttgcagcgccgcgactgccgcggcatcctcgccggccttcctggccgcggccgcggcggccacgtccgcttcggccgacgacagggtggccgcggctgcggcggccttcatcgcggccgcgttcacgctgtcgtctccatgaggagtcaccggcgtcagcgtgccgtcctcggcctcgtccagcagcacggtacggcgaggcgtcccgtattcggcaaccgcctgatccatttcgtcgacgaccacgcggtccagttcctgcgcggaggccagtatgcgctccagctcctcgatacgccgtttgaggtcgtcgcgctccgcctccagctcgatgcggctcatgcgtgtgagccggcgaaggcgcaggtcaaggatgtactgcgcctgcacgtcgtcaaggtcgaagaccgcgatcagccgcgacttcgcggcgtcggcgtcatccgaggtgcggatgacctggatgacctcgtcgatgtcgatcatggccagcagcaggccctcgaccaggtgcaggcgctccagcgccttccgacggcggaattcgctgcgccggcgcaccacgatgcggcggtggtcgatccacacctgcaacatctccttgagacccatggtgtggggccggccatccaccagcgcgacgttgttcatcgtgaaattgtcctgcagcggcgtgtgtcggaacagctgcgcgagcacggcgttcgggtcgaaaccggtcttgatctcgatgaccagcctggtgccgttatggcggtcggtcaggtcgatggcgccggagattccctccagcttgcggttcttcaccccttcggaaatgcgttccagcacccgttcggggccgaccatgaacggcagctcggtgaccacgatggccttcttgcgcgccgtcacgttctcgaaatgcgtcatcgaccgcgtggtgagtgtgccgcggccggtctcgtacgcttcgcggatgccgtttcgcccgatgatgatgccgccacccggccaatcggggcccggcacgtagcgcatgagctcctccagcgtggcgtcgggatgcgccatcaggtgcttcgcggccgcgacgacctcgccgagattgtgggtcgccatgttcgtggccatgccgacagcgatgcccgaaccgccgttgaccagcaggttggggatcgcggccggcagcacggtcggctccttgagcttgttgtcgtagttcggcgtgaaatcgacggtgtcctcgtcgatgtcggcgttcatgcccagcgccgcgggcgccagacgggcctcggtgtatcgggaggcggccgggccgtcgtccagcgagccgaaattgccatggccgtccaccagcgcgagacgcatcgcgaacggctgcgcgagacgcaccatcgcctcgtagatggctgaatcgccgtgggggtggagcttgcccatcacctcgcccaccacgcgggccgatttcatgtacgggcggtcgggcgtcaggttcatctcgcccatctggtagatgatgcggcgctgcacgggcttgaggccgtcgcgcgcgtcaggcagggctcgcgcgtagatcaccgaatacgcgtattcgaggaacgacttgctcatttcctcgttcaacggcgtttccacgatatgctcttggacctgacgcgggtcataggcctgatgagtcgtggtgcgatgtgccataggtgccattccccaatctgtgcttcggccatccgcatggcgcgaatggccgaaatggtgccgttgaaaaatccaatcgtccatgatagcgaacaatcatgccaagaatcccgcccagccgtgtccttttccgacggacggtgcttgaatggaaaacatgaacgctgaaatcgcgagcatggacgaattgctgcagacgataccgaccgttcggtatggcgactggcggcgtgacgccgtacgcggcggggcgctgcacctgtccgccgtgctgccggcggtcagcgcggcgatagggcatccggtcgccacgcggatccaccatgatccggaggccttgcgcgtcgccctgggggttcccaaggccgacagcgtgatcgtggcgctggttgacggccttggctactggaaccttcggatgcgcgtcggacacagtccgtacctgcgcgcattgctgcgcgacgagtccaacgacaggcccatcgccacatgcgcgccgagcaccaccgtcgccgcgatggcggctttcggcaccggcacgtgcccgggcctgacggggatggcgggctacacgcagcgcaacacccaaacgggggagctgtcgcagctgatccagttcgacaacgcgatcgcgcctctggacctgcagagggagcccacggtgttcgagaccctgcgggccgccggcgtgcgggtcaccagctgcggactgccgaagttcgccggctccccgctgacgaaggctgcgttgcgcggtgcggactacaagggcgatatgcggccgctcggccgcgtgagggccgcgtgcgaggcctcgaagacgccggggctgacgtacctgtacatccgcgacgccgacaaggtggggcacgcctacggctgggagtccgagcagtggacggccgtgttcgagcgggttgacgaacagctggcgcaattgcacaggcttgcgccgaggggcacgctcatcgtcatcgtggctgatcatggcatggtcggttcggatccggaccagcgcgtcgatatcgccgagaatcccgagctcgcccggggcgtggccctggtcggcggggagcccaggtctctgatgctgtatgccgagccggattgcgacccgaatgacatcgcgcgtcgatggcgcgatcggctgggtgacgccgccctggtgcgtacccgggatgaggcgatcgatcagggcatgttcggtgtcgtcgagccgcgtgtcaggccgatgctcggtgacgtgctggtatcggcggccgggagggcgaccttcgtggattcgcgcatccagaccgacaaggcgacgcgtctgccgggtgtgcatggctcgcagacggcgctggaaatggacattccctgcctgattgacgtggcgtgaccgtttcgatgccgaacgtgtcacgccgatgtctcattatccggacggcctgtcgcgtttttccgtaaaaaaggattgacgtgtctcgctggacagcgacggcgggccagacgatcctactcgccgaagagaatctcgtcccagctgggcacggcggagcgacccgaacggcgtttcgcaggcggcgtctgccggtcggagcgttcggcagacgtcttgccggattcggattcgatctcgggcgccgtctgagccgcggaagcggacgtgcccgaatccggtgtcggccgcggcggtttcgactcggcggcgccgagcgcggcctcgccggccttcgccggaagcgcgccggtgcgcgggatgtcgattgaggggccttcctcggatggcgcaggctcggtgcgcacgtccaacggggacgccgaacgtggcatccgcgcttcggggcgagccgcaggcagtgtcggggcaggggtgttccacgccgacacggtgcgctctatcctcgccgagcgtaccgaatccccgggcagcgtcgcaggcagcatctcggagggcgtgccctcggtcccgtcgccgcgcgcgcccgtcgccgttcccagcagcttcttcgccgtggagttcaggcatgccaccgcgttgtcgtgcatgttccaggaccattccgccctggcggtgcgccccgcggcgtcgaacgtcgcggtgatcttccacggttcgagtccccggcgtgtcgccttccacgtcaccgattccatgccgatgccggacagcgccagcgcgcgctccaccacgtcggcggtggtccgcccacggctctccttgggggccggcacggtgaggaactgctcgatggcgtactgcttctcgacctcgacggcggacgagaaacgccgcaccagcgcctcgctgagacggtatcgttccgccacccgcgcgggatccgcgccggcccggataagcgcctgaatctgcgagatcggtagcgtagccgagctggatgcgctgggagccgaccgggactcctcgcggatctgtttcgcttccagaatggcgcgttccagcgtttcgtccacatcgacgaagaaacgctcgtcgcctgacgcgaacacgagacgacccgtgtcgtcgacgtggtcgaaccgggcttgtgtgagcgggttctcaggcatgttcacaccactttcctcagaaaattacaacttcttctattgtgccccacgtgtcgtattttacgagtatttcaaatcgtgtatcctatgccgagtaaaagtcatgtattctatggcgcagaacgtgccaccatgatgaaaggattcagatggctcaggattatgattccccccgcaataaggacgaggatgaggaatcgctgcaggagttgggcaagggctcgcgcagctcttcaaccgatatggacgacgacgagaacgccatcgccgaggattacgaactgcccggtgccgatctgagcaacgaggacgcctccgtgaccgtcatccccatgcagaacgacgagttcatctgctcggagtgcttcctggtcaaacatcgcagccagctggcatacgtcaccgacgacggccagccggtgtgcgaggaatgcgcggcctgatggcgttcgacgagacatatgacgagcccgaatacaccgaggtcctggtcaaatcgcttgatcccggccatccggtcgagctgcggtacgcccacgccggggacgcgggcgccgatctggtcgccgccgaggacgtgacgctcaagccgttccagcgcgccctggtgccgaccggcatggcgatcgccctgcccgccggatacgtggcgctggtgcatccgaggtccggactcgccgtcaagtacggcgtgaccgtgctgaacgcgcccggcaccatcgacgccgggtaccgcggcgaagtgaaggtccctctgatcaacctcgatccggagcatacgatggagttccatcgcggagaccgcatcgcgcagctggtcatccagcgttacgtcgaggcgaggttcgtcccggcgagcaccctgccgggttccgaccgtgcggaccgcggtttcggctccaccggcgtgtcatcctgacggacgatcctggccgacggtgcgaacacggccgtcacggcccgcaagccaaggcatgcgggagaccgttcacggcggaagatgccgcgtatgctttttcattcgcggcgggtaggatgtgataccaaatacctgagagggaggcagacatggccaacgatgaagccgagcataatgccgcccgcatgctcggctgcgagatcagcgacgacccgctgaacccgctgctgccgatcatgcaagcgtgcaggaaccatcaccccgacgaggatctgagcattctggagcgtgcctatcgtcgggcggtcatccagcattcctcacagcgccgcaaatccggcgagccgtacatcatccacccgcttgcggtggcgcagattctcgccgacctgggcatggggccgctggtggtcgccgccggtctgctgcacgacaccgtcgaggacaccgactacacgctggacgagtgccgcgcggaattcggcgacacggtgaccggtctggtggacggtgtcaccaagctctccaagatggaatacggcgattccgctcaggccgagaccatccgcaagatggtcgtcgcgatgagccgcgacgtgcgcgtgctcgtcgtcaagttgtccgaccgtgtccacaatgcccgcacatggcggtacgtcaagtcgtccagcgcccagaagaaggcgcgcgaaacccttgacgtgtacgcgccgctcgccaacaggctcggtatgaacgccatcaagaccgagcttgaggaactgagcttcaaggtgctgtacccgaagatctacaacgagatcgtggtgctggtcgcgcggcgtgccggccagcgcgacgtgtatctcgcgcagatcctcgccgagatcaacgaggatcttgacgcgcagcacatcaaggcgtacgtgaccggccgcccgaaggactacttctcgatctatcagaagatgatcgtgcggggccatgatttcgccaacatctacgatctggtcggcgtgcgcatcatcgtcgacacgattcgcgactgctatgcggcgctcggcgccgtgcacgcgcgttggagccccgtgcccgggcgcttcaaggattacatcgccatgcccaagctcaacatgtaccagtcgttgcacacgacggtcgtggggccgggcggcaagccggtcgagatccagatccgcacctgggacatgcaccggcgcgcggaattcggcatcgccgcgcactggaagtacaaggagaacgggcaggcgggccgcgccctgagcgcgcccgacaaatccgatctcaagcgcggttccgacggcaaccaggagctgagcgagaccgacaacctcaaatggatccagcagctcgccgattggaccagcgagaccccggactcgaacgagttccttggctcgctcaaggaggatctgggcgcggccgaggtctacgtgttcaccccgaagggcaagatcgtctcgctgccggccaatgccacgccggtggacttcgcctacgccgtgcacaccgaagtcgggcacaggacgatgggcgcgcgcgtcaacggccgtctggtgccgctcgacaccaagcttgagaacggcgacaccgtcgaggtgctgacctcgaaatccgacaacgccggcccctcccgcgactggctgagcttcgtcaagagccccaaggcccgcaacaagatccgccagtggttctccaaggagcgccgcaccgaggccatcgaggagggccgcgacgagctgacccgcgcgatgcgcaagcgtaacctgccgatcggcacgctgctgaccacccaggcgctggtcggcgtcgccgacgagctgaatttccccaaccccgacgccgtgttcgcggcgatcggcgacgggcagatctccacgcagaacgtcatcgcgcatctggtcaaggacgcgggcagcgacgaggttgatgaggaggttgagcaggaggcgctgccgctgcgcgcggtcgagaacgccaagaagaagaccggctccctcggcgtgtccgtcaagggcgtagacgatgtgtgggtcaagctggcgcgctgctgcatgccggttcccggcgacaggatcgtcggcttcatcacgcgcaatcagggcgtgtcggtgcaccgcgccgactgtcagaacatgatcgacctgcagcgccgtcagcccgagcgcgtcgtggatgtggcatggaccagcaccaagggcctgttcatggtcaggattcaggtcgaggcgctggatcgccagcatctgctgtccgatgtgacccgcgtgctggccgaccacggcgtgaacatcctgtccggctcccaggcgaccggctccgatcgcgtggcgatcagccagttcagcttcgagatggccgacccgcagcatctgaaccgtctgctcgctgccgtgcgcaagatcgacggtgtgttcgacgtgtaccgcgtcaccggcgcgaaggattccgccgtgccacgcctgcgcaagatgcagtagccggattcgttccagcgatcgtccaagtcttccgcccgtcgcgctgccggttccgcgtgacctttgcaaggccggacggccccggggatgacgggcgtgcggaaaatcaccctttcggacgagggcatgacggcacgatccggtgtgtaatcgatagtgtcatcgattggcgggatcgccgatggtggcacgatgaatatcgaccggcgccggacatcagagggacggcgcccatacgggatcgaggcaggcatgttcttccttcagcgtagacgtcgcccggctttggcgcgggtggttcgcaacagcaatgcgactctctggcgatacggtcgccgggagtatgacatggaggccggcgcggatggtcggacggccatgacgtccccgatggaacgaccctcctggacggattgcagcgatcgccgggcgccgcatgccgtctcgtcgacgttggacgccgtcctggggcgtgtccatgacatcccccagtcggcgatgtcgcgtctgagcggctctcccacggtgtacgcgcgctgacggtgacgtgccccgcttacgggcgcggcgatgcggccggccgcgtcggggcgttctgcaggacttgaccgctatgagtacgatcatcatgcgtgcctctgatgataatcgcgtgtggtcgttttttgctttgttccaaggttttcgttttttgggaggcctgccgatcagcctcgttttcgccgaggcatctacaggcacgcgagaacaatccggtgacattccaccgtcctgccggcgctcaacgtcttcgccgaccggcacggaaaaagaacgatccgccttgtgatttcatgatgttcagcatgggcgatgcccaaaagcattcgcccagcagtacgtctccgtgtcggacaacaggcacgccgggcacgaggccttcaatgtctccgtcacgcagaaccatctgctcgacgtgaccgttcgtggatggtgtccggcgtgccggttcgatgaaagaaaccgcgaggatcacggacggttcggcggcgacataccgttgtttgatttcgattaatgcccgaacgatctacgtggttgtttggactgcgctagtttaccggtctcaagcatgtgcatggcgacaccggtggaattatgtgtttagttccaaaggtctggactatttttatccagtaatgacggaacggattccaatgggattgcgtgtggtaagcagaagggatgcattgactgcgatcgcggcgcattcggttggcgcgttggggagtgttccttcgtagagggtgattagcactgcggaggagtcttcgtcgacggtggcccgtacaccatgacatttgggatttcccatggagaagaaaatgcgcacggaggtgtccgagaccacttcgtatcggttccatgaggatatatgttcgttgctgaggtcggttcgttgctgtacgtcgttggaggattgctccggtgcctctgccgcggaatcgtatcctgcatctgtacctggtgagctggggctggattcgctcccgttagttgcgcatcccattaccgtgatactggtcaaagcaaataccagaagcgcagcaacaaaacggctgcggaagcgaatccaactggccatgatgttgtttcaccagtccttgtttgctgcaacgaacaagtcgttgacgcggctgtcgaagtatgggcctcgaagataggaattgtctgcggggccgttcgaggttacgctgcgtacatatccgagaccagtggtattgctgtattcgtcgagccaaggtccaccggacgaaccaccgccgaaatcgcaaccagtaatatggttgaacttgtaaaggccattccaaccagtttgactagagccccagcaggcccacatgctttggcctccgctgaggttcgttggatagccgaaaatactgacgtcgaaaccagtacctctgccccacctaaacccgtgaccaccaaccgcgtttacaacagtatccccggaagtgctgccactataggtggtaacaaaggcaacgtctgaattgaatcctcgcccggattcaccatagttgatccagtcattgagcgttcggagcgtggcagcttggtaagtgccatacgtggcaccgttgctgtaacccggtgcgaatatccaattggtatgccaatcttttcctgggccgccatggacacagtggccagcagtaacgaccagacgtttggaacggctattgacggaggctccagagcatacgtaatccttgccgtcggtctgattgcggaagaaaacttttccgttggtctttgagaaattcgtgactggcgtcacagcctgtggcgtgattgcattcaagattgccgtcacgggggacgatccgtcagtaactggttcgtctgccagagccggttgttcgagctcgtcaatctgtcggtttacctcggtcgtgcttgttggtgtatcagcgggaatggcactcttcatgcgttctggagtccagtaggctgtgacgatggggtcgccgacgcttgtgttattggtcggaacgtaagtgtaggtacgatttgcaccaagggctgttacctgtgcacgcacggctgttgtggtggacgaagacaatggatcacttgccatgggcgatgcggatgccggcacagtggtcgagataaggagaacagcggccgacacgaaggttgtgagggttgtgtatgtattgcggaatcgagtcatgttgatctccccgggagttggttcacgtaggaactgggataagtatgtccgttgactttcagtgtctacgaacatacgcgagtaagacgttcacaacttatgattagggctacattacatacctaaatcacagaaaaattataactccatgacgccaatcggattggcgacagcgtgttggataggtccttagaggacgatcctcgttcgatgaattccttcgggcccggtatccgaggatggaacggagccgctggtcgtcgaattaccacacgtagtcgttgaggtcgcgcctcagtcgctcgatcgtggtgtagcggttccagttacacaagctccttcttcaacagcaggtcggcgaggcgccgaccgtgccgtcaagccgcatcaacgaagtcgaacgcggagcatggaacctgcccgaactcaaacaacgggtccaaacgcttgacaatgtataggagcatcaaaatacagagcaggagccactcatggctgtcgctgccggtgcgctgatcatagtgaaccaattcgtatgacgttccgcgttgcagctcggcggcccggctaccggccgtggccagtccacgggcccgctgcgccattccccgcaatcaaacagcaatgcccggtctcaagcccatgagacacttaaagtcatgactaccatcatcatgcgtgcctccgatgataatcgtggtcagctgtttttggctttgttccaaggctttcaatttttgggaaacctgccgattaccctcgtcttccacgaggcacctacaggcacccaagcataatctcgactgattcccaccccgacggtcagccataactggacataccgtcaaaaccaaaacagtcacctatacgaaggtcaaggacacacagactaatcgacatcaaaagagcgaacaggcaagttcagctcattctctagattgttaatcgccctgctcattttgcctatcaaatcaccattacgaatatgctcaggaaaactaagcttatcacgccgaagttcctcctcgagacatttttccgcttcctgattacgcattgtaactgttgaacaaattagggggtaactgatttccttctgggcggagggactgaaagcaacagagaaatctgtaatggaatccagccatacttggtcttttgccgtcactaaaactgcgttcgctccaacataattgctctgatgctcgagtctagctggagggactaacataccaagtcgatatccatcaagagcctgaataaaccatgcatcccatgcggcattccatgctttttgtcctagacttttcctcttatgatcgactttaagaagtgagcgtgctttccccttgcttgcttcatctcctaggagaagagcagccgctatcactcttgcgtatgcagaaacacatccaagctcctcacggacccattcgcaatgctcctgaaacttttcgacaccattatgtctattggctccttgcaccagtttaagcaaatgaagtaaagcgccatatgcaggcataatgaacgaacgaggatctccatcgtccatccccaacattgatggcgaaggaattgagacttttcctttctcccactgtttatcccgcttaacagggggatgtctgctatcgaaagccttatcaatcttctcctgattccaattcacaactgtttgtaccgcacggtagatacgccgacaacgtaaacggtcgaacccctcttgccgaaaacaagtctctgctaaagcaaaaccaaatacaacgtctggacgcacttgcttattgggcgacatagttacaagaagctgatggagccccgacgccgaattcggattcagcccatcaaaataaaaattcctaatatcaatcaaaaccaatgagtctaatagaaacacatcagcctcacagagatcaaaatccccgttggtaataagcctgtatttacctatatcacgtaatttgttcatacaacttatcatattcattcgcccgaatactatgcccgggttctaaatagaagtgcaacaccttgtctagggttggaagtgttcgaagtttctaacttaagaaggtgttgcactcatgggtcaacagtattcgcacctgtcgtccgaggagaggatcctgatcgagaagctgcattgcgagcggcatctgagcatccgtcggaccgcggagaggatcggccgggacaagtccaccgtgagccgcgagctgaggcgcggcctgtggttcgcgtccaacgagaacgggtcgtaccggccctaccggccgaaacggctgaagaccgggccgtggacctcgggtccgttctattcggcgctggccgcgcagagaaaggccgaccggcgtcggcgcgagtccaggaaaccgcgtcgcatggattcgggcccgttgcgcgcctgggtgcttgacgcgctgcgcagggggtggagcccggaactgatcgagggacggttgaaggcccagtacgccggcgacccgtcgatgcggatcagccacgagtgcctctaccagtggatctacgccaagccgcagcgggcgctggacctgcgccagtacctggcgcgcggcaggaaacgccggacgaggaaaaagggcaggaaggcgaaggggccgcgcatcccgatgcgcgtgcccatcgcggaccggcccgaggcggtcggatccaggaaggggttcggccatttcgagtcggacacggtggtcggcgccgcgccgtcgaggcgctgcatgaacacgcaggtggagcgcaggagccgcaggctgttcgcccggctcgtcgacgacaagagcgcgtccgccacggccagggccgaatacgagatcttcaaggacatgccgccggccgcgcgcgtcgaccgcacgtgggacaacggcacggaggcgagcctgcacatgctggtggacgaggcgctgggcatgctcacgtacttcgccgacccgtacagttcctggcagcgtggcagcaacgagaacaggaacggcaggatccgccgctacctgcccaagggaaccagtttcgaggatctcacgcaggacgagctcgacgcgatcgtcggggagatcaacgacacccccatgaagctcctcggctacaaaacgcccaacgaggtatgggacgaggagatggccaagctacaatcaaaacaagccgacccgaaaccagccgttgcacttacaagtgaatccgggatggggctggcgataatgacatcagctacgttgcacttggcatgattgatagcaaagagctatatgaagaggccgcgaagctaggcatcaaccgccgagtcgcagtcaacccaaacaatttcctaaaaggggaaagtcaatgaaggacacggagaacaggccaccatcgagaaaacgcaggaaatggggatcggtgatcgtccgcagggacacggacggcaacccgaccagtttccaggcgcgatacgtcaacccgctcgatccgcccaagaaggtcggccggaacttcggtctggaatacgagacggaggcctataagtggctcgacgaggagcgctacctcgtcacgctccacaacaaaggcatccgccaatgggttcacccatcgcagcgaggcgcgggcacaatgcccacattcagggaatactccaaagactatttcgacggataccgcaaaccggacggcagcaagctatccggccggtccaaccggtgcaacgagatcgtgctacgccggctcaacgaggcgttcggcgacacaccgctcgaccgcatcacccgccagatggtcgacgaatggtacgtgaacgccagggacgagctgacggcatggacgttcgagcaggcggcgcgaacgctcaaacgggtcatgctcgccgccgcgaccgagcaggcggacggcaccccgccgctcatccccgcgagcccgtgccggtaccgcgtcatcaaaccgcaatccaaacgacgtgaccagccgccggtcaccgccgacgagatcaacaggctggccacgctcttccccgactaccaacggctcgcgctctggctctccctcctggtaggcggactgcgcatcggcgaggtatgcgcactgcaactcagggacatcgacctggagaacctgcaactccacgtccgacactccgtcaaccgcggccccgacgacaggggcaaataccggttgtgcgagcccaagaccaaaagcagcaaaagggtcgtacccatcccgaaaccgctcgccccactcatcgaggaccatatcagccggttctgcaaggaccgcaaacccgacaccatgctgttccactcgaccatgctggacgactggctgctcccgcccacgaccatcgaacgaacattccgcatggcccgtgaaaagatcggacgacccgacatcaccttccactcgttgcgcaccacgcacgccaccatgctcgtcctcgagggcgggaccatgcgcgagacgatggacgacctcggacacaccagcctcaccgtcgcggtggacagctaccagcgcatagtcagggaacaccaccgcgacaccgtggaactcctcgcttaccggtacatgccctcgaactatccgaccgtgatccgcacggtcatcgatcagaaggaacgccagatcgacaagctccgcagcgaagtggacagactcaggaagatcctacaggaaaagaactgacgacacataccaagaaaccggaaccggtaaataccgggacaccggtttaccgagataccgaaaaaacgaaataccggaatgctgaaagaacaagataccgaaaaccagataccaaggtaatggatcctggcccgacgcatccgaaagtcatcttgccttgtgcccgcgttcaggctttccttgccccggggagacgacggtgcgttggtaggagtaatgctcgtacacgtgacggcgctgcgcgagagacatgtcgtatgccgtgttcgccggttgcgcatattcaccaagatgggccaggtcattcgacatggtcaacggttctgacaacggcttgacgattcttctgaacatatcctcgagaggacgcaggtcgtttcgctgcatccccgcgatcgaggcttgatcgttcgtccttttgtcgatgagtccccagtcgaaatgccagccggcctcgcgcgcgatgatctcccagaaaatgcgctgcgtccgtccgttgccctcacggaacgggtgaaggatgttgaagttgttgtagctgacgctcagacgctttacgaattcgtcatggccgagacctttgagaagatcgtcggcgcgaagcacctcctcggagtagcgaacccctatgctgaacagctccaatggctggaagggaagcccctcgcccttgcccatgtcgatggttcgcacctcccccgcccagtcgtacacgtcccggaagaggaaccggtgtatgcggcgaagctgttccagcgtcccttccgcaggagggaggttctctctcagaatggcggcgcgggcggagcagagatcgttctccgcagccgccaacgcatcctcgtccgtggcgcccacaaggttccgcagcacgttcgttcccggaatcaggtagggatcgaagacacgcgccatcatcactccagtccgtaacggcgacgggtgcgggcaagaagttcggtgccatcgattgttccccgcgcatattctccggcatcgcgcatgaaggccctcgtcacgtcgccgccttccaaccgcacggactgcaccgacagcccgacgttctccgtgcggcggcgcatctcggattcagatatcgttccgaacatcgtgcctccctttctccttgaattctagcaaaaccgacagcccttagacagagccgcgcctgattccgctcctcacgcatgtcgtgtcaggcgtcatgccgttcgttccggtccgcgtcaagggccgtagccacctcttccgataccggcatgtacatcgtccctgtcgtagatctgcgcggcggcccgtttcatggcgcggcgttcggccctggatcatgaacatcgtcgcgacgtcgccgaacgtctggcgctcgaatacctccccgccggggagccggccggcatcaaggcgcagatagcccggaaggaggaggaaatcgaccagctgcggcagaccgtcgccggactccggagaagactggaggagctcgaagacgacggaagggaacggaaccaggccggataggcatacccgcaaaaccgaaaaaccgaaatattgaaaaaccgaaaccggtgaagaccggcatcaaacggaacggacctcacgcgtctaagcgttgcaacatccataacgacaacacttagacgcgtgaggatggataccggaagaccggaatcggtggataccgacataccgaaaaaccggagggccgtgaaaccgaacgacgcggggggctgggtgaagaccagcgtgagccttcgcgcctctcaccgcgatcatcggcatcccgatgggcctgaccagcatgtccaactccgtgtccatctccgacacgttcgcccagctgccgcagaccttcggcgtgatcttcagcgccgatggcttcccggcgctgttctccgacgtatccaaactgccgctcgtgctggtcacgatcttcgcgttctcgatgtccgacacgttcgacacgctcggcacgttcatcggcaccggccgccgcaccggcatcttctccgatgacgacatgaagcacatggaggacggcaagggcttctcctccaagctggatcgcgccctgttcgccgactcgatcgccacctccatcggcgcgatctgcggtacctcgaacaccaccacctacgtcgagtcttccgcgggcatcgcggcgggcggccgcaccggcctgacctccgtggtcgtgtccatctgctttgcgctgtcgatcttcctgtccccggtgatctccgcggtgccgtccgcagcgacggccggcgtgctggtcatcgtcggctgcatgatggcctccagcctcaaggagatcgagtggagcgacatctccgaggcgattccggcgttcttcgccgccgtgttcatggcgctcgcgtactcgatcagctacggcatcgccgccggcttcatcacctactgcatcgtcaagacctgcaagaaggaagccaagagcgttcacccgatcatctggattgtctcgctgctcttcatcctcaacttcatcctgctggcagtgctgtaatggcatctgccctgccttgaatcccggcccccgttggttttccagcgggggccggattcgtatcgtgccgtcttgtgtgtttgctctctcggcaatacgatggatgtaagggacagaacggactgccctgtaccacccgtcgcgacgatggtgttgacggtgggcggcgatccgtccgcagacgacgatcagatcgtggcctgcgagatctacatcagcggccagctgctcgacagccagtaccggcgcggcaaggacgtcacggtgacatgctcctacagctcatggcagcaggagccgttcaacgggcgcgaggtcgacctgccgaggctcggcgaatacggcaacgatctcgccaagcttgtgtcctgataagatcgaggccgttgtctttcataacacatagactgagtggatgctgagcgcaaggtcgcgattggcatactggacaatcagaaacagctggcaaagataaaggctgggacacaatagggtggccgattttcagaggtgaaagaaagcgatgtccataaatgaaccgaagaatatccacgtggttgcgcgggcgtgaccttccatggagacctgccgccgccgtgatcgcgcaggtcaaggccaaggatctgggtgggtatacggatgagtccgtccgggcggtgcgtgatgcgcttgctgcagccgagaaggtcgctgccgatcctgatgcgacgcaggtcgcaagtctgaatgcggccgtcgacgggctgaaggccaaggatgacggtgacaagcccggcgcgggtgatggcaagcccggcgacggcaagccgggcaagggcgacgagaccaagcccgataccggcaagaagggcgggctgagcgccaccggtgccggcatcgttccgatcgccgccgcggccctgacgctcatggccggcgcggcgctcgcactggccaagcgctgagacgccatggggcggtcggcccgtcggacggagatttttcgtccgacgggccgattatttgcagcctccgaccacgacacgcccggagtgcgtagcacaatcgtcgcgcgcgtttgcgggaatcggctccatggcggcgtttcatgaaattcggcatgccgatcttgctgagcactccgggcgtgtcgcgatggaatgccgcctgtttagtcaacattccggaccgatgtgagccgcataggtcttcgctggcaaatcctcacttatggccacgattgccgtgagaaacttatggtattggcagcgtggcgttgataatgcttgacgccgtgaagggatagcgaggtctgcgacatgaggaaccgtgtgattcatcgcaattcgcgcgccggcgattcgccgttccgtctgctcgccgcggcgctcgccgtgctgacgttgaccttattggcggttatggtgccgtgcgagggagaagcgcacgcagccgcgcccatcaagatcgcatgcgtgggcgacagccttacggacggctccaaatccagtggcggcaagaaaggcgacaccgcatatccggcgtggctcggccgcatcctcggcagcagctatgacgtgcgcaatttcggcgccgctggtgacacgctgctgcggggcacgggctggtcatattgggattcggccgaattccggcagagcaaggagttcgcccccgatatcgtcatcatcatgctcggcaccaacgattccaaggacgcctactggaacgagacactgtacaggaccgaggcgaaggagctggtgagggtgtaccgggatctcgccagccgaccggtcgtgtatttcgcgagttcaccgcactcataccggatcgcccccggtaccaaatatgtctccgtcaactccgtgaacaggttacatcccgtacaggagtcgctgatccgtgacgagcgttggaacaccatcgacctgtacgcggcgaccgcgaaccggcggcagctgtatgacgccgacggcgttcacttcaacgacgacgggtaccggttcctcgccgagcagatcgcaggcgtcatgcaccggtcggcgcagatcatcggctccaccggaagggagcgggtcatcgcaaacgagacggagaacggcgccacgaaaagagccggcgtggaattcggccttacctcgcagggtaccgccgccgggaacgccggcgattcgtccgatggcaacgggaaacgggatgccctgcgcggctccgatgccgtcgtggccatcatagccatgctgtcggcgggcattaccggagtggcgctcgtgctgggcggacggtcgcgacacgcccgggttgaaggtgtccgctcgcggccgtattctatatgacttgtaaaccacagaccgttggttggagtgtgcaagcactcacgaagtttggttcgccaagccagcgcaggttgagaaatatgtgcctgtaatacggctcgccggaaacggttgtatgttgctctgcctgtgcgcagggcttttttattgccctggcagggtgcgcgggacttcgcaggatcaatggccgatctaggaaggaacgccatgaagaggcccgaaaaggaagcggtagtcgctcagcttacggaacagttccgtaacgccgacgctgtctacctgaccgagtaccgcgggcttaccgttccgcaggtttccgaactgcgcgaaaagctaggccgcgatacttcctacactgtggctaagaacacgctggcgcgcatcgccgccaaggaagcgggcattgagggtcttgacgacctgctcaagggcccgaccgccatcaccttcgtgaagggcgacttcattgaggctgcgaagacgctgcgtgactttgccaagaccaacaaggctctcgttatctcgggcggttatgccgacggcaccgtctacgacggcgagggtgctaccaagctggcggacatgatgtcccgtccgcagctgctctccaagttcgcaggcgacctcaaggccacgaccgccaaggccgcgtacctgttcgtcgctgtgcctaccaaggccgtgcgtacgatcgacgctctgcgcgagaagcaggaaaaggcagcttgattctcatgcggcttgccgcatgaaccacaatcggaaaacaacacacatcaggcggacggcaatcgctgaaggccgccgccagaatgaaaggaagccatcatggctaagtacaccaacgaagagctgctggaagctttcggtgaaatgaccctcgtcgagctctccgagttcgtcaaggccttcgaagagaagttcgacgtcgaggctgccgctccggccgccgtcgccgttgccgctccggctgccggcgctgccgccgaagaggaagagaagaccgagttcgatgtcgtcctgaccgctgtcggcgacaagaagatccaggtcatcaaggctgtcaaggccatcaccaacgctggcctggctgacgccaaggccatggttgatggcgctccgaaggccatcctggagaaggccaagaaggaagacgccgagaaggccaaggctcagctggaagaggctggcgccaccgtcgagctcaagtaatgatcgcgggagtgaaacccgcacattgcagctttgcacagaccctgctgtcgcacacgcggccgcagggtctgcgcgtatgcggcggtccgcgcaccggagccgagaccgcttctgtgaacgcctgacacggcctgacatgggcgttccgcaccggtgtgcgctacaatccgaaataccggcatcaatgcgataatgttgtcaattcatcggtcatcaatccctgaaaacacagcgggacatgacacaatggcacatagtatgcgaacgagcgtgaaaggaagggcggcacgtgactggcgatcagcggacgatacagcagtggacggtgagaatcggtggcatcgatcagaaaaccgtgaagccgggagacagcatcgaaatcgggcgcaagccgttgcggccgttgcccgatgacggcaccgaacgcctggagatagcggacggcacgcggtccatgtcgaaacgccatgcgaccttcgcggtgagtcagaacggcggcggcaccgtgcgcgatctgggctcgaccaacgggtcatatgtggtgcggggcaatggcgatctcatgcgtctgccgccgaacgtcgatttcctgctgccgacttcaccgatgcgcctgcaattcggcgatgtccccgtcgatttcattcgtgtggagcagccggtgagcgacacgttcgtcgtgcccgacctgttcggatacgctttggagaccgtcaagcaggagccggatgtggccgacatgtcggtggatgacattcttgacctgcgtgccggggaacctaccgccgcgatcagcgctgccaccgtgcgcaagcgtgtcggtgagctgaatgccgccgcatcgcagacgttcccgccgcagaagacgaccacggcggatggattggcggcggattccgcggccggtgccgctgagccggattcggagcttgccgtttcgtcggatgctgccatgcccgttgaggccgcggtgctggccgaaaccgtgtcgccggctgaggccgacgctgccgagagcgatgccgagaccaaggttccggaagccgccgagtcctccgagaatgcggcgcctgcggatgccgttgatgccgcggacgcggccgtatccactgagactgcgacatccgatacggcatcgcctgaaaccgtgacttctggaaccgtggcatccgagtccgccgcggatacggtaccggctgattccgctgtatctgattctgtagtgaccgcggcccaatcgcagaccaacgatgagccgagcgagcccgattccatgccgttgaacgtggccggtgccgatgctaagccggtggtggcgttgccccgcgacctgttcgccgacgcgctcgccgaggacagcgaagaggccgggcagtccaccgcgcccgcagagcaggcggatcagttggcgaacggacagccgtccgacgaccgattccagcaggcgtcatccgatcaggaggcgcacgacgacatccgtcaggcggtgaacgaggtcgcagccaacgcggccggtgtggaagtcaccgccggcgccgtggcaggcgacggcgtcgtgaaagccgatacggacatcgcccacggggagattccggaagagcaccgccggttcgcgcaaccgaacgacgacgaggcggactcgaccggttcgttccgacccgcattcgagccgggatcggtgttcgaactcgtgtcgaaaggcaggcttgccgccgccgaaccgaaaatcgaagtcaacgggtacacctctgaccaggcgaagaccacggaagactacaccgagcagttcgccatcgcgaattgcgaagagctgctgccgttccttgccatgaatccattgctgtacgatgacctctataattggctggaagatcagggcaaagcggacattgacgccgcgctggagaacaatgagggctacaagagttaccgcaaagcggtagggaagtgagtcgggtcatgagcgaaagcatgcaacaggcgccccaatcgctggaacgcatgcgtcaatggcatgaacagtaccgcgccggattggtgccgtccccattggaggacatcaaccagcttggggcgaagctcgatttgacccatgcgcatccctccggcatcgcccagctgttcgcgggaggccgcgcgtcgctggatctgctgttccgcgacaacggcatgctgcgtgcggcgaaccgccgactggagcgggtgcttgacgagaaggccgcgaaactgcgcgtcagcggcgtcgcggaactgtctctcaccgtgggagtcgccacatgggacgacggtgccatgccggtgctgctgtatccggtatccgtgcaaagcgcccaggatgaaggcgatgtggcggtgatccggttcgtcgggcatgtccggctcaaccccgcgttcgtgacggtgatgcgcgagcagcacgtcgaacttgacgagcgggagctgttcaacggcgccaactacgagagcggcacgcccgaaacgtccgcggtgttcgcggcgatcaccaagcgtgcggagaaggtgttccccgatttcaccatcgagcggcagattatcctgggctgcttcatgtcgcccggctcgctgattcttgccgaaagccagcacattatcgatacgctggccgagggggcgaccggcaacacggtgctggacgcgctcgcgggcagcaaggaggccgccgaagcgctcaaggactccggcgcacctgcgttcagcccattcgacgccgatccgcacaacgagttcgaagtcggcgatgtcgacaacgccgtgcggtacgcggccgatatggtcgcagccgggcattcactcggagtcgatgtcgtcaacgggcgtgacaccgccgattacgccgccgccatcgcgtcgcgctgcgtgatgaacggccgcagcgtactgtacgtgccgtgcatcgccgatcagaagcgtcgtttccgtcaggccatcagcgccaatgagctcagcggccaagtgctcgacgtctcggacgagcgctgcaatgacagcatcgaccatcagctgatcgccgcggtcggattccagcccggcgtcgccagctcccggttcgaccagatcgccgatgagctggtcggcgtgcgttcccgtctcacccggtatctgggtgacctgcactgcaccgacaagcagtggggcgtgtccgcgtaccagaccatacagaacctcgccgaaatcgccacgttgcccgcgcatcccgccacccgagtgcggttgcgcaaggagaccgcgcgtgagatcggcggtcatctggacgaatgggcggcgaagctcaggcgtgccggcgagctcggcgaattcacgctcggaccggaggataccgcttggttcaaggcctccattacgtccgaggacgaggctgtgaccgtctaccagcgtgtggtcgatctgctgcgcaagttgctgccgttgacccgtgaacaggtgtcgtccaccgtgcagacatgcgggttcccgataccgaacaccgagcaggagtggggccgtcaggtgcaggtgctgaagaacctgcgccgcgtgctcgacgtgttccagccggagatcttcgagcgcgacatcgacgcgatgatcgagtcgagcaagtccaaggccgaacgcaaggccgaaggcaccactatcggattctgggagcgtcgccgccatatcaaggaggccaagagcctgctgcgcgtgggcgcacaggtcgagaacctgcacgatgcgctgcaggtcgtggccaagcaggccgcgcaatggcgcatgttcgtgcctcacggcgggtggccggtgctgccgaacaaactcgacgacatcatcgccacgcaggaggagctggcccgcgacctgacggcgctggacgccgtactgtccaccaccgtgcagggcggcgatctggaatcgcaggatttcgtcgccgtcgaggaacgtctgaaggcgctgttcgacgaccatctcgcgctggacacactgccggagcgctgccgtctcgaacatgaattccagacggccgggctcaccgaactggtcgaggacctgcacacgcgccgtgtgccggtggaatcggtggatgccgaactgcagctggcatggtggaccacggtgttcgagaacatcgtgcgggcgtccgcgatcatctccaatcaggatgggtcggcgttgcagtccgctgcggatcgtttcgcgcaggtggacaccgaacacgtgcgttcggtcggtccgatggtcgcgcaggaatccatgcgccgcctgtgtgaaatgctgttctcccgcacgcaggaatccaaccagctgcacacggtgctggccggcaagacccgcatcccgctcagccggatacgccgtgaccaccccgagatcctggccgcggccaagcccatcatcgtggcgaccccggccacgcttgccgcgctcaccgatccgacgaccctcgccgacgtggcaatcatcgacgcggccgcgcacattccggccatccagttgctgaccatcgtctgccgcgcgaagcaggtggccgtgctggcccaccggtccaccgtgacctcgccgagcgtgaaggcgctgatggagctgctgccgagcgtgaaggtccgctcccaccccgtgcggcgcgcgcccaggctcgccgcgttcttggaatcccaggggtatggcgaggtgcgctatgacgtcacgaccgagccgtcgcaaggccgggtggccttccacaaggtcgaggcgaacggaacgccggtcatggccaccggattggtcgagagcagccagcaggagatcgatgaggtcgtccgcatcatcaccgaacgcgcggcgagtttcaacgtggtgccagtcggctacacgctgaccgtggtcacgctcaccgacgcgttccgttcgcgactcggtgcggaactgaaatcgctggcgtcgaagaacaagaccatggggcagttcctgcgccacgtgcgcatcgtcgcgctgccggagatcgccggggcccagtcgacggacgtgattctgtcgttgtgctacgcgaagaccgtgcatgggcgtctgctgcagcagttcggcgtgctggagggcgaaggcggacgtgccatgctgctggatgcgctggcgctgtgcgaccgccatctcgatatcgtttcggcgttcgacgagtctgatctggacgatgagcgacttcaccagcccggaccgcagctgctgcatgccatgctgcgctgggtggagcagctggacgaccacgtggtgcgtccggtgaccatcacccggtcgaacaatgtgctgttcaatgatctggcggagcgcgtgcggtcccgcggactgaacgccgccgtcgactacgggttcgaccgcggcctgcacattccgatggtcgtcgggttgcccgacaagccgttcgcgctggccgtgctgaccgacgacgcgcagttcatgagcgtgcagtccacgcgtgaacggcatcgcggcctgatgcaggaccttgcgtcgctgggctggtcggtgatgagcgtgtggagtgtcggcgcattcgtcaacccggacaaggaggtcgatgcgatcgtgtcgcgcatcggcgagatctacggggatgtgcgatgagcggcgatactactggtgacggggatcgtgtggccgcagatgcctcggagccaaggccgtacagtgcctcgcgtcgtacgcggcgcgagcacaaacgcgtcgtgttccacggaaccgagcgcttcgatgcagacggcgtgaaactcgaaccgggcgatatgcgtaccgagcagcagcgcgaggccgacgacgacaaacgcatcctcggcgaactgccaccccactgggccatcttcaacgacaaacgttgagtgtggtgaccaccccagtcgcgcgaacagcgagactggaggtggctgctgcggctgagcaactgcagctattgcgcagtgacggccataatcggaccgagttcctgtgcgttgatgattgatatggcttcgtcgggagtcaaagcgaacgtgatgagcgtgccgccggtcatcgcatcgtcatgggcggcatccatcgccgtggccgatcgcgcgagaacgcatgaccggccgcctgcggattcgtcacgcgatgaagtcgtaccagtcgaagcgtcgcaaggggtgccggataccagatccatgacatcaccggccgcgatgccgtccacagtgccggtgacccgtacatcgatcaccgtctgaccgggttccgccaccggccgccgcgaaactatggcgccgaacagcggctgcccggcggcgatgtccgtctgcgcgatgcctcccgccgcctgattcgccgcatcgagcgccgtatcccaaccatccgatacgggcatctgccggatctccacgtcctccgcgccgatacgcgcgccgcgtgggatgagccgtgccgccaccacgaccggttgcgtgacgatgctcgccgtcacgcattgcagtgtcgcgaatgctgcaatggccgtgcaacaggccgccatcagccgccgtgtgagccgcagcatccgacgttggcgcaacgtggggcgcttcagcttctccaatatagaaaaagtcaccatgcaagcatggtgactgaacgttgttccgatgcgcaagccgtgacgaaaatgtggtcgaaggctcggcagttatccacatcttgggcgtgtcgcacatgcgcgggccgagcactggccgccggaagacggcgaacgcgccaatggcagctgcttatttgccggagccgccgcgcccgtcggtgcggtagaagccgtgccccttgaactcgatcggcacggcggaatacaccttgcgcacctgctcttgcccgcactgggggcacacggtgatcgggtcgtcctcgaacgactgctgctcggtgaaatcgtatccgcagttcttacaacggtaatgataggttggcacggttcctccctggtcgaagctcattatatgattccggcacgtatgcgatgcccggcatacgcatcaagtccgttcatatcctagtcgtcacgcggacaccgcgccgctcgacgtctcgttttgttccctccgcgaacttgcgcggatggcgaactacaggcgttgggctccctgcggcgtgaccacccagtcgaccgggatatcgtgagactggcggggcaggtcgtctgccatgcattcccacggccagcagacggcgacgaccggcacgcctccgcgtcggtatgtcagcgcgcggtcataccagccgccgccgcgcccaagccggacgccatgcgcatccacggccagcgcgggcacgatgatcaggtcggcatcgccaagggccgccgggccaagcgtctgcgtatccggctcatccggccgttgtgccatgccggttccctcgcaggtcacgccatgcaatgaggccatgtcgggcagcagagcccatcccacgtccagaccggagcccaagcgcggcacaaggacgcgcagcccgcggtcgagcagcagggacagcagcggccgcatggggatttcgctgcccatcgacacgtaggcggccacggtcggcggccggtgtccgcggccgtgtggcgcggacatgacgccagacgtgccggcctgcacgccgaccaagtccagcaacggcacaatgtgttcggccagtgccgccgcggccgcgtcccgttcctgccgcgtcacggtcttacgccgcgcgatggcgtcccgtctcagctgtctcttgcgcagatcgtccgacatatcggcatcggtcgtctgccggcgttggcaaaggttcatggttacgttctatcacggacgaatgtccgtcatcggcggacggtgcgccgtgtcggagacgcgacgatggcacaatgggtgcgtgtccgttttgcaatcgatatgcgccgtgttccggcagccggcagcgccatccatccgcgtgccgcggtggatcggcattccgcagtgcccgataaagctgcggccgatcacggcggacgacgaagaggagtggaacgaggtgcggtggcgcaacgatgcgtggttgcatccatgggagtcaggcgatcccatgcacggctcgccgatgacctacaaccagtggatgcagcagatgcgtcacaacgagcagaccggccgcggagtggtgttcgctatcgattatcatgagcatatcgtcggccagatttcgctgggagcgatagatctgggatccatgcgcaccggtgtgatcgggtattgggtcgatcagcggtacgcggggcatggcttcgcaccgatggcggtggcgctgctcgccgactgggcgttctgtgatccgaccggccctcggctgcaccgcatggaaatcgcattactgccggaaaacgagcgctcccgcagggtggcgtgtaaagtggggtgtcattatgagggcgtgcggccccggtacatgttcgtcaacgggcagtggcgcgatcatgagacctacagcctgttcgccgaggacgccggcgacgggttcatccatcgtctgatagctcgacacgccatgccggaatcagtgcaatcgtaaggggagtctcctattcttaaggacatgggttatgagtcgctgagcaccgtggtggtgctggtgattctgatggttatcgcggttggctggctgcccaggcggacggtcaacagcatgaaaaaggtggccgagcaccgtcaggacaggtactcgtcgtcgttgcatctggtggatgccgacagcggtactcgattctccgacgagcatacgccgcagccgaaaggggctattatgcagcgggcgcaaacgagcaccacgacgccgaccacggcgaaagtggcgcatattcgcgagcttcggcgtgcggcggtccgtcgtcggcgcatattggcgctatcgctgctgctgatcacggtgctggtactggtgctgtcgatggtcctgcctttcagcgccctgttcgcgctgattccgggcgtgctgctggcggtcgtgttggcgttgggcgtgcgggcctccagtcaggcccgtcgctgggagcatgcgctggccgaggcgcggcgcagggaacgtctggcgaaacgggccggggcgagtgcccgcccgcgagcaaagtccccgtctcaggcaaagtccacgtccccagacaagtctgcggcgaaggcaatcgctgatacggccggtgaccaggtaaccgccaccgcgaatccctctgccgagaccgaagtgaagaccgacgtgatggaacgccgggagattcgtcaggcgcttcaccgcgcacgtatcgagcaggatcgcgcgttggccgcccgtgaggcgaggcagaaggctcatgcgatggctgcgtccgaaaacggccggcatgatgtggatgcggcatcggaacagccggaagcggccgtaacgtcggccgtgcagcctgagccgcggcaggatgccgtcgcgcagccgtccgcggacgagtccgcgacgaatgtcgtggagcccgcggactcccatgccgaagtggtcgtcgaggaggggagcgccccctcgggcggcgacatgaccacggaactggatcgggtgcacccggccgcggccttggacgccttcgaagtggccgcgtctcaggatctgatttcgttctcgctgggtgagccgcgcaatggcgtcgaccgccatgcgcccgcgccggagagcctggagatcaaatcgacgaagcaggtcgcgaaggccgttcctgcactggttgccgagcagcccaccatcgtggacggcggcgatgcagggcagtcggatgcggatgccaccgtcgccgcggtcatggatgacgcctcggtgaacgataccgacgcgttccatcagacggaggtgcggtcaagcgtggatgccccggatgcgtcctccgactcgctgggaaccggccttgaggcgattcttgcgcgccgctcgtcgtgattgcgtgtgattttctctcagagcgttagcagtcgagttggcagagtgctaacaatcgcgctacgatgagtgctagcgcgaagggatgatgcccgaagtgatcgtcagcctctgaatggcggcattccatcgcgggaccatacgattggatttcaagaatacgaggtgacccacagtgtcgatcaagctcacaccgttggaagacaagatcatcgtcaagcaggccgctgccgagacccagaccgcgtccggtctgttcatcccggacaatgccaaggagaagccgcagcagggtgaagtcctggccgtcggccccggccgtcgtgacgacaagggcgagcgcatccccatggacgtcaaggtcggcgacaaggtgctgtactccaagtacggtggcaccgaagtgcactacgagggcgaggactacctgatcgtctcctctcgtgacgtgctcgccattcttggctgagtgaacgctgcacgacagcgccgtcagcacggaaccccggatcgcatgatatgcgccggggttttcctatgtctggccgcactcgtttggtagactgtgcggaagggaagacgatacaagggaattccgatgaggcaggcaatcatgatggtatgtccgaattgcggcaagccgatcagcgcgggaggtcacggccgtgcccgcgcccgcagcgccgaaagaacccgacccgagtgagacgcgtgtcgctgccgtcaaacaggtgctcgataccaagctcgcgcagtacggcggcacatggtcggcgccctacatcgatctggaaagaggccgcgacgtcacagtcaacgacgagaaactcgtggcggcgtcactggtcaagctctacatcatgctggccgtgttcgacggcatcgagcatgacaccatcaccgatgacgcgaacgtggacgccctgctgaagcagatgatcaccgtcagctcgaacgaagctgcgaacgggctgctgtcgcgcatcggcaacggcgacggcaaagccgccatcgccaccgtcaccgcgaccgcgcaacgatacggcttcacctccagcgaggagctgcgcacattgaccggcatggcctcgggcaacgcggtggagaactggacctcgacgcgcgactgcggctcgttcctctctcaggtgtacgccgggacgctggtgtcgaaaaacgccagcgaacgcatgatgcagctgctgctcggccagacgcggcgcaccaagattcccgcgggcgtgccgtccggtgtgaaggtcgccaacaagaccggcgagctggcggccgttcagaacgacgtggcgatcgtgttcggtacccatccgtatgtgctcgcggtgatgagcagcgacatctcctcagccgtggccccaagccagatcaccgaactgtcccgcgccgtatgggacgccgcacaatagccgcacccgctgacggggactgtcggcggggccgactggggtggtacgcgcaacgggtatcgaaagcaacggcggagctgacgaagacatcgcgatcgacactcccgccatgtcggcggcggtcatcggcgacatcatcgacgcgcttgccggtgtgctgtcgtgctcccgcgaggtgattgagctcgcggtaatgacgctggtcgcgggagggcatctgctgccgagcgatctgaccggtgtcagcatgtattcgcaggccaccggttcgttcggtttccatccgggaccgttgttcgccaatatcgtcatcgccgacgaggtcaaccgtgcgaatccgaaggcgcagcccgccatgctggaggccatgggtgaggggcagatcagcgtggacgggcatacccacgggctgcggcagattcgctcgatcgaaagggtccgtgatatccgtgcggcatgccgcagggtgacgttggcgcctgagatggcgtcgtatatcgtggcgctgtccgcggcgacccgtgacgcgcagggcgtgcggttcggagtgtcgccgcgaggccgcctcaacgtggcggcgatggcccgtgcgcgggcgctgatgcagggtcgtgatttcgtgatggcggatgacgtgcgctcggtggtggtcccggtgctcgcccatcgagggtgcgccagcgtcgacgccggatgcggttcggcctgatggaggcggtcggagagaccggatcgccggacgcgacgaacggcatggggtgggcgtggcgtgcggcgtggcgcgaggcgtgcgattcggcatgggacgcgggcgtgagatggtcgcctgtcgacactgagcgcggtattgccggtcgcatcgccgaatgtctggaagccgtgacgccggaaggggagtccgatttcggcgcgtatctggccgaactcgcggaccatgtgacagccggcgcgtccgacgtccgtcgcgccgtcgccggaaccgttgcgcgggttgtgcgcccggtgcgccgtcgccgcgaaacgacgcggcaatgcggtctggcggatgttcagatggctgttcccggcgtcattgcgcagaaaaacatgatgcgagtatcgaaggtgagatgccgtgataccttggaaatacttgcgacatgccgtgtgcgacacgcgagttgcaaaagtcggcgacttgtgtttagatagccaagttgccggttgaggccacagcctcgacaagcagccatggcggatttcccaagcggtcaaagggagctgactgtaaatcagccgcttcgtgcttcagtggttcgaatccactatccgccacgccccgatagctcagtggtagagcacttccttggtaaggaagaggtcgtgagtccaattctcactcggggctctctggcgggatagctcagctggctagagcgtacgactcataatcgtaaggtcaagagttcgagtctctttctcgctacaaaggccggtaagccaccggtaaacaacgaccacagaggtgaaccacatggcaagcaaaagcgccgatatccgtccgggcatcacgctggcatgcactgagtgcaaggagcgtaactacatcacgacgaagaaccgtcgtaatacgcccgaccgtcttgagctgaagaagttctgcccgcgttgcggcaagcagaccgtgcaccgcgagacccgctgagcttcatcaagtctttgtcgtaaaagcccgaccttcaccggtcgggcttttgtcgtttcatcgccccggctgtcgcacggccgccgctcgcgggacgggcgcgtgtaccctagagggcatgacgagttttgcagatctgaccactatcggcgtcggcggccatatcgcccgattcatcgaaccgacctcgcgcgtcggggtgattgaagcggtggaggacgcggactccaaagggctgccgctatgcgtgattggcggcggatccaatctgctggtcgctgatgggccgttcaatggcgtcgtcgtgcgcgacgcccgccggcagatcaccgtgcccgacgaggccgcgccggtcgagaacggcgagcgaatcgtgcacgtcaacgccgaagccggctgcaactgggatgatttcgtcgcgttcaccgtcgagctcgggctggagggcgtggaaggtctgtccggcatccccggcacagtcggcgcctcggtggtgcagaacatcggcgcgtacggacaggaagtcgcaggcgcggtcgaatccgtggaggcgtgggaccgtcgagacaagcggacgctggacatcgcggctgccgacatgggattcggataccgtatgagcgctctcaagacgagcatgtatcaggctccggcggtgccggccggcgagttcttcccgacgccgcgatacgtggtgctgtcggtgacattcgcgctgcggcacagcgccaccggcacggtcggttacggacagctcgccaaggcgctgggagtcgaggtcggtgaccgcatggagaccgcggccatccgcaacgccgtgctcaaggtccgtgcggccaaggggatgctggaggatgccgcgcgttatcttcagccggcgatggccggcaccaagcgcgacgtcaacgtgcgcatcgcgctcgaagcgcagcgtcgccagctggccgcaggcgcggacacgcccgtcgtgcgcgatcccgaccggcacagctgcggcagcttcttcatgaatccggtgcttcccgccgatgcggccgataggctgccgcaggacgccccgcgtttccccgcgacgctgccggatggcacggcgggcgtgaagacctccgccgcctggctgatcgatcatgcaggattccataaggggttcaaggtcgacgaatcctcgccggccggcctgtccacgctgcacacgctggcactgaccaaccgcggagatgcggccgcctccgacatcgcggcgctggcgcatgccgtgcaggacggcgtggaggcggcgttcggcgtccgcctcgtccccgagccggtcgtcgtcggcatggacctgcgttagccgcccaaagtcccatctcgtgcgcgttagatgggactttcgcggggtggagcaaggcgggggcgtgaccgtgcgtccccgttgccgcgtactgtggtaagtcaagctaagccaaggaggagtcatgccatacgttatcgcccagccgtgcgtggacgtcaaggacaaggcttgcgtggacgagtgcccggtcgattgcatctacgagggttcgcgttccctgtacatcaatccgaacgagtgcgtcgattgtggcgcgtgcgagccggtgtgcccgaccgaagccatcttctacgaggatgacctgcccgacgagtgggcttggtacaaggatgccgcggtgagtttcttcgccgaggtcggtgatttcggcggtgcttccgcacacggcccgatcggccacgatcccgagcaggtggccgcgttgccgcctcagaatcaggactgatccgcccggtatcattctgcaggccgtcgccttgtgcggcggccgctttcatagagcacggttccttcgccgggtgacacgccacggccggccggaggacgtcgaggaaaggaccagcatgggctttcacgcttattcatcgccatacgattggtctcgcatcgccccgtacaagacaaaggcggcacaggtgccgggcggcatcgtcgacctgtcggtgggctctcccgtcgacccggtgccgcaatccgtgcgtgaggcgcttgccgtggcctcggacgcgaagaacgcgcacggttatccggtgacggccggatccggtgatctgcgcgacgccatcttcgaatggttccgtgccgtgcgcggcgtggacctgcaatccatcaatgccgacgtcgtgcccacggtcggctccaaggaggccgtcgcgctgatggcctcgctgttgcacctcggcgagggcgatgtcgtggtccagccgaaggtctcgtaccccacgtacgagatcggcacgcagctggccggtgcgagcgtgctgaaggtcgatgacgtctcggacgtcgactcatggtgccatgtgccgggtgtgaaggcggtatgggtcaattcgccgtgtaatcccaccggcggcgtgctgtccggcggctggctgtccgatatcgtcgcggcggcgcgtcgcatcggcgcggtggtgctgtccgacgagtgctatgccctgatgtgctggtcgtcgaattcgcgtgatttccacgtggacggtgccgaggccggcgcgtcgacgccggtgtcgttggcgacgtccccgtgcgcgttgaacaccgccgtctgcgatggtaccgcagaccggatcctggtgctgtactcgctcagcaagcagtcgaacatggcgggataccggaccgcgttcatcgcgggagacgccggcctggtgcgtgagatgtcggcgtaccgcaagcagatcgggcagatcatccccggtccgatgcagtccgcgatggccgcgggattgcgtgatttcgatgcggcgaaaacccaatggacacgctatcgccgccgtctgaagacgctggtcggcgcgctgcggtccgccggatacgacgcccgcatgccgcagggggcgctgtacgtgtgggtgcgggcgaagtcgggcgactgctggcgcgacatggacgatctggccgcgctcggcatcatagcgagccccggggagttctacggagcgccggaatgcctgcgcttctccgccaccgcgagtgacgatgccgtcgccgacgcggcgaggcgtctctcgcgctgacgtcggtcggctcacccaccggctcacaatcccagcgacgccgcgcccttgccgtatttgcggcgtatcgcgtccagcgcctgctccgcgtcgcgctgccgcgccgaccgcgtgacggttccggcggactgtgcctcggtctcctccagcacgtcatccaacgtcggctgcacggtcgaaccagccgacctcgccaatccgctcgcgctcatgccggcgagccggatgtctcgcggcaggggagtgccggggctccgcatggcggcgacgccaccctcgatccccagcatccggcacagtagctctacggattgcggatacagcgcggcggccgtgtcctcggcgcgttccatggtgtgtgacatcgacttgtagctcagatcggcgaaccgcagtttcaccgtcaccgtccgcgccaccagaccgcgtctgcgtagcgagctcgccacttcgtcgcagcaccggcgcagcaggtcgcatacccgtcgcatgtcgcgcgtgtcctcggggaacgtgctctcggagccgatcgacttctccggagtgtacggcgtcaccgcacgcccatccatgccacgcgcggccatatacaggccgtgggccatggtctgcgagccgacggccgtggccagcgtctgctcgctcatcttcgccaggtcggccacggtcttcacgccccactccgccagccgccgctccagcgaaggcccgatgccgggtatgccccgcagcggcatcatctgtacgaactcggcgtgacgggcgacgggaatcagcagcatgccatcaggcttcgcattcgtcgacgccattttcgcgaccagcttgttcgcggcgacgcccaccgaacaggtcacatggaaccgcgaggcgacctcctgccgtatccaggcgccgatccgggtcggccgttgccaggcgagcagcgcccccgacacgtccatatacgcctcatccaccgaaacctgctcgaaccggtcagtgacctggctgaacaccccttcgacgatgcgccgagacatcatccggtagtagtgcatgtccaccggcaggaacacgccgtccgggcacagctgacgggcgcgggcgctcgccatcgccgaattgacgccgtaacgccgtgcctcatagctcgccgccgacaccaccgagcgcgtcccggtgccgatgatcaccggcttgcctttgagttcgggatgacgtgccacttccagcgaggcgtagaaggcgtccatgtcgatgtgcagcaccgtgcagccggtctcgtcatgcccccaatcgcgtttggcggcggccagtctaggtgcggtactcatatcccttatcgtaccgtgccgggccgggatggagcgggccttgccgtaccggttggggagcggccgtcgcaatctctttgccgcccgcgcgtggcctggcctgccggagcgcagggcgccgcgaaattgctggcgtcgcgctgctgatcgtcgcggtgatcgtcacgttcacgggcgactcgaatccggcgcgttgacccgtcgtcaggccccgtatgacgccgcgtgcggcacaccgtgttgctgaagtccgggggacgatggtaagatgccatgttgttgcgccaatgtgcaacatggagacatgcctgagtggccgataggggcaccctgctaaggtgttagtcgtgtttagcggctcgagggttcgaatccctctgtctccgccgactaggctccggacgtttgcccggggctttttgctttttccgggtctttctcgagggacgtcaagaacgactattgcagcccgtattatggcagcaggctggagccgccggcgcgtgggtcgatgctgtgtgactggtagggaatcggtaagccgcgaaaagctgaatgtccgctgggattcgtgtggtcatgatatgagaaagccggtcgtgcataatccgcgcgaccggtcatccgggcaaggcgtatcgtcccttgtagcgaagcaggggggcggaggtacgccattgtccgtccgtctccaagcagtcattctacccccttcgtttaccgtggcataatgatgtcatcgttcacatagtaagaaagatgccgccgcaatgtgattgcatatgccggtttcccgcgcgtgtcgcacgtccgtgcttgtgtcgtatgggagattcgcccgcgcgtgtcgtgtccgcttactggacagtagctgacgggcgttagactgagaaccatcaggacgagatgagcgaggagcgtacgatggggcacatccggggaaaagggcatcacaggacgacggcatcgcattcgcccgtcagggcgctcgtcgtcgtgctggtcatcgtggcggtgctcgtcggcggcggatggctggtcgtgcggcatatgcaggccgccgctcccgtcgcgaaaccggataaggccgcgacggtgacccgggtcgatctcgacaacaagcaggccgtacccgaaccggttgtggagcaccatggcaattcgcccgactgcccggacaccgactgcatctccatgctggtcaacggcgacctgctgttccatccgaacctgtggaagcatttcgccggtgcgaacaccgccgccaccgacggcacggcgttcgatttcacgccgctgttcgaaaccatgaagccatacatccaggcgtccgacatcgccgtgtgcgagttcgagacgccgatcgccaaacgcggcggtccctacaccggctatccggtattcaacgtgccgccggaggtcgccgatgccgcggcctcggtcggctacaccgcctgcacgcacgccaccaaccattcatgggatcagggtgccgacggcatcgcccgcctgtgggatacgctcgcgtccaagggcatcgcgcagaccggttcgtacaagaccgaggaggactccaccaagccgctggtcatcgactcgcccacgggcggcggcaagctcggcctggtcaccggcacggtgtcgctcaacggcatgaccgccgaccatgactggcaggtcgaccgcctgcgcgaagccggcgacccccagcatcagtccgacatcgaccgtgccgtcgccaaggccaaggccgcccgtgaacagggcgccgacgtggtggccatggccatgcattcggtgcaggaatacatcgactacgccgattcgtggcaggtctccgaggcgcatgagctcgcggacaccggcgcgttcgacgtgatctacggcgccggatgccattgtgcgcagcccatcgagaactacaacggcacgtggatcatctacgggcttggcaacacggtgacggtcagcgcccccgccagcagaatcgtcaacaatcagggtgtgaccgcccgcatccagttcgccggccgcaagggcgtggccggggcatggcgcgtcagccgcatcgactgggtgccgaccgcgaacatgcggcagggctcataccagtggtgcccgatctccagcgaccatcccaacggcacatgctggtccgaatcgcaggatgcgcaggtgcgccagcgcatatggaacgtcatctattcgatgggcgccgacaagaacatcgtgaaggagtggaacatcaccgatgaaaaccgttcttgacacgtccgaccggccggcgcatgacgcactggtggagaagaagtccgagttcatcgccgatgtgtgccatgtggatgcgttggacgaggcgctgctgttcgtcgattccgttcgccagctgcaccccaaggcccggcatgtggcgtacgccgcgatatgcgtcgacggcgatggtcgcgtgcgggagaggatgagcgatgatggcgaaccatccggcaccgccggcaagcccattctcgacgtgctgcggcagggagatctgatgaactgcgcagtgacggtcacccggtatttcggtggtatcctgctggggtcgggcgggctgattcgcgcgtattcgtccgccgcctcgctgggcgtcaaggtggccagactggcgtccatcgagacgtgccgcagatacacgacagcgctgcagtacccgcaatttgacgtgttccgtcaactcgcctcggattgcggggccgcgctggagaatgagcggtacagtgaccgtgtcgtactggacacggtggtgccggtggagcgtgagcgggaatttctccggcgcgtgcgtgagacgttcagcgcgacggtgacgcccgaatccggtgaactgataagccgtcccgtcgcaatctaaacaggcgcgctgttatgcgcagcatgtccacctcctaatcgcccccgctggcgggggctgtcatgcgtagcatgactgggggtggtttttgcggtactcagctcacccgtcagcaggaacgcaatactttgcggaagatatggttcggttcggcgacccctcgggtatggtgatgactatgagcgagatgcaacgacatgatgacgaggccacggtgcgcgaggccacagcgcagactgcagcgcagtctcagcccgacagcgccactgactccacgcccttcgagcctctgaccgccacgtatgagcggctgcggcactccaccgatagcgcggaactgtccgagttcgcgcgccgtccgttgccggatcgttccgatcaggcggcgttctcccgtgcgacggcactgctggaggccgtcgccggcaaccggcacacgccgttggaagatcgcatcatgctggcggagacgatgccgttcccgaacatcctggtcaagctgtcgacggacccgagtccggacgtgcgcagggccgtggcggccaacgaggacgacaagaactggctggtggggcgcctgaccaaggacgaggtccccgaggtgcgcgacgcggcgctgcgcaacaagcgcacatcatggaagatgcggctggagggagcgcagaacaccgatcttgacgccgacaccctggacgtgctgtcaaggctcggagtatcggaggaatccggtgccccggcgattctcgcgacgatggtgcggcgcgcggtggcgttgaaccccggcacttcgcaggagacgctcgaccggttgcgcgacgacccttcgcccgaagtggcgaaagccgcggcgagccggacctcggacgcctcgtgacgcatcattgcgcgacactctccctgcgctccctcctgccacccccgtactgaccccgtttcgttccgacccgtccgtcgccggcggatcaggcgataatcgcgggtaaaatctggcgcaattcgcggtatacgtaagcgtgccgcgcaaaagcgggcttacactaaggaatatgacagagagtacagaaagtgcggagcgtctcgcgcgtccgctgatccatctggcgcgtctggttggattggccacgagctacatcggcatgagcgacgactatcacgagatcgatgatgatgtcctgaaggcgttgctgggtgcgttgggcgtggacgcccatgacgatgacgccatcgatgattccgttgtccgtatccttcgcgagcgccacgggcgtctcgtcgccccgaccgtgttgcatgtcgtcggcaaggaagatcgtgtgctgctcaacaccggtatcatgcagattccctccgcaaccatcacgctggaaaacggcgacgaataccagggtgcgctggagccgggagccggagacggatcgcaggcgtacgaggtcgacggcaagttcgtggcgacggcatccatcaccatacccgcggatctgccgatgggataccatacgctgcatgtcagcgtgggtgaccgcacgcaggacgccacgctgatcagcgcccccgagcgtattccgatgctgccggccatggaacatgaccagctgtggggctggatggcccagctgtattccatccggtccgccggatcctggggcgtgggcgatttcgaggacctcaagaccctcatggtcgattcgcacagcaagaccggcgccgatttcatgctggtcaacccgctgcacgcgtgcgagccggtagcgccgctcaccccgtcgccgtacctgccgatttcccgccgcttcatcaacttcacgtacattcgtcccgaggcgatcgaggaatatgccggcctcggcgatgacctgaaatcgcagatcggcgagctgcacgcgcaggccgaaccgctgaacggggacgcgcagattatcgaccgtgattcgatgtggcgcgtgaagatgcacgccctgtggctgatttttaaggccgggcgcagcgaggagcgtcagaaggcgttcgacgactacaagagcacgtccgccgaagggcttgaggcctatgccacgtggtgcctgtgctacgacaagtggggcgcgccgaccggcgaggccgacagctgggagaagcgcctcgacaagaacagcgacgaggtgcaggggctgcgtcgacagttccccgacacattggacttctaccgctggttggaatggatcgccgacgaacagctgggagccgctcagcaggccgcgaaggacgccggcatgcagatcggcctcatggccgacatggcggtcggcgtgcatccgtccggctccgacgtgtggtggaacccggagtgtttcgccaagggcgccacggtcggcgcgccgccggattacttcaaccagcaggggcaggactggagccagccgccactcaacccgatcgagctggagaacaccggctacctcacgtatcgtcacatggtgcagggcatgttcgcccatgcaggcgcggtgcgcatcgaccacatcctcggcctgttccgcctatggtggatcccctccgggcacacgcccaaggacggcgcctatgtgcagtacgattccgagatcatgctcggcatcctggcacttgaggcgtcacgcgcccacggcgtggtcgtcggcgaggatctgggcgtcgtgccggaccacgtctcgacgtcgctgtccgcgcatcaggtgctgggttgcgccgtcgaatggttcgagcagatggacggcaagttccgcgccccgaaggattggcgcgagttctcgctcgcctcggtgaacacgcacgacctgccgcccgcagccggatatctcgcgtacgagcacgtcgaactgcgcgagcgcctgggactgatcgaaggatcggtcgaggacttcgagcagaacgcgcgcgccgagcacaaggccatgatggtcatgctgatcgtcaacggctatctcgaccccgacctgctgaaggacgagaaagcccacgagcaggagatcgtcgaggcgctgtaccgcggcctgcgcggctccccgtgcaagctgctcgcggcgtccatcgtggacggcgtaggagagcgccgcgcccagaaccagcccggcaccaacaacgaatatccgaactggcgcatcccgctggccgacggcaagggcaatgtcgtgccgctggaggagctgttctccaacacgcgtctgctctcgctcgccaaggtcatgcaggggcgctgagggtgcgatatgggcatgccatccggccgtacatgtcgttcggccggatgatgaagtgtgtcgtgtggcgttgtgaaatgtcaaaggtggcgttatcatagaggattgttgtgtttccctaaggggtccttcaaagcgctttcccactcgccatcgaggactttcagggagcccacggataatgaggccgaaaccgccaagcctgaccagcgcggcagtccaagcccggaacacaataagcaagaaaaggtacaccagtgaaaactttcactccgaaaccagccgatttgactcatgactggtacatcatcgacgccaccgacgtggtgctcggtcgtctggccactcaggtcgccacgctgctgcgcggcaagaacaagccgacctacgcgcctcacgccgattccggtaaccacgtgatcatcatcaatgccgacaagatcgctctgaccggcaacaagatgggcaaggaactgtactcgcactccggtcgtcccggtggcctgcgtcgcgatagctacgccgagctgctggcgaacaagccggagcgcatcatcaaggctgccgtcaagggcatgctgccgaagaaccgtctgtccaaggtgcagctggaccgtctccgcatcttccgtggtgccgagcatccgcacaccccgcagcagccgcaggttttcgagatcgctcaggtctcgcagcaggccaagtgaaccgaagggagatagagaatcatggctgaaaacaccaacgactccgcggttcaggcaaccgaagaggagctcaccagctacaccaccgagaccaacgcgggtgccggcaccggcacttccgcgattgctccgggctacggcaccggccgccgcaaggaagccgtcgcccgcgtgcgtctggttcccggcaccggcaagtggaccatcaacaagcgcaccctggaggagtacttcccctccaagctgctgcagcgtgaggtcaactccccgatcgtgctgctcaagctcgaaggcaagttcgacgcgatcgtcctcgttgacggcggcggcaccaccggtcaggccggtgccatccgtctcggcgttgcccgcgctctgaacgccatcgaccgtgacgccaaccgcgccgccctgaagaaggccggcatgctgacccgcgactcccgtgtcgtggaacgcaagaaggctggtctgcacaaggcacgtcgcgctccgcagttctcgaagcgttaatatacgccagttctggctatcgcgaggccctttcggaaacatcgtttcccgaaagggcctcgttcgttatgagcacctctactgcagcctgcgcatcacgctgatgctgagtgcgggcatcgtccataccaccgacccgttaaccgtagcgttgccgccatcacgggccgacgcggaagcgccatgcacggtactggccgcagacatggtcgccgaaacatccgcgccaacgcccggggtctgctcgtcatcctcgaacagcacatcggcatgctctgtggtggcgccaagcagatccagcttgtcctgctcggccagcgacgcctgaacggtcttcaacagctgatggatgttgtccttctcgctgacggacatgatccagttgctgcgcagcgcctggttcttgccgatacgctgcagccgatcgcccggcgtcggccgcagtccgaccgcggtcgcggaactccagtcgcactgccaggagcagtcgctcggcagggtgaaccggcgtacctcgtcgacgccgttgatcacgatgagcacatcgacctcatcctgcgagagcagtcgcatcgcgaagctgcgtatcgtcgtgtcgaaccagtcccgatccatcggcgtggtgccgtcgggcagataccattgcacgcggctcgacggcttgaacaggccgagctgcgtgagccgcgtgaagaactcctcgtgatggtacagtcccagcgacttgcgtatcgacagcagtcgggacaccgtctccaggcggtgcatctgcatggttttgcgggtctggtatatccagtcccagttcagccaggtgatgtcgttgtcctgcgcataggcgttgttgttgccgctctgcgagttgccgaattcgtcgcccgccagcatcatcggtgtgcccagcgacagcatcagcgtgccgagcatgttcatggcggcctgctcgcgtttgcggatgatcgccgggtcgtcggacggcccctcgacaccgaagttcgcggagtggttcacgttcgatccgtcgatattgttctcgccgttggcctcgttgtgcttgaccgcgtatcgggtcaggtcggtgagcgtgaatccgtcgtggcacgagacgtagttgatcgaggacacgcatccgcgcccgggctccgtggcgaacaggtcggatgaaccgcacagtcgcgtggccatctcctgcatgccgataccgctgggcgcccccggttgggtgtcagtgatccagaatcggcgcaccgtgtcgcggaaccggtcgttccactcgctgaacggcatgccgaatccgccggtcctccatccctgcggccccaggtcccaaggctccatgatgagtttcaggttgccgagcagcaggtcggaacgcaacgcatacaggaacgggtgatgcttggtgaagtccccgtccagccgcgccagcgacacgccgagatcgaatcggaacccgtcgatgccgatgcgcttggcccaataccgcagcgagtccacggcgaacgtcaccacgtgcgtgttggtgaagtcgaaggtgttgccgcagccggtggtgtcctcaagccgcccgatattgcccttctgacgccggtaatacaagagcgcgtccagaccgcgccagcatgtcgtcggcccttccacgccgccttcgcaggtgtggttgtacaccacgtccatgatgacctcgaacccggcctcatgcagcgcgcgcaccatgccgatgacctcgtcgcggatcgcccgggcccccttgcgctgggcttcggcagtggcgtacgaaggctcgggggagaagtagctgagtggcgagtacccccagtagttgtgccgcccgcgctcctgcaggaacagctcgtcctgcttggcctggatgggcagcagttcgatggaggtgacgcccagggattgcaggtacgagagcgtggtcgggtgggcgagacccgcgtacgtgccgcgcagttccttgggcagccagggtgcgttcgcggtgaatcccttgatgtgcagctcgtacagcacggtcttgctccacggcacgtgcgggtgcgaggggtcggcgtcgtgcttggtcttgtcccggtcgtcgatggccaccgacacgggcatgttgcccagtgcgtcgacggtgctcatcggcccgaacgcggagccgcgcaccttgccgtcctcgctgacgtcgcactggtatgagaacgcggccggcgacagcttcatgcggccgtcgatccccttgccatacgggtcgagcagcagcttgtacgggttgaaccgcagccccttgctcggatcccacgcgccgtccactcggtaggcgtagcgcatgccgtcccacgccttgggaagatgcacgtaccacaggccgtagttcggcccatccatgcggaacagcgtctcgcgcacgtacatgggctcgatgatgcgcgtgcagacggcgtgctcgtgtatttcgttgatgaacggcgttgctgaatcatcgaagatgcggatggcgtcgttgaagaaggcggtgggttgatcgaccttctcgtagatgcagagccacacctgatcggctgtttcggaacggacgatgacatcggcgccgccgtcttccgtgaagtacaggcccggtcgtgtcgcatagcgatgagggattgcataccgctgaggtatcgcgtgtttcatacacccattgtagcggtgtcgattttcgtccgtgtcggagcgggcgaggacgggtgcgggcccgtgtcccagccgcacagcgcgtccatgtaggggtcggtgaactgcatggccgcgccgatggcgccgctgttctcgtcgctgcggctcagccgaagggtgaaatggtcggtgccgaatacgctgagggccgtgacccgccgctgcaggtcggcgatgttgtcgtggtcgaggtacagcgccgcctccccgccgatgacgacgtcggcgcagatgacgcaccgcacgttggcgatggccagcgccacgtggtcgagccagtcgttcatgcgctcgcggtgatgggtctcgccttgctccagcacgctgaagaagccggggatgctctcgtagtcctccggcaggttttcgggagagcagtaggcggccatgcagccgcgcctgccgcagtggcacggtttgccgcctgggatgagcgtcatgtgttcgatggcgccatcgcacaggttcgggccgcggtgcaggcggccgttcatgatgagcgcgccgctgggtctgcggttcaggtacaggcatatggcgtcgctgatggcggcgtcgtgcagcgtttcggtcatggcgatggccgcggcctcgcggattagttgacgcgggtagcgcaccgactgggcgatggtgtcgatggtgacgccggtcgctccggtcgagtcgttgaaggtgatgacggtgccgtcggccgagatggcaccggggatggcgaaggatacgccgagcacggggccgtgggccttctcgatctccgcggcgaaatcgttgatcgccgaacccatccgctggtagtaggcgttggtgttggcataggggagcgtgcgtgagagggtggcgatggggcgcccctgcaggtcgatggcgcataggcgcagggtgttgcggtgcatggtgacgccgattgcggtgcgatgactcgggttgaaccggtagctttgggatttgcggccgcccgtggagtcggtcagggggccgggggcgatgatgccgtcgtgttcgagcgcgcggatgttgccggtgatggtcggcaggctcagctgcagatcgagctgcagctggcgcttggtgacgttgccgtgcgttgcgaggtggcggatgatggcctgcctgttgcgcgtcttggtgatgtttcgggttgcggcgatgtcggtgtccgtggtcgtcattggagcctcgttgctgggtcgattccgtgtggtgccggacgcatgacaccgcttttaataaataattttataaaagtttgtcgacgagtgcaacttttataaacatactttatataagttgtgtcgcggaaattcgtttgatggtgtgcgatgtcgcaaaaagcgaacaaaagatatcatttcgtggaatatcagcggcaaaacagggttaaatgtaacaaatagcaacaaataaataccaaaaacaaacacgaaacgccgttgtttttgttcgtgtgcgtttgcgcagtgtatcacgtagattgtgacgtaggccacagatgcgcaatagcgagcatgtggatggatgatccgccaggtgatggcggcaacgacaacggaatgaaaccacagctagtcgaggagtattcatggcagaagcaacacaggtcgaggcgcccgccaagccgagccccgaggagaagcgcgcggcggccgaagccgaggtcgacgcccttgtcaagaagggtctcaaggcccttgacgagttcgagaagctcgatcagaagcaggtcgaccgcatcgtcgccaaggcgtccgtcgcggccctgaacaagcatctggtgctcgcgaagatggccgtcgatgagaccggccgtggtctcgtcgaagacaaggccaccaagaacatcttcgcctgcgagcacgtcacccactacatggccgggcagaagaccgtcggcctgatccgcgaggacgaggtcatgggcatagacgaggtcgccgagccggtcggcgttgtcgccggtgtcaccccggtcaccaacccgacctccaccgccatcttcaagtcgctgctggcactcaagacccgctgtccgatcgtgttcggcttccacccgggcgcccagaagtcgtccgtggccgccgcgaagatcgtccgcgacgccgcgatcgaagcaggcgcacccgagaactgcgtgcagtggatcgaacacccgtccatcgaggcgaccggcgcgctgatgaagcacccgggcgtcgccaccatcctggccaccggcggccccggcatggtcaaggccgcgtactcctccggcaagcccgccctcggcgtcggcgccggcaacgctccggcctacatcgataccgatgtggacatcgaacgtgcggcgaacgacctgatcctctccaagcacttcgattacggcatgatctgcgccaccgagcaggccatcatcgcccacaaggacgtctacgcgccgctcgtcaaggagctcaagcgccgcaaggcatacttcgtcaacgcggacgagaaggcgaagctggagcagtacatgttcggctgcaccgccggctccggccagaagccggtcctcaactccgtggtgccgggcaagtccccgcagttcatcgccaaggccgccggcttcgagatccccgccgacgcgacgatcctcgccgccgaatgcaaggaggtctccgacgacgagccgctgacccacgagaagctcgccccggtgcaggccgtgctcaaggccgacgacaaggagcaggccttcgagatgtgcgagaagatgctcaagctcggtgccggccacaccgccgccatccacacgaacaacgaggcgctggtgcgcgagtacggcctgcgcatgcacgcctgccgcatcatctggaaccagccgagctcgctcggcggcatcggcgacatctacaacgcgattgccccgtcgctgaccctgggctgcggctcctacggcggcaactcggtgtccggcaacgtccaggccgtgaacctgatcaacatcaagcgcatcgctcggaggaacaataacatgcagtggttcaagattccggccaagacgtacttcgagccgaacgccatcaagtacctgcgcgacatgcacggcatcgagaaggccgtcatcgtgtgcgacaaggtgatggagcagctcggcatcgtcgacaaggtcatcgaccagctgcgcgcccgtgacaatcgcgtcaccttccgaatcatcgactacgtcgagccggagccctccgtcgagaccgtcgagcgcggcgccgagatgatgcgcgaggagttcgagcccgacacgatcatcgcggtcggtggcggctccccgatggacgcggccaagatcatgtggctgctctacgagcacccggaaatctccttctccgacgtgcgtgagaagttcttcgacatccgcaagcgcgcgttccgtatcccgccgctgggcgagaaggccaagctcgtgtgcatcccgacctcgtcgggcactggttcggaggtgacgccgttcgccgtgatcaccgaccacaagaccggatacaagtacccgatcaccgactacgcgctgaccccgtccgtggccatcgtggacccggtgctggcccgcacccagccgcgcaagctggcctccgacgccggcttcgacgccctgacccattccatggaagcctacgtgtccgtgtacgcgaacgacttcaccgacggcatggccctgcacgcggccaagctcatctgggacaacctggccgagtccgtcaacggcgagccggggctcgccaagaccgacgcgcaggagaagatgcacaacgccgccaccatggccggcatggcgttcggctccgcgttcctcggcatgtgccacggcatggcccacaccatcggcgccctgtgccacatcgcccacggccgcaccaactccatcctgctgccgtacgtgatccgctacaacggtgccgtcccggaggagccgaccagctggccgaagtacaacaagtacgtcgccgacaagcgctaccaggacatcgcccgcatcatcggcatcgacccgggcaagaccccggccgaaggcgtcgagaatctggcgaaggccgtcgaggactaccgcgacaacaagctcggcatgaacaagtccttccaggactgcggcgtggaagaggactacttctggagcgtgctcgaccagatcggcatgcgcgcttacgaggaccagtgcaccccggccaacccgcgcatcccgatgatcgaggacatgaaggacatcgccgtggccgcatactacggcgtgccgcaggccgaaggccacaagattcgcgtcgagcgcgagggtgtggccgccaccgaagaggcgtccgagcgcgtctgacgatggcatgacattacccatcccaggtgattgaaccaatgtgggggtcttcctatgcggaaggcccccacaattatttcaggccattcctgcctcccgctggcgggaggtgacacgtagtgccggtgggtggtcacgcggattcagtgattacctccactaatcttctcttcgcgactacccactgaatccgtcaattacctgccttgtctccctccgcggcggtgatcgcctcggctatcggatcatgccggaaatcgtggttgcgatactcaggatcatccaccggcagatgctgcaccagcgtgtcgaacacctgactgtatatcttgccgtgatcgagcaccgcgtcgagcacgtgaccgccgaacgtgcgatcgtctgacagaaaatgctcgtgaaaaccggcgacggcggctccatgaaacatctccggcgagaaatatcccagcatcgtgcccttcacgtcgtgccgcaggaacatcgcctgccggtcggcgacctccaccagagtcgggtacggggcctgctgtttgatgactgccctcgtcttgatgaagctgaaggtgcctcgcacgatgaccgagaagaacgtgttggcgcggccgttcgcctcgacgatgcggttgttgagatcctccaggccgatatcgcggcgctcgcactggtattggaacgcggcgtgatgcacgttcgcgaacggcatggtgaaatcgtccggcacgcgttccgccacgccgctttgtccgaccttataggcgacgccgtcgaggatgatgagctcgccgtcgagcccctcgccggttccgatgccggtgtcgccgtgggtgagcagttcgccgatggtcgtggtgccttcgagcagtccgggcaccagcagcgccagcgtgccgtgctgatacagctggttggcgtgatgcgccgtgatgggtttgatctgtgcagcttgcgattttgtcacggtgattacgataatgcagcacgcggggcgcttcaacgcgggcttcgcataggggagcgcctgcgctgtgacctgcctcacgaacaacacggccacctcatcccgccaaagtcccatctgcggcctctgaaatgggactatggtcggggaaggagtcggataggaaggagtaggcggatcgccgctatgccagatgaggacagatgatgatggccgctatgaacaccagtagcaggcacatcgcttcggtgactccggcgatcatcggtttcggccgtcgttgcccgcggaatcgcagcggtatcgccactgactgcgtcagcaggacgaccgcgacgacacccagccacatattgacggcgaacccggtgatggcaagcgccgcgtgccacacccatgaggccaccaagtaggatccttcccgtattcgcgaatcatcgttttggcgaacagcaccgagccatactgcgtcagcgcgaaaacgattgcggccgtcaacgccgccttcggcacggaatacgccggccaccatgcctgcacatcagtccaggaacgccagtcaggcagtacgcgaatgccctgccgatactgcgccacagcatcgcacgaaacctggccgccaccagccccgcataacggcagcagccggtccccgaacgaggcgatgaccaccgtcgtcatcgatgtggcgagcacggccacggcgttgccccacagcgagcgctcccggcgcagccatgcggcgaacagccatacggtgtccgcgttgacgccgcccgtcagcagtgcgagtgccgccagggcgatgatcggagccgtgctggcgtcggtcttggacagcgggttggacacgccgttcggctgcgtcgaggtgctgccgttttgcaccggcgatgcctgctgcttggggttgttgccggttttgtttccggcatcggccgtcaccttgaccgtgaacgatgcggtctggccatcataggtcaccgtgatcttcgccgcgccggacggcttcgcgaagtcgtaatgataggtcacggcctcatcggtcgggtcgatggccttcgtggacttgtcggagtaagtcgcggtaatcttcagaccagtcgggtcgaactgctcttgatgttcctgcacccaggtcttctcgatctcacggaacttcgcatcgccgaccgtcgaacgcagcgcggcgagggcgagcctgaatgtctctcccaagttggttgtcatcgtacagcacgaaaaccgtgcgcggggccgtttggctactgcctttcccgatagcccattgaaaatcgtgtacggataggtgtatcggcgcactgagaggtgagaataatgggctatctgcatttcgaggggttgatggcagagtagaggcgctccgggaaccgcatgattccaacaaccgtagggcagtgataccgagggtatcgtgctctgacaacctcacgaaacgcagatagacgttcccgaggcgccaaatcaacctcacgaaacgcagatagcgccgaggagcggcagccctgaggggatatggcgggattcgggcgtgcgacacgcccgcggagccgtgtggccggtagcccggtgggctgccggtaggcgacgccgaggggcggcagccctgaggaaatatgacaggattcgggcgtgcgacacgcccgaattccctataggtacccctggtgctttaattaacaagttgcctgttttgggctcgcaaattggaatcaaaaaagcgagcgtggaacaaggggtccgtttcgacgggcttcttgcatgtctacgcactgatgtggttatggccgcgaaaagtattttcgtgtgtcatgctcgccggtgccctttagcaggatggtaatagtcaacgaatcgctagaaagggcggacggcaatggcgggacagaaaatccgcatcaggcttaagtcctatgaccatgaggtcatcgaccaatcggcgaagaaaatcgtcgagacggtgacgaacgcgggtgccactgtggtgggcccggttcctctgccgaccgagaagaacgtgtttgttgttattcgttctcctcacaagtacaaggattctcgcgagcatttcgagatgcgcacgcacaagcgtctcatcgacatcgtggaccccacccccaaggctgtggattctctgatgcacatcgatctgcctgcagatgtcaacatcgagatcaagctgtaagggaggagggatcgttatgacttcgcaaagaggtagccacaaggctctgctgggtcgcaagctcggcatgacgcaggtgtgggacgagaacggcttcttcgtccccgtcacgctggtggatgtgtccaccaacgtggtcacggccgtcaagtccgaggagaccgatggctacaaggccatccagatcggttacggccagattgatcccaccaaggtgaccaagccgctcgctggtcacttcgccaaggccggcgtgaccccgcgtcgccacctcgttgaggtgcgcaccgaggacgccgccgagtacgagcccggccaggagctgtccatcgacgctttcgccgagggctcagaggtggatgtcaccggcaccaccaagggcaagggcttcgcgggcacgatcaagcgctggggcttcaagtcctaccgccgtacccacggttctcacaagaacgaacgtcgccccggctccgtcggcgcatgcgccactccgagccgtattctcaagggcaagcgcatggccggccgcatgggtcacgtgaccgcgaccgtccagagcctgaccgtcatgtccgctgatgccgagaacaatgtcctcgccatcaagggtgccattcccggccccaagggcggcatcgtcctcgtccgcaccgcagtgaagggagcctgattatcatggcaaacgttactctcaacgtcactgacggcaagggccaggccactggctccgttgaggcgcccgccgagctcttcggccacaccgccgacgaggtccaggctcacgtcccgctgatccaccaggtcgtcgtggcccagctggctgccgcccgtcagggcacgcacgccaccaagacccgcggcatggtttccggcggtggcaagaagccgtggaagcagaagggcaccggtcgtgcccgtcagggctccatccgtgcaccgcagtggtaccacggcggcaccgtgttcggtccgcagccgcgcgactactcgcagcgcacccccaagaagatgaaggccgcggccctgcgctacgtgctttccgatcgcgccaacgccggccgcgtcgtcgtggttgacttcggtgtcaccgacaccccgtcgaccaaggccgccatcgccgcgctcaccccggtgaccgagaacaagttcaccaccgtggtgttctcccgcgataacgtcaacgagtggctgtcggtgcgcaacatcccgactgttcacccgatcttcgccgatcagctcaacacgtacgatgtggtcacggctcagtacgtcgtcttcacgaaggaaggccttgaggccttcgtcgacgcgaagaccaagccggccgccaaggaggcctgatcatggtcgctattcacaagccagcacatgacatcatcctgaagcctgtcgtctctgagaagagctacgccctgtccgatcgcggccagtacaccttcgtggtggccccgaacgcgaacaaggtgcagatcaagcaggctatcgaagagatcttcaaggtcaaggtgacgaacgtcaacaccctcaaccgcgccggcaagcgccagcgcacccgcaccggtttcggccagcgtgtttcccagaagcgcgccatcgtgaccgttgccgagggccagtcgatcgacatctttggcaactgaaggttagccgagaaaagttaaaggaagaactatattatggctatccgcgtttataagccgacgaccgcgggccgtcgtaacgcgtccgtctcggacttctccgagcttacgcgcaccacgcctgagaagtcgctggttcgcaagctcagcaagactggcggtcgtaactcttacggccgtatgacctcccgccaccgcggcggtggtcacaagcgccagtaccgtctcatcgacttcaagcgttgggacaaggacggcgtgccggccaaggtcgctcacatcgagtacgacccgaaccgtaccgctcgcatcgcgctgctgcactacgccgacggcgagaagcgttacatcatcgcccccgagggcatcaagcagggtgacaccattgagaccggcgagaaggccgatatcaagcccggcaacaacctgccgctgaagaacatcccgaccggtacgatcgtgcacgccatcgagctccgtccgctgggcggcgcgaagatcgcgcgttccgccggtgccgccgtgcagctcgtcgccaaggacggtgcctacgcccagctgcgtatgccgtccggcgaaatccgcaatgtggatgctcgctgccgcgccaccatcggtgaggtcggcaactccgagcacgccaacattcagctcggcaaggccggtcgcgcccgttggatgggcaagcgtccgtggacccgtggtgagtccatgaaccccgtcgaccacccgcacggcggtcgtacccgcggtggcaagccgccggtttcgccgtggggcaagggtgaggttcgtactcgtcgtccgaagaaggcttcgaacaagatgattgttcgtcgtcgtccgaatggtaagaaccgcaagtaaagggagtatcgagaagatgactcgtagcatcaagaagggccccttcgtcgacgcccacttgcagaagaaagtcgacgagcagaacgagaaggggaccaagaacgtcatcaagacgtggtctcgtcgttcgatgatcactcctgatttcatcggacacaccttcgctgttcacgacggccgcaagcatgtcccggtgttcgtcaccgaggccatggtcggtcacaagctcggtgagttcgcccccacgaagaccttcaagggtcacgtgaaggacgacaagaaggcccgccgctaaaggagagaatgacttatggaagctaaagcaatcgctcgtcacgtccgcgtgacgccgcgcaaggctcgccgcatggtcgacctcatccgaggcaagaaggccaccgaagccgttaccattttgaagttcgccccccaggccgcggcccttccggtccgcaaggtgctggagagcgccatcgccaacgctcgcgtcaaggccgacaaggccggtgagccgttccgcgagaatgacctggtcgtcaagacgacctatgtggacgagggcgttacgctgaagcgtttccgtgctcgtgcgcagggtcgtgccgctcgtatcaacaagcgcaccagccacatcacggtcatcgttgccaacaaggaaggggatcgctgagatgggtcagaagatcaacccgttcggataccgtctgggcatcactgagagccatcgctcgaagtggttctccgattccaacaaggtcggcgagcgctacagtgatttcgtgctcgaagacgacaagatccgcaaggtcatgaacaaggatctcgagcgtgcgggcgtgtcccgtatcgtcatcgagcgtacccgtgaccgcgtgcgcgtggacatccacgccgcccgtccgggcatcgtcatcggacgccgtggcgccgaggccgagaaggtccgcgccaagctcgaaaagctgaccggcaagcaggtccagctcaacatcttcgaagtcaagaacgccgcgctggacgcccagctcgtcgctcagggcatcgcggagcagctgaccaaccgcgtcactttccgtcgcgccatgcgcaaggcccagcaggacgccatgcgcgccggtgccaagggcatccgtatcaagctctccggccgcctcggcggtgcggaaatgagccgttccgagttctaccgcgaaggtcgcgttccgctgcagaccctgcgcgctctgattgattacggcttcttcgaggccaagaccacttacggccgcatcggcgtgaaggtctggatctacaagggcgacatgaccgagcgtgagttcgaagagcagcaggcgcagcagaacaacaaccgtcagggccgtcgcggcgatcgccgcccgcgccgtggcaaccgtgccgccggcgctcagcagaaggctgcgaccgaagccgctccggctgaggcccaggccgccgccgaggctcctgccgcaacggaaacgaaggagtgagctgatgcttatcccaaagaggaccaaatatcgtaagcagcatcgtccgggccgctctggcatgtccaagggcggtaccgaaatcgctttcggcgattacggcattcaggcgcttgccccggcgtacgtgaccaaccgtcagatcgaggccgcgcgtatcgccatgacccgctacatcaagcgtggtggtcgtgtgtggatcaacatcttccccgaccgtccgctgaccaagcacccgctgggcgcccgaatgggttccggtaagggtacccccgagttctggatcgccaacatccaccccggccgtgtgatgttcgagatcggcggcgtgtccgaggaagtcgctcgcgaggctctgcgccgcgccatcgacaagcttccgatgaagtgccgcattatcgcacgtgaaggtggtgatatctgatggcagtcggtaccgctgattacgcaatcaagaatctgaacgagaagaccaacgcagagatcgagggcttcctcaagaagtccaaggaagagctgttcaacctgcgcttccaggctgccaccggtcagctcgacaacactgcccgcctcaaggcggtcaagcacgacatcgccaggatgtacaccgtcctgcgcgagcgtgagctcggcatcagccaggagcctgaggctaccgagaccaagtcggaggagaagtaagcatggctgatactacagagcgcaacttccgcaaggttcgtcgcggttatgtcgtgtccgaggcaatggacaagaccatcaccgtcgagctcgaacagcgttcgacccacccgctgtacggcaaggtcgtccgctccaccaagaaggtcaaggcccatgatgaacacaacgacgcccacgttggcgacctcgtgagtattatggaaactcggcctctgagcaagaccaagcgttggcgtctcgaatccatcatcgagcgcgccaagtaaacaagttcggcaaggctccgcgagacaccctgcctgcgctggtataggcaggcagggtgctcggggagaaccagctcggctaaggagaatcaatgattcagcaggaaacgcggcttcatgtcgccgacaacacgggtgccaaggaactccttgccattcgcgtgctcggtggatcgaagcgacgctatgccggcctgggcgacgtcattgtcgcctcggtcaaggacgcgatccctggcgggtcggtcaagaagggcgatgtggtcaaggccgttgtcgtccgtaccgtcaaggagcaccgtcgtgtcgacggctcctacatcaagttcgacgagaacgccgccgtcattctcggctccggccgtgaaccgaagggcactcgtatcttcggaccgatcgcccgtgaactgcgcgacaagcgcttcatgcgcatcgtgtccctcgctccggaggtgatctgacatggtagccaagatcaagagcggcgacctggtcaaggtcatccgcggcaaggatcgcggcaaggagggcaccgtcacccgcgtgctgcccaacgaccgtctgatcgtcgagggtgtgcagatcgtcaagaagcacgtccgcgccacgcagcagggacagcagtccggcatcgtctccgtggaggctccgatccatcgctccaacgtgatgctggtcgacccggagaccaaggagccgacccgcgtcggcgtgaatgttaagcaggaggctcgtgacggcaaggtgaagaccgtgcgcgtgcgcgtcgccaagaagtccggaaaggagctggcatgaccgatagcactatcgaggcgccggcaactccgcgcttgaagcagcagtacaaggacgtcatcgttcctgaactggagaaggagttcaagtactccaaccccatgcaggtcgctcgtgtccagaaggtcgtcgtctccatgggcgtcggcgctgcggcccgcgactccaagctcatcgaaggcgccgtcaaggacctcactctgatcaccggccagaagccgaagatcaccaaggccaagaagtccgtcgcgcagttccacctgcgtgaaggccaggccatcggtgcgtacgtcaccctgcgtggcgaccgcatgtgggagttcctggatcgccttctgacgctggctctgccgcgtatccgcgatttccgcggcatcaacggcaagcagttcgatggtcagggcaactacaacttcggcctcacggagcagtccatgttccacgagatcgaccccgacagcatcgatcaccagcgtggtatggacatcaccgtggtgaccagcaccaaggacgacaaggaagcaagcgtgctgctcaagcacctcggcttccccttcaaggagaactgatatggcaaaaaccgctcttaagaacaaggcggccggcaagccgaagttcaaggtgcgcgcctacacgcgctgccaggtctgcggtcgtccccactccgtgtaccgtaagttcggcctgtgccgcatctgccttcgcgagaaggcccaccgcggcgagctgcccggagtcactaagtccagttggtaaacatcgacgctgaaggtccgcggcccgaacgtctgcagtgcaggcgctagggcggcggaaaccacggcgagaaagggcaacaagcccacatgacaatgacagatccgatcgcagacatgctcacgcgtctgcgtaacgcgagcgcggcaaagcacgagaccgtggaaatgccgtactccaagttcaaggcgaacatcgccgagatcctgaagcgcgaaggctacatcaaggacttcaccgccaaggaagccaaggtcggccaggaccttgaggtcaccctcaagtacggcccgaacggcgagcgttccatccagggcatcaagcgcatttcgaagccgggcctgcgtcgctacgcgaagtccgactccctgccgatgccgctcggtggcctcggcatcgccatcatctcgaccagctcgggactgatgacccagaaggaatgcctcgaccggggcattggcggcgagatcgtcgcctacgtgtggtgagaaaggagagctgacacatggcatcgcatattggtaagctccccgtcaccatcccggctggcgtggaagtcgctatcgagggtcagaacttctccgccaagggtgcgaagggttccgattcctacgtcatccctgagggcatcaccgctcaggtcgaaggcaacgagattatcctgaccgccgcggatgacctgcgtcccacccgtgccaagcacggtctgagccgctcgatcatcgcctcgatggtcaagggtgtgcacgatggattcgagaagcgcctgctcatcgtcggcaccggttaccgtgccgtcgccaagggcaagggcatcgagttctctctcggctactctcacacgatcaccgtcaacccgccggaaggcatcactttcgaactgccgaacgctaacgaagtggtcgtcaagggcaccgacaagcaggtcgttggccaggtcgccgctaacatccgcaagctgcgtgctccggaaccctacaagggcaagggcatcaagtacgcggacgagcgcatcctgcgcaaggccggaaaggctggtaagtgatatgagcgtcaagattctaggtaagggcaagaaggtcgcgcgccttcgtcgtcacgctcgtcttcgcaagaaggtcgtcggcaccccggagcgtccgcgcctcgtcgtcacccgctccaaccgtcacatggtcgctcagatcgttgacgacaccaagggccacaccctggtgagcgcctccacgctgaccgccgagttcgctggcttcgagggcaccaagtccgaggccgccaagaaggtcggtctgctggtggctgagaaggccaaggcggcaggcatcgagcaggtcgtgttcgaccgcggtggcaacaagtacaccggtcgcgtcgcagccgtcgctgatggcgcccgtgagggaggtctggcactgtgagcgacaacgaagtgaaggaaacccaagtggctgaagagactcagaacactgcggcacccgagaacaacaacaatgatgagcgcaagtcccgtcgtggacagcgtggcgaaggccgacgcggcgagcgtcgcaaccgtcgtgaggagaaccacggcgacgagatgctcgatcgcgtggtgaccatcaaccgcgtgtccaagacccacaagggtggtcgtacgttcagcttcgccgccctcgttgtggtcggcgacggcaacggcaccgtcggtgtcggctacggcaagtcccgtgaggtcccggcggccatcgccaagggccagctcgacgccaagaagcacatgttcaccgttccgcgcatccgtggtaccgtcacccacccggtgatcggccatgatgccgccggcaccgtgctgctccgcccggccgccccgggtaccggcgttatcgccggtggccccgtgcgcgccgtcatggagtgcgccggcatcaccgacatcctcaccaagtcgatgggctccgccaccgccgtgaacatggttcgcgccaccgtggccgccctcaagcagcttgaggagccggaagagatcgctgcccgccgtggcctcgccctgaacgaggtcgcccccgatgcgatgcttcgcgctcgcgccgccggcatcgccgaggccaagaaggctcgtgaagaggctcaggccaaggccgccgctgaacagaaggatggtgagtgatggctaacctgaagatcacgttgcaccatggtctggtgaaccgcacgcccaagcagcgcgcgaccgcccagtcccttggtctgcgcaagatcggccagagcgtgattcgtgaggacaactccgttacccgcggcatgattctcacggttcgtcacctcgttaccgttgaggaggctgactgattatggccaacgaagatgaactcctgcagatgcacaatctgaagcccgccccgggtgccaagaaggaccgtactcgcatcggtcgtggtgaaggctccaagggtaagacttcgggtcgtggcgacaagggtacgaagaagcgctaccaggttcgtccgggctttgaaggcggccagttgccgctgtacatgcgcctgccgaagctgcgtggcttcaagagcccgttcaagaaggaataccaggttgtcaacgtctccgctcttggggagctgttccctgagggcggcgaggttaccgttgacgcgctggttgccaagggcgctgtccgtggcggtttcccggtcaaggttctcggcgatggtgacatcaccgtggccgtcaccgtgaagggcgccaaggcatccgcttccgccaaggccaagatcgaggccgccggcggctctgtttccgaaaactgattgttgttcggcaacactgcatgtgaccaatgagataaggccctccccgctcatgtcgcgggcgagggccttatctgtcattacgactcgtcatatgacatatgacaccagcgtgtctgcgggtagaccccgtacgctagactcgacggttagagtatgtttgcttcggtgcgccgggcgcgcacaacggaaaggaatccttgtgaggacgttaatccaagcctttcggaccaaggaactgaggaacaagatcctctttaccttagccatgatcatcatctaccgtattggttcgttcatcccgacgccgggagtcaactacaagacggtgcaggattgtatcaacacacttagcggtagccaggaaaacttcatcggcttggtcaacctcttctcgggcggtgcaatgttgcagctgtccattttcgcgctgggtgtcatgccgtacattaccgcttccatcgtcgtgcagctgctgcgcgtggtcatcccgcgcttcgaggcgctgcacaaggaaggacagtccggtgaggccaagctgacgcagtacacgcgttacctcaccattggcctggccgtgctgcagtccaccacgattctggtgaccgcacagtccggcgcactgttcaacaacatgtgctcctcgccgattccggacaactccgtgtggaacctctccgtcatggttctgatcatgaccggtggtaccggcctgatcatgtggatggccgagttgatcaccgacaagggcatcggtcagggtatgtccatcttgatcttcatgtccatctgctccggcttcctgccgcagctgtgggagatcggttggggcaccaacggcaccaacggcgattggctgaagttcggcatcgtcaccggcgtgctggtggtcatccttgtcttcgtcgacttcgtcgagctgagccagcgccgcatccccgtgcagtacacgcgccgcatgatcggccgtaagatgtacggtggctcctccacctacctgccgctgaagatcaacatgagcggtgtcatcccgccgatcttcgcgtcctccatcctggccatcccgacgctgatcgcgcagttcggcaagtcgggacagtcctgggtcgactggatcaacaagaacctcgccaacaccacttcggtgtggtacatcgcgctgtatgcgctgatgatcgtgttcttctgcttcttctacacgtcgatcacgttcaacccggacgagaccgccgacaacatgaaggaatacggtggcttcatccccggcatccgcgccggcaacgccaccagccgttacctgaactacgtgatgaaccgcctcaacacggtcggtgccgtgtacctgctgttcgtcgcgctgatcccgaccgtgctgatcatggcgctgaacctcaactccaagctgccgttcggcggcaccacgatcctgatcatcgcgggcgttggccttgacacgctgcgtcaggccaaggcccagaccgagcagttccagtacaccggcttcctgctcgaaggcatcgaccacaaggaaggctgatccttctgcgctcccgcttttacgggagcgaacatatataacgtattcacttcaccaaggagaccacatgcgactgctgattatgggcccgcaaggtgtcggcaagggcacccaggccgccctgctcgccgagcactacggcatccccgccatctcgaccggcgacatcttccgctacaacatcaagaacaagactgagctcggccttgaggcgctgaagtacaccgacaagggcgaactggtgcccgacgagctcaccaacaagatcgtcaaggaccgtctggccatggatgacgccaagaacggctggattctcgatggctacccgcgcaacgcctcccaggtcaaggcgctggacgcgatgctcgaagagctcggcacgccgctggacaaggtcgtcgcccttgacgccgaccacgatgtgctgatgcagcgcatcgccaagcgcgcgcaggagcagggccgttctgacgacacccccgaggccatcgccaagcgtctggccacgtacgccaaggaaaccgctccgctgctcgacacgtacaagagccgcggccagctggtcgccattgacggcgtcggcgacatcgacgccattcaggccaacatcgtcgccgcgctgagcgactgattgccgctgccggtcgtatcgccggcaggagcaaggataaagcaagaaattataacgggtcatgcacgcctcggcgtgtcgtgacccgttatgatatattctttaaatttggtgtgtcttcggacatacaagtgtaatacacccaaggaatggactgtaaggcttatggcaaaagacggtgtgattgaagtcgaaggtcaggtagtggaagcattgccgaatgcgatgttccgcgtcgaacttgagaacaagcacatcgtgctggcgacgatttccggcaaaatgcggaagaactacatccgcatcctgccgcaggatcgcgtcgtgctggaaatgagcccctacgatctgaaccgtggacgtattacgtaccgttacaagtaaataggtacaagcaaaggaaaaccatgaaggtcagccctagcgtgaagaggatctgcgaaaactgccgcgtgatccgccgtcacggccgcgtcatggtgatctgcacgaacccgcgccacaagcagcgccagggctgagagcagattccagcggcaacaaataaataaggcgctgagtcacagcgaacagctgaaccccgggtacgcaggcccgggccggggaaccggaagactcggtgcacgacctgcgtgaacacagaaggaatcgcaatggcacgtcttgccggagtcgacatccccaatgagaagcgcatcgagatcgccctcacctatattttcggtgtaggtcgcactcgtgccaaggaaacgcttgccgcgaccggtatcaacccggatattcgcgtcaaggatctgacggatgagcagctgattacgctgcgtgattacctcgaaggcaattacaagatcgagggcgatctgcgtcgtgaaatcgacgcggacatccgtcgtaagatccagatcaactgctaccaaggccagcgtcaccgtaagggacttcccgtgcgcggtcagcgcaccaagaccaacgcccgcacccgcaagggtccgaagcgcacggtcgccggaaagaagaaggccaccaagtaatagggtggcgtcgattcgggccacggggtgacacccatcgtccggatccaatccaaaacaacagttcgttacaaggaaacgagggtcaatggcagctcctaagcaggccgcgcgcaagcctcgtcgtcgtgatcgcaagtcgatccccgtcgggcaggcgcatatcaagtcaacgttcaacaacaccatcatctccatcaccgacccgtccggcgcagtcgtgtcctgggcgtccggtggcgatgtcggattcaagggctcccgtaagtccactccgtacgccgctggcatggcggccgagtccgcggcccgcaaggccatggaacacggcgtcaagaaggtcgatgtctttgtgaagggcccgggttccggtcgtgagaccgccatccgttctctccagtccgctggactcgaagtcggctccatcaccgacgtcactccgcaagcgcacaacggcgttcgtcccccgaagcgtcgccgcgtctgagcactcagcaatctcatccatccaaaaccgcttacggaaggtgagtgcaccaccgtccagaagctgaaaggatacacacagtgcttatcgcacagcgtccgacacttaccgaggaatccatcaatccgcagcgttcccgtttcgtcatcgagccgcttgagcccggtttcggatacacgcttggtaattcgctgcgccgcacactgctgagctcgattccgggcgcggcggtcacttccgtgcgtatttccggtgccctgcatgagttcaccactctgccgggtgtcgtggaagacgtcactgagattctgctgaacatcaagggcatcgtgctgaccagcgagtacgacgagcccgtggtcatgtatctgcgcaagagcggcaatggcgaagtcaccgcgggcgacatcacaccgcccgccggtgtcaccatcgccaacccggaccagcacatcgcgaccctcgccgacgacggcgaactcgaaatcgagttcactgtcgagcgtggccgtggttacgtccccgcgcagatgaacaagcaggacaccgatgagatcggtcgtatcccggtcgattcgatttactccccggtgctcaaggtaagctacaaggtcgaggccacgcgcgtcgaacagcgcactgatttcgacaagcttattctggatgtggagaccaagccggccatttcaccgcgcgatgcggtggcttccgctggctccaccctggttgagctgttcggcctgtgccgtgagctcaacgtgcaggccgaaggcgtcgaagtcggtcccgctcccgtcgcggaggagaccaaccccgagatggccgtcccgatcgaggacctcaacctcacgcagcgcagctacaactgcctcaagcgcgagggcatccacacgatcggcgagcttgtcgctcacaccgagcaggatctgctggatattcgcaatttcggtatgaagtcgatcgacgaggtcaaggacaagctgcagtccatgggactgtcgctgaagtcgtcgccgctgggcttcgataccaacaatttggaaggtggtacgttcttctcgcctgaggacgagtgacgtcacctttcgcaacagatataaccgtcggattcggacgttcgggcatgtgcccacctgaatccgacgggctataaggagaaactatgcctacacccaagaagggcccgcgtctggcgtcaagcccggcccatgagcgccttatgctcgcgaacatggccaccagcctgttccagcacggtcgcatcaccaccacgctgccgaaggccaagcgccttcgtccgctggccgagcgcctgatcaccttcgcgaagcgcggtgacctgcactcccgtcgtcgcgtgatgcgcgtcatccgcaacaagtccgtcgtgcacgtgctgttcactcagattgccgagcagatggagcagcgtgagggcggctacacccgtatcgtcaagatcgctccgcgcaagggcgactccacgcctgccgccgtcatcgagctcgtcaccgagccggtaagcccgaagaaggctgtcgtcaaggaagctgaggccgccaccaaggtcgccgccgctaccgaggctccggtcgaggagaccgccgccgctgaagctccggttgaggcgcccgccgagaccgctgccgaggagaccgccgacaaggccgagtgagacccgtctcatagacattgataggggctgggaaccgtaactggtttccagcccctgtttttgtttgttgggtggtactggaggctgttgacgggccctagtccgttgcacggacagccctccgccagcgggtgcgttggcatcagatgcggttgcgttcctaagtgcgcgccgaaacgacaaccgtgcgcacttaggaacgcaaatagccccgtttgcgtagctaagtgcgcggactcgtcgtttcggcgcgcacttagatacgcaacagtaggcgataatgacatatccacgttattacgtacctgcacgcaacggaagagggggctcccggcgtgaaccgggagccccctctagggtctcagcgtgtcatccgcgggggatgacacgtgattcggtcagatcctgcgcttacgcaccagcaggtagcctgcggacaacagcaacagggcgctgaagacgaccgccgtgaccgaagcaccggtcttggcgacctcgtcaggcgtgttcggcttcggcttgtcgtcaccgggcttgttctcgcccggcttgttgtcgccaggagtcggggtcacggtctttgccttgacggtgatcgtgaaggagtcggtgagcttgccggaggtcactgtgacggtgacgtcgcccgcagccgtgaacggcttggtcaggtcgacggtcttgccgtcggcgtcgaccgcggacagcttgtattcgccgtccttcagcagcgccgtcttgccgtcggaccaggtgcccgtcaccgcgagacctgtcttggcgaacgtctcatccacggtgtacgtggtcttgtccggcttggacgtgaccttgatggacttgagcgtcgcgggttccggatcgggatccttggccgtcacggtcacgtcgaaggtggcggtcttgccgttggcggtgaccgtgacagtgacctttccggccttggcgaacgccttgtcaagcgcgaccgcggcaccgtcctgcgtggctgagagcgtgtactcgccggccgtcagggtcttcgtgctgccgtccgacatcgtggcggtgaccgccagtccagtggcgtcgaacgtgtcgccgaccttgtaatcggtgacggtcggcttggtgacggcgatcgagctgatggtcggcttcgggccgggatccggcgtggagtccttggtgaacttcgcggtcagagccgtgttgccgtcggctgcgaacgtgtacgtggcatcggtggaaaccgccgtctcactggccgtcgtgaaccagccgctgaacctgtagccatccgccgcgaccgccttggcggtcaccgaggcaccggatgcgacgtccacggccgtatcggtgccggtttcgccctcggcggctacgctcaccgtaccgccttcggccggatcggccgcgacgaatacgcgcacggtggaggacggcttgttcgccacgccgaactcggagaccgcgacccagccatcgttcgaggacttggccacgaacttgacgtaccgcacttcctgctcgtcgaacatgaaggtcttcttggcgcggctggcctcgaacacctgatccgtggcgacctgcttccactcgtcgttcgcgttggccttgacgtacagatcggccttggtcacctgtccgctgtcctggctggtacgcggcgtgaaggagaactggttgatcgtgtacttctggcacatgtcgatctcggcgtagaacgagttcgaaccggtcagcttgtccgtggcgcccttccagttggaatgccagatggtgctcgggttgttgtcgaacgcgtaccgcagcagaccttccgtgtcgttgtattgggtctcggaattggtcgtgccggtccagcaggacttgttgtactggtctgtctcggcctcggacttcttgacgatgacgttgtcgatgacgccgttgatcgcagaggtcttcgagccgatacgctgcagcggcagtgcgaaggtcgcggcggtgatgccggtcttcttctcgatgcccttgtcgatgtacttgccggtcgcatcgctcacgaattcgccgtcaacatacagcttcgtggtctgctggtccaccttgatggtcacggtgaccgtcttgccgaccggcagctcgtaatcgaagtagtagttgtacagctctcgcgtgaagccgagcttgccgttctccatgacgcggatgtcatgcgtgccgtacggagcgtcggcctcgaagaggatgtctccgggcttggcagcctgctggagcgtcacgtcgaacgtcagctcgttgccgttgccgagcttgtcgagcttggatgtggcatagctggagccgccggcgagcttgagcgactggtccttgacggcggccttgctgccgtcgccgatggtcaggtcgcggccgttgccgctggcgtcggcgagcccgtcgttgaagtcgtagctctcgtagacgctgttcttcgaagtggcctggtagtacgggttggtgcgagggccggttccctgcttggcggccagcgccgtgagtttcgcggcggtgcccttctccttgccggtggcggcccaggtcttctcggcgtagaacggcatcgcgtcgaagaagcgccagtacaggtcggattcggtcagacccgatgcgctcttgtcgatgttgtcgctccagatcgcgaacgcggcgccgagcatctggtcgtcgccggagggcacggcctggtagccgccgctgctgcggatcttgttgggctcgaagctgtcgaagacgcggctgatgttcagcaggtcgccgtacgcgttggcacgtccgtagctgccgttgggcaccatgtagccgtagtcgtcgatcgtgttgatcagcttgtagcccatgttgtacatctggaggccgtcggcccagtccttggaccacaggttcatctcgacgttctcgatcgcgtccttggtgatctccgtcttgtggtcgttgatccaagtcaggccgccccacatgcgcacggtgttcgtgtccttgatgtaggggacgatctcgttgatgaacttacggtatgccgtgtagttgtagaggaactcgtcggcaccgatgtgcacggtcgtgtcgctgtcgaacgtcgggtcgtcgcccttggtgtagtcgtcgaagatctccttgatcttggcgatggtctcgggcttggacacgtcgaggtggtcgatgagcggtcggttggagttgatcggggagacccgtcccttcaccatgagctcgggccagatcttcgtgaaggagttggcgtgcgcgggcacgtcgatctccggcacgacgttcatgccgagggcgcgctcgtcctggatgaactgcttgaacgtcttcttggagatggagtagtcctcggccgtgggcgattcgcccttgtcgttggtcaggctggattcgagacggaacgcgtcataggccttgaacgcctcgtcctcgttgtcgcccttgccgtagttctccaggaagatgtagttgtcggacagatgcgcctggaagtcgttcatcttgtagtagcgcatcgtgcgggtgatctcgcgcatcatctccagcgagacgggcttgcgggccacgtcgagcaggagtccgcgggtggtgaagcgcgggtagtcgcgcatcgaaccgatcacgaagccgttggcgtcctgcttggtcatctgcaggatcgtctgcatcgcgtacatgttgccggtcacgctggacgacttggcgaccacgcggtcggcccggatgtccatcgtgtagccttcgtcgccgagctgcgcgatcgcggccgtggagtcggtcttgacgaagttgaacgcaccggcttcggcggcgcccttcttggcggtcagcttgatgccggtgaagtccttgtagtcggcgacgaactcgtcgaccacggccttgagcgaatcatcgtcgtagacgaccttcgtcacggcggaggccgccagcttggcggcactggtcgaatgccattcggcgatttcggggatgatggtcggcttggcgttgttgccttcctgctgctggttggtgcctttgacgacgtaggggatgtcggaggtcgtcttggtgttgccggtggcggtgtcggtgacgacgtaggcgacctgcacggtcttgtcgaccagcgggtggttgacggtgccgtcggcggcgatgagctgctcgtagtcggcgccgttgaacttgacggtgtagccgtcgggcacagtgggcagagccagcgtgtcggtgtcggtctcgatggtcaggtggttggattcgaggtcggagaccacgctgtcgagcgtggcgcccggctcggcctgatcgttcgaatacgcctcccattcggcgacgctcacgttgttgtattcggagcttttgatcgcgaagttcgacagcttgagcgagcgggcgttgacggcctgatcgagctggatgacgacgtcagcgacataaccggccccggaggccgtcatcgcgtagccggacttgagcgtgtgctcggtgccttcggagtcggtgtaggacaggtcgaagctctggacattggtaggcttcggattcacgtcacgctcgaagaaatagatgcggatgtccttgaccgcggtgagccgcgggaattccgccttcagccagatgttgctcggggtctcgtagccgctggcccaacggttgttgcggccggtgcggttctggtcgatcgccttgtcgggggtgagcgtcgccgtctcgttgctggaggcggtcatggtggcgccgagcatgtggttcgtgtcggccgtgtcgagcacggtctccttgggtgcggagtacacggaaatctcgttgatgcccacgttgacccagttcatggtgccgccgtcggcggacagtacggtcaccttcacggcggacgcctgctgtgcctggtcaagcaggatgatctcctgttgcttggcgcgggtgtccttctgatacaccttggtataggtgtcgccctgcttcagctcgactttaaaactggtgatgttctgatcggcatctttgcgctcgaaatcgatgttgatctgcttgacggtcttggtgccgcccaagccgacctcgatccattcgtttgcggccttgttctgcgcggtgccccagcgtgtgccgagatcgccgtccacggccttctcgggcgcagtctgcgccacttcatatgaactggccgttacggtctgattcagtgcaagattgtcatcgctggcttgcgccgccgtgacgccggtcagcgacatactcagtagtgtcacggctgccaggacactgcctatggccgctttcactctcctcaatcgcataatctctccattgggtatgtggttaatgttgtttctgttattgtcggaatctttgttgattggttagcgcatcgccgcattcgttgcgactttgctccaatataaacaaagtttaccgttacatccaacatttgcccacagtgtatcggcacatgggtgtcgcgaggtgggggaggggactcggcgcggcgtcgatatactggtgggcgtgatgagattgcgcattgacctggcatatgacggcggcggcttcttcggatgggcgaagcagccgacgattcgcaccgtgcagggcgagatcgaacgggtgctgcacacgattacgcgcgtgccggtcgacgatcccgccgagccgctgcgcctgaccgtcgccggccgcaccgacacgggcgtgcacgcctcgcatcaggtctgccatctcgacatcggcgaggaaacgctgagccgctgcgtcgggcacatgagcgtgccgccgaccgtagcgctcaagcaccgtctgcaacgcatgctgcccgcggacatcaccatccatgacgtgacggtcgcgccgagcggattcgacgcgagattctccgcactggaacgcacttacgtgtatcgcgtggccgaccgtgccagcgaagtcgacccgcgtctgcgcggcttcgtgctgcacctcgacgccgacctcgacgtcgccgcgatgaacgaggccgccgtgatgaccatcggactgcatgatttcggctcgttcgccacccccaatccgggcggtaccacgattcgcgaggtcaaaaccgcatattggcggcggatccccacccggccgctggtcgtcgacggcgtgggggagcgataccgcacgccggccgccgaatccgacctgctgtgcttcaccatcgtcgccgacgccttcgctcgcaacatggtgcgctcgctggtcggcggctgcatacaggtcggcatgggcaagcgctcgaccgactggttccgagagaagatggccgtgccgctgcgcgagggctccacagggccgatcgcgccgcaagggctgacgctggagcacgtcgcctatcccgccgacgacgagctcgccgaacgggccgagcgtatacgcgccaagcgcacgctgtagacgcggggtgggcgcgaaggcagacgttcggcatgccggcgaaccgttcgcggcgcgaccgattcgtaacatgattgtcgatttttcgagcgaatgcggaaaccacggccgcatacgctgggacgagttcagtatcatagagcataagcgttcagcatgcgtatctgtgagacaaggagtcgccatgacagaacggtcagcccgacaattcgccgaggaactggtcaacaggcgaggagacatcaaccgtgaactgagccgcaacggcgtgcgtttcggcgtatacaagaacggcgaataccacgaccggctgtttccatacgacccgatcccacgcatcatcgaatccgacgaattcgacgagctggaagccggcctcaagcagcgcgtgaacgcactcaacgcctacctcaaagacatctactcagacaagcgcatcatccacgacggcgtcatccccgaagaatacgtgtacacgtcggccggctactttccgcaagtcaacggcgtgactcctcccggcggcatcttcgcgcacatcgcaggcgaagacctcgtccaaggcgaggacgggcgctggtgggtgctggaagacaacctgcgcatcccgtcgggagccagctacccgctgttcgcgcgcgacatcgaacgccgtacgaatcccaaactgttccgtgacgtgcatgtgcgcgacaaccgcgactatccgcggctgctgcgcaaggccatggacttcgtatccaccgaaggcatcgccgtcgtgctcacgccggggcgctacaattcggcgttcttcgagcacgcctacctggccgagaagaccggcgcggcgctcgcgttccccgaagacttggaagtcgtcgacaacaagctgtacttcctcgactatgccggcaaccggcatcgcgtgggtgccgtgtaccgccgactgtccgacgaatacctcgacccgttcgcgttcaacccggactcggttatcggcgttcccggactgctgtcggcctaccgttccggcaacgtcgccatcatcaacgcgcccggcaacggggccgcggacgacaaggcgatctactatttcgtgccgcagatggtccgttactacctcaacgaggagccgatcctgcacaacgcgccgacctacatgccgatgttcgagaaggaccgcaaggaagtgctcgaccgcatgggcgagctggtcatcaaggacgtggcggaagccggaggctacggcgtcgtgttcggctcgtcgctcgacaaggccgcgcgggaggatctggccgaccgcatcaaggaggatccgcgccggtttatcgcgcaggaggtcatccagttccgcgacatcgacgtgatcgacccggacagtggcgaggtgagcccgcgcaagtgcgacctgcgcgcgttcgtggtcaccgggcagaacacgcacgtgtggtattccggcctgacgcgctactcgtcagtgcccggccagatgatcgtcaattcgtcgcagggcggcggattcaaggatacgtgggtgctggcgcccgaagacggcagcacggacaagcagcgcgaggagtcggtcgcctcggtgaacctcattccgcattcgaagcggcactcgctgtcgctggtcaccgcgtcgaaggccgacaacctgtactggctcgggcggtacaccgagcgcgcgttcacgacactcgtgcagttcttccccttctacgaccgcgtgatggacaccgatgtggacgcgttccgcccgttcgcgaaggcgctcgacctaccgcaggatttcgaggacttcgacgggttcatccactccttcctctacgacggcacgaaccccgactcggtgcgctccgccatcgtcgccgcgttcaacaacgccgtggtgctgcgcccggagctgacgtcgaggctgctgcagtacgtcgagctcgcggtgaagaacatcaccgaggccgccgagcgttccgccagcgcggatgacatctactcgcagcgtgacatcgccgacgacatgctcgcgttctggggcggcatcgagaactccaccgcagacatcacactgaaggcgttcgtgttcatcggcaagtacatcgagcgcatcgacctgtacacccgcttccatctggacaatagcgagctcgacgcgccgctcgccaagttggagacctactcgcgcacgctcgacggcatgccgttgccctcatgcttcgtgtccggcatcagctggctactcgggcagttgccgagccgcggctacccggagctgacgagccgcctgaacgagttcctcaccgacttcaacagccgggccatcaccggcgacccgaaggacgcgggcatgctcaacgcgatgaacatggacgccaaacgtccgtgaggggcagaccgccgatcggagcgtgaccggtcggcggccgtcagctgacggatgacctccgccgtttctgctagactagagtggatttttgcgagcattatccgacgaggagcctgccgtcatgaagaaactggtgtttgactacgagatgaagctgacgttcagctcgccggtcaccgaccatcgtttccaactgcgctgcgtgcctgcgagcggcccgcgacagcaggtggtggacgtggaggtcgccatcgagccggacgtcgaactggagacgaccatcgactcgttcgattccgtggtcatgaccgggttcatcccgcagcctcacacgatattcagctattcggtgaagggcatcgcgttcgtcgacaacgcccacatcaagtcggagatctacaagccgctgtaccggttcaactcggcgctgacgattcccgggccgtgcatcgaggccatgatcgcggcgtgccgggcgcgcatcgccgggctgccggccgacgccacgccgattgatcaggcatgggaggtgatggacgaggtgtatcaggcgttcacgtatacgcccgcctcgaccacgatccgcaccaccgccgagcaggcgctcgcccagcgcaagggcgtgtgccaggactacgcgcacgtgatgctctcggtgtgccgccacgtcgggctgaccgcccgctacatcgcgggcctgctgggcggcgagggtgcgacgcacgcatgggtggagatctaccacgacggccgttggatcgggctcgaccccacccacaaccgcatggtcgacgacaactacatcaccatcgcccacgggcgcgattaccgcgactgcatgctcgacatcggcatcttctcgggctatcaggtccagcagaaccaatgggtgaacgcctccgtccacgagcagctgctgtgagggcggttgcccggggcgttttgcgggctatctcgctttcgaggggttgattgaggctgctcgggtcatctatctgcgtttcagggggttgctcaaacgcgatacctgatgtattcggcttgttacgctattggaatcatgcggattagcgagccgtcatacttgaccaccaaccccttgaaatgcagatagatgttttgcgggagctgaatccacccctcgaaacgcagatagctcgccgatggaggctcgatggagcggtggcaggtgcgccacgcgctgatttgcgtaatcgggaaatcgacttataatgaacaagttgcgttttttcgcagcgcatggataggtgtccgagcggtctaaggagcacgcctcgaaagcgtgtgaggctaacccctccgcgagttcgaatctcgccctatccgccagcaaagagggttccgggattctcccggaaccctctttcgggcttataggaacttttgtggtgctttaggtctggttctcggcgtcagtcggtgccgttgggatatcgcgtgccggtgtggaattcgttccagtcgacgccgatcccgtatgcgggcgagacgtcgccttccggttcgggcgacgtcgctttcccgtcctccagcggatcgtcgggaatgaacgattccggccgtgggtgcgcggtcttcatgtagcacacccattcgcacgcgcggagcatgtgcgcctcgggcagtccgcggtggttgagcaacacgttcttgacgaccgagttgacgccgccctccagccggttcgtggtgcgcgccaccggcccacctgcggcaagcgccggcccgggaaaggcgaagagcttcccctcgcggaacagtttctccaaccgccggcagcggcggcgcagctccccgtgcgtccaccactggaaggcgaggacttctccgctttcgccgtcgatggcgatgatcaggcaccagccgtggcccatgtacgtgccgtcggacatgaccgtgtggcgcttcgcgtccggcggggcgatgcgcagccggattgaccagcaccatacgatgcgtttgcgcagggcgcgcgcgtcgcccgtggattccgacgccgtctgggacgacgccccggcagccatgagaggaactcctccagcgtccgcgcccgtctgcggccgcgctgcggcatcgtcgagctcagccggcaggcccggcatctccaccgttgcgtgcccttgccggtccgtccgttcttcttcatcgcacgcccgcatgccgggcatttcctcgctttgctggatggcgttctcgcaccatccagcccgccaccgggagcgcatcattttccacgcggggaaaaagacatgccgacacgcctactcgtacagggccagacctcgatcataagcaccacaaaagttcctatgggccctacgttgtcgttactggctcatcgatgagccatcgagggtgagtttggcgtttttccatcgggtttcacggcaacgtgagaccttttacgaagaaacggttatgctgcgcatatgcaatcgggctgacttctgcggcgtacgggtgttgcttttacccccgtatgcataatagggctgcgggagtgacgcgatcaggagaagaggaacgcgtccatgtcggggtagccgagcgcgaatgcggaggtgatgtgggaggagatcagcgtggagaggacacgcaggcgtgcgtcgttttccgtgccgacggtgttggtatcggtggcgttgacgtcggtggtgtcagttgcactgccggtatcgccgctgccgttggtgttgttgccggtcttgtcggtgtgcttcgacttggccgacgccccgtcatcggccattgcggcgagttgctcccgggcgcagtcgatctccgtcaaggccgttgtcggcacgctcaggccggtcgtggaatcggtcatcgaggtcggcgaggtgaggatcttctggatgtcgtagaccttttctcgcgggtcgcggctcaagccggacgcggtgaagagcaattgccccgcggtcttgtgccggtcggaccggctcagggtggcgccgggcgtatcccgcgcggcgagcacctccatgacgaacccggcgcggtcctcggccagcgacatggcgcccaaggtggcgccgtcgaggtcgatgcccagaacctgcctcaggctgtcgtcggagaccgtgcggtaggtgtcattgccaccgagtcttgtgcccagcgtcacggccacatgctcggcctgggcgcttctgatcgtgccctgcgcgaatcgctgggtgcaggtggcggccacctcgctccactgcccgacggcctgcttcgccgcgagatatcgcatgatgatatggcgacggccgttcatggtggccgtcgacgcgtcggcggcccagtaggcgttctcgcaggcgctgggctggtgttccgactccgcgcgcccatcgatccggggcgcgctgcaggcgctcagggcgccgcacagggcggtgatgcagagtgccgcgacgatacggcgacaccacgaagatatgttcctctcacggcatggaatgccgtgatctggccaatgacgtgtctgcataggcctctacactaatagacgactgtgaccatatgcgcgccaccacggctataacttcataggaggtcttgagtatggaactggacctggcaggaatgcatcagctcgccatcgagcaaggaatcgatctcgaacaactggacgccgcactggaagaggcgctgcgtctggcctatctgaaaacacctcatgcggccaagcatgcccgtgtcgagctcgacatgcgggcaggcacgttcaccgtgtgggctcgtaaggagatcccggtggagcccaccgaggatgaccctcatcccgcaccggagctgggcgaggagtacgacgacaccccgcgcaacttcgggcgcctcgccgcggccaccgcgcgccaggtcatcggacagctgttccgtaaggccgaggacgacaaggtcttcggcgccttctccggccagaagggcaagctcgtcaccggcatcgttcagcaggatgccagcgatccgacgaacgtgcatgtcgccatcggcgatgtcgaggcgattctgccccgtcgcgagcaggtgcccggcgagcgttatcgtcatggcgagcgtctgcgcgtgtatgtcgtcaacgtggcgcgcggcgtcaagggccccgagatcgtcgtctcccgttcgcaccccgagctggtgcgtcgcctgttcgagcgcgaggtcccggaactggtgtccggcgccgtgtcgatcatggccatcgcccgcgaggccggcgcccgcaccaagatcgccgtccgcgccaacaccgatggcgtcaaccccaagggtgccctgatcggccccggcggcgcccgtgtgcgcgccgtcatggagaacctcggaccggagaagatcgacatcgtcgactggtccgccgatccggcgaagttcgtcgcctctgcgctgtctcccgccgtcgccaccggcgtgcaggtcatcagcgagaagaacaagaccgccatcgccttcatccatgatgaccagctgtcgctggccatcggcaaggaaggccagaacgcgcgtctcgcggcgaagctgaccggatggaagatcggcatcgaatccaccgaagcgcacgcgaagaaggtcgctgccgaaggcaagtgatccgcgacacggcggtgacgcgcggccgacggcacatccaacgtccctagtatgctggacacggcacaccgggtgtggatgcgttatgccgtcatgccacgggatcgagatatgaggtaacacgaccatggttgcacgatgaaacgggcagaatccgtcatcggaaaatagccgcgcgagtctacgcgcggcccagaattaggagtaatgtggcgaaaaaacgcgtgtacgagcttgccaaggattttggcgtcgacagcaaaaccgtccttgacaaactcaaggacatgggtgaattcgtaaaatcagcttcttcgacggttgaggcgccggtggcgcgcaagttgaagaacgccttccagaagggcgaggcgaagccgggagcgtccgcagcggaacgcaagacgccggctcccgcaccgtcggagcatcgtgctcccgcagtcaagcccgcacctgtagccaagcccggtctgggcaagaagcccgccgcggcaccgcgtccggcggaaccgcgctctgcggcgcctgctgcacatgtgccgtcatcgaatcgcggcacgacgccgcgcgacaatcgcaacgaatcccgcggcgacatgcgtgacgctcgaccgaaccgtgaaggcggcgagaaccgtccctcacccgcgcagcgtcacaatccgcacgcgccttcagggcagcgcggctccttccccggcccgcgttcccaccaacctggtcacggcggcaacgccggcggccgtccgcaggattcccgaggaggctcccatcagggtcagccgcgccagggccagcagccgggcgcaggcagcgcaccttccgccaacggcggcgcccgtccgtcgactccggggcctcgtcccggcaacaacccgttcagccgcaagcagggcatgcacgcgcccaccccgcgcgacatcccccgtccgcacccgatggcccgtccgaccgtaaacggcaaccacaacgacaatcgcggcggccgtggcggtcgtcccggcgcaggtcagggcggtcgcggaggattccgtggcggtcgtcccggtcagggagcgcagggcgccaagccggggcagtgggggcataaccgtccgggtcagaccggcggcgcccgtcccgcgggcggcaaccgcttcggtgccggcgctggcaccggcgctggtcagggcggcggcttccagaacaactccaacacgtccggaaccggtccgtcgcgcggcggcggtcgcggtcgcggcggcgcggccggcgcattcggccgtcagggcggcaagtcgtccaaggcccgcaagaaccgtctcgcgaagcgtcaggaattccaggagatgaaggcacccgtcatcggcggcgtgcgcatccccaccggcaacggccagaccgttcgcctgcgtcagggcgcctcgctcgccgatctggcggagaagatcaacgtcaacccggcggccttggtcaccgtgctgttccatctcggcgagatggccacggccacccagtcgttggacgaatccaccttccagatcctgggcgaggagatcggctggaacatccagatcgtctccgccgaggaggaggacaaggagctgctgcagcagttcgacatcgaccttgacagcgaggagctgcaggaagacgaggatctgaagccgcgtccgccggtcgtcaccgtcatgggccatgtcgatcacggtaagacccgactgctcgacaccatccgcaagaccaacgtcatcgcccgcgaggccggcggcatcacccagcgcatcggcgcctatcaggtgaccgtcgatctggaaggcgagaagcgcaagatcacgttcctcgacacccctggccacgaggcgttcaccgccatgcgtgcccgcggtgccgagctcaccgacgtcgcgattctcgtggtcgccgccgatgacggcgtgatgccgcagaccgtcgaggccatcaaccacgcgcaggcggccaaggtgccgatcgtcgtggccgtcaacaagatcgataagccgggtgcgaacccggagaaggtccgtggccagctcaccgagttcggcctcgtgccggaggagtacggcggcgacaccatgttcgtcgacatttccgccaagcagggcaccaatgtcgacaagctgctcgaagccgtgctgctcacggccgacgccgacctcgacctgcgtgcgaacccggatatggacgcccgaggcgccaccgtcgaagcccgactcgacaagggccgcggcgctgtggcgaccgtgctcgtgcagcagggcaccctgcgcatcggcgacgccatcgtcgccggcacctcgtacggccgcgtgcgcgccatgctcgacgagaacggcaaccacatgaaggaagccaccccgtccacgcccgtgcaggtgctgggtctgacatccgtgccgaccgccggcgacctcttcctggtcgcatccgacgaccgcaccgcccgccagatcgccgagaagcgccaggccaccgaacgcgccgcgcagctcgcgaagcgccgcaagatcgtctcgctcgaaagcctcaaggagcagttcgccaagtccgaggtggacatgctcaacatcgtcatcaagggcgactcctccggttccgtcgaggcgctggaagactccctgatgaagatcgaggtgtccgacgaggtcggcatccaggtcatccaccgcggcgtcggcgcgatcacccagaacgacgtcaacctcgcgaccgtcgacaaggccgtcatcatcggcttcaacgtgcgcccgaaccgtcaggtggcggatctggccgaccgtgaaggcgtcgagatcaagtactactcgatcatctacaaggcgatcgaagacatcgaggccgccctcaagggcatgctcaagccggaatacgaggaggtcgtcacctcccactccgagatccgcgagatcttccgctcctccaagttcggcaacatcgccggcgtcatggtgcaggacggcgaggtcaagcgcggtacgaagtgccgtatcctgcgcaacggcgtcgccacggtcaacgacctggagatctcctcgctgcgtcgtttcaaggacgacgtgcagtcggtcaaggaaggctacgaggccggtatcaacctcggcactttcaacgacatcgagctcggcgacatcatcgagacctttgagatgcaggaagtcgagcgcaagtaaggcgcatatatacatgggaggcgggcgctttcgggtgtccgccgctttttcgcggacgggcgcagcgaaccattctcattacggttcgtgcgccccccgtttttcgccaatgaacagtattcgctgctgatggccggaactccgggcttttcggttttgttcgattgtgcgctaatgtgtgcaatcctcgcatgtttcttattgagaacgattcgctgtgagccttcgagtaggggatgtgcgaatatgatacgagtgatattgtcagcggttcgccgcgcaatcgaggaaaaggatttttatggcaggaacgaacccgcgcgccgcacgagtcgcggcgctgatccaacgggtgatcgcgtcgtcgatggaagctcagctgcacgacaagcggcttgcgagcgtgaccatcaccgatgtgcgcgtcaccaatgacttgcagatcgccaaggtgtactggactcagcttgggcatgatgggcgcgagcagggggagcgcaagcgcgccaagcaggcgctcgatcaggcgaaagggcggctgcgttcgctggtcggctccaaagccggcctgcgactgaccccgcagctgcagttcatctatgacgaggtgccgagcgaggcgcatgagatcgaggatatcctggctgtcgcgcacaagcgtgacgaggagatcgccaaggcgcgcgagaccgcgcagtacgcgggcgacgccgacccgtacaagcatcctgaagagcgcgatgacgacgagtttgacgatgacgacgagtacgacgagtacgcggacgacctcgacgatgacgacgtcgaaggcaacggcatcggcgtcgagaccctggaagatgacgccgagaacgcggcggacgaggcaacgggcgaccgctgagccgcatatcagcggttctgcgagacgggagaggattcactgatggggaccgtacccgaagcctcgggcggcgagcaggctccgatcgtggctgcgcaagccgcgcctgtggctggctccgccgcgccggcgactcctacgtcgggattgttggtcgtggacaagccgcgtggcgtcaccagtcatgacatcgtcgcggctgcgcgcggcgcattgcatatgaaaaaggtggggcacgccggcaccctcgacccgatggccaccggcgtgctggtcgtcggattcggcaacgccacgcggttgctgaaccatatcgtcgaacatgacaagacctatgaggcgacgattcgcctcggccagtccaccaccaccgacgatgccgatggcgaactgctgtcggctacctcgcccgagcgctggcaagagctgctggcattgccggtcgccggtgggcctcagtcggctggcgagaatgggcctgtgaacgcggccaagggttcggccgtggcaaccgcaaaggtcgcggatgacggctccgcgtatcatccgcatcaggaagcgtttttgccggattgccagcagctgtggcgcgaccgtatcggtgacatcatcgcattgcagctcaccggcagcatcgagcaggtgccgaacacgttctccgcaatcaaaatcaacggtcaacgtgcctatgatctggcccgcgacggcaaggacgtgcagctcaaggcgcgtcggatcaccgtcagcgcgttcggtgtgctggatgtgcggttcggctatgccccgacgcggcagctaggacttccgctcgtctcggcggcggacgagcgggcgacgacggaacgggatgacgcggaggcgacgccggtgatcgacgtcgatgtgcgcgttagctgctcggcgggcacatatatccgcgcgctcgggcgcgacctgggcgcggcgctgggagtcggcgggcatctgatacggctgcggcgcacacgggtgggcggtttcgacgtctcctcgccgaatgtcatcaccgcgcacgtggagacacgcgagtacaccgaccgcaacggcaaccaccagtcccgcaaccgcgccgtgctcgatgtgattggcgacgagcttgcaggcaaggcgctgacgatgctggatgccgcgcgaggcaccatgccgctgctcgccatcaccgatcaggacgccgtcaacctgcggtacggccggcgtatctcctatgacatccacggtacggtcgccgcgtatctgccgcagagcggggaagtggtggcgctcgtcgagcgcgccaagcgtggcgaggccaagccggccaccgtattcggcgcgtaatgcgtcactgtgtgcgaggtgcgtcacgctgtgcgtccacgcacacagtgacgcaatgccagaaatccttattttccaaaggttttgtggtatgcgtcacgctgtgcgtccacgcacacagtgacggcgcccgcacacagtgacggcatcgggacggcatgatgcaaatcagttcatcatttcggtggcgcagccgcactggtggcgggtatcatggaaggccggaaccatgcccacaagccgcatatacggcgcaacacgtgaaggaacaccatcacccatgaaaatcacgactcttgccccggacgcctccgggctggtcgaatggccgacgctgagtgccaacaggaaatccgtggtcacggtcggcgtgttcgacggcatgcaccgcggccatcaggcggtcatccgccgagcggtggaactcgccaaggccgacaaggcgttttccgtggtggtgatgttcgacccgcgtcccggtgtcgtgcacgcgtacgcggccgcccatgacgggcaggagccgggcgacggcttccgcgaccccatggcgctgaccagcgtcgaccagcggctgcggacgctggagaaccttggcgtggaccatgtgctgatcgtgcgctatacgctggcgttcgccacgaaatcatatcggttcttcctcggccagatggtcggcaaactgggcatgcgcacgctggtgctgggaacggatgcggcgatgggcgccaaccgcgctggcgatgtgaaggccatcggagtcctcgcgcaggccaccggcgtgttcgagcttgagatcgtcgacgaccgcggcccaggtcatgtgcgtgtgccggccgacgttaccccgcagatgccgagcgagcctggggagcctgtggatccgaccgaaggcatgaccaaggcgcagctgcgcgcgtggagcaagaagcatcaggggcgcgaagtgcgcgtgtggagctcgacgaacgtgcgatacctgctcgcacatggtcgtatcaaggccgccgacgagatcctcggccatgcgcacgccatcgagggaacggtggtgcacggcgaggagcgcggccgcacaatcggtttcccgacggcgaacctggggagcatgattgacggttatattccggtggatggcgtgtatgccggctggctgatcgatttgggcgcggcgggagcgaccgccgactccgacgagaatgcctccgacggcaacagcggcagcggcaatgcctcggtgattccgcgcgtgtatgattctggctcatccaaggccaggctcgccgccgaatcaccctaccggtggccggcagcgatctccatcggcacgaagccgaccttcaacgaagagaccggtctcaatgagcgggtggtcgaggcgtacgcggtcaccgacgaatggctggacctgtatggtcacgacgtgcgcgtcgaattcgcgggattcctgcgcccgcaggtgaaattcgacagtgccgatgcgctcaaggacgaattgacgcgcaacgtccaggagaccagggaactgacctccgcgcgttgagcgcggtaggagcacccgacagaagtcggtctctccacctgcgtccgaacggtatcggcataggctcgcatgcgctgaatcgcgccgctatcgtgcctcgcgtatcttgcgcgtgccgtgtcgccaccgtcaccgtcactgtcagacgacgcccagagactccagcgcgtcgcgcagatgcgtcacctctacgatgcgcagcccctcgatggtgacacgcttgcgcatcggcggcaccaccgccgtggcgaacccgagccgcgcggcctcgcgcagccggtgctccagccgcggcaccggcctaatctgcccggtcagggagatctcgccgatggcgcacgtgtctcgcgcgattggcttcgacctggccgcactggccagcgccgccacaatcgccagatcacaggctggttccttcgccagtcctcccgcgatcgtcgatacatacaggtcgttcgccagcaggttcaccttgccatgtcggtacagcacggcggtgagcatagcgatgcggttcgtctcgacccccaccaccgcccgtcgcggtgtcggcagcacggaattggtcaccagcgcctgaatctcaatgggcaggctgcgatggccgtccagcgtgaacgtcacgcacgtgccctccacacgttcgtcggcggacgacaggaacagtcccgagggatcgctgacctcctcgatgccctcgccactcatatcgaaacacccgacctcatccgtcggcccgaaccggttcttcaccgcccgcagcatacgcagcgccgtttccggatcgccctcgaactggcataccacatccaccagatgctccaacgtgcgcgggccggcgatggacccgtccttggtgacatgcccgaccaggagcacggggatgttcagcgtcttcgccgtgtcgatcagcgcgctcgccacctcgcgcacctgcgtggagccgccggagatgccatcaacgtcttgcgagacgatggtctgcgccgaatccacgatcgccagtgtcggccgcgtccgctcgatcagccccagcacggtggcgagatcggtggtggaagccagcagtaggttctgctccatcgcattgacccgcgacgcccgcagccgcacctgcgcctgcgattcctcgccggagacgtacagcaccgagccgttgggctggcctgcggcgatgttgccggcggtctccagcagcagtgtcgacttgccgatgccgggttcgcccgcgatcagcacgaccgagccgggcacgatgccgccgccgagcacacggtcgaactcgccgaaacccgtggacagccgtgacgccgtggacgtgtctatctgggtgatgggcgtcgccgcgctgacgatggacacggccgcctgcgtgcgtgaggtgcggcccggcgccgcggtgcgcgacgacgatgcggcggaacgggcctcgtggaattcctccacggtgccccactgcccgcactgcgggcagcggcccacccatttgagaccatcccaaccacattcgctgcatacatatcgcgtcgccgacttcaccataccgcagaccttagcacaaagcggcacgccgacgtcgccgacgaaacgatgccgttgcgtcgtatgcgcgtgagagaatcacagcatggcaaagactcaatccccttcctatccgcacggtagttccgcatcgcgcggcaagctgatcgtcgtgatgatcgtcgccgcgctggtcgtcgtgcttgcgctgctgtccgcgttcgtatggcccggttgggcattgaacaagacggacgaagtgacgaaggtgcagcagcagaccgccaccgagcctaccaagccgagcatcaaggccaccgcgctgccggatgacgcatccgaactgctcaaggcgatgccggacagcgtgctcaactacgcgcgcaccaaggcgggcgccagcgagacctggaagtccgcgtcgccgctggaggagtacacgctcacgtactccacgggcaagtcggcgaaggacgtgaccgtcatcgtcgcgcaatggtcggactccgacaccgtgaagaagcagtacgacgagctggcgaagaacctgaccggcaaggagctgaagtccggggacgtcaaggtgtcgggcaagagcaccggcagctacacggtgagggccgacagtaaggatggcaagaccgcgacggcgttgtggcagaacgataccgccgtgttcgaggtgactggctccaaggaatccgtgctgcggttctacgagccgttcccgctgtgatttcgtgataattcggggtgatttgcggattcatggcggaaatggaacgcgcggatgcgtaagtccctcaatacgtgtactattgggcaagttgcaatctttaacgtactaagggaggctgacgatgggttcggtcatcaagaagcgccgcaagcggatgagcaagaagaagcaccgcaagatgctgcgtaagactcgccaccagcgcaagtagtcgttcgcttgcaagagcgcacacaaagccccgcgaccctgtcggccgcggggcttttacattctcgtccccgctggcggaagcgagctggatatgacagcgccggcagactccgatgggggggggctgccggcgccgggattgaggcggcgattcgccgcgttaggtcacttgttgccgttggccattacgcgtgggccgttggggtcgccgacgatgaccttgtcgaccatgttgaggaacaggccgtgctcgacgacgccgaccgtgttgatcaggtcctcggcgagatcctgcgggtggtcgatgcgctcaagatgcaggtccacgacgaagttgttctcgtcggtgcgcacttccttgccgtcggcgtcgaggcgcagcaccggcttgtagttcttggcctcgaactgcttgatgacgtggccggcgccgaacggaatcacctcgaccggcagcgggaacttgccgatggtgtcgacgaccttggactcgtccacgatccacacgattttgttggagttcgtggccacgatcttctcccacagcagtgcggcgccgccgcccttgatgccgttgaagttcttgtccacctcgtcggcgccgtcgatggtgatgtcgatatgatccacatcatcgatgtccacgatcttgatgccgtaaccttcggcctgctcctgcgtgcgacgggaggtcgtcacgccggtgaactgcaggccctcctccttgacgcggcggccgagctcatcgaccaggaaacgcacggtcgaaccggttccgagaccggcgatcatgccgttctcgatcagcttggcggcttcgatgccggccgccttcttcagtgcatcctgctgtgccttgtccatcatgtactccttgaaatgtccgtgcattccccttggagggaaacatgcttcaaactttgggattgaagtccacctctatagtatccggttcgtggaacgtcaccgccgttcgtccgggttttgggaggagaaccgtcgccattcggctgctatccctgcttgtccgtatagaacgtggcattgtcgagggtgatggtgccgtcgccgttcacatatccgtccacgcgaaccagtccgtggatgatgcgcggccgtccgtcatatgtcgggctggtggatggcgggggagtaaagcgcagcgtgcccgacgcggtgagggcggtcggtgagagccgcggcgccgcaggttcggccacagagcgtgtggagctgccggactgtgtgccttcggcctgtgccgaattcgatgacagtgcgacggtcgcgtccgattcggtcgtcataggaacagcaggagctgacatcgcagtggtggatgatgtgtccgactgggtctcgccgtagtcgggcacgccttcgggttcggcaagcagctccgccaacgatggcttgcggattcgctttgcgacgttgtcgccgtccgattcgtgctcggctcccgcttcacccgattccccgcctcgcccgagatggtactcctgcgtggaaatcttgccgtccagcagcatctgcgcatcctccggcacgtcggttcccttggcatactccgaagccagcagcgactgccatccctccttcggcagatatccctcctgcacgccgctgcggcagtcgccggcatacgtgcgggccaggtcgtccaccttctcgttgccggcgttgcccgcgtgccccttgacccacacgaacttcaccgagccggcgcggcgcgacagctcggcgtcgatcgccctgatgagcgccgcgttcttcacaggcttcttctgcgagttcttccagccgttcttcttccacccgtgcacccacttggtggaacagttgatggcgtactgcgagtcggtctcgatgaccagcggctccgcgccgggatgtgcgcgcagcgcctccagcactgcgcacaattcgccgatctgattcgtgccgttcgtggcgccgccggcatcgcagtcgccgccgtgctcatggccgccggaatgtgccatgttgagttcgtggtcggcccaggcccagcccattgggccgttcggattgcccagggcgcttccgtctgtcgatacggtgatggtcatgacaacaacagtaacgcacgccgtgccgcggccatgaatcgccgatgggctgcgacacgaccgaaaacgtcgcgatattttgttaagtatatatactgaatactgaccaatgatgaactcacacgagtccccgtgtcacgatgatgcaaagcagcatggtgacgaataattcaatgatgagagattcagccggcgcgtccccagtgccggacaaggaaaggaaccccagtatgcgcagcaaggcattaggaggcctgcttgccgcggctctgtcgttgagcccggcagtggccatcggcgtgcagacggcgtacgcggcaggcggcgatacggcggcgaccgaatacacgctgtaccccaagccgcattcgatccgttatgacagcggacagtacattcttcgcgacatcaacgtcatctatgacgatgacatcgatgaagccacccaggaccgactggacgaagtggcggcgctcaagaacctgaacgtcaccgaatccgacgccgcagtcagcggcaagaccaacgtctatgtgggcgtgaacggttccgatggcaaggccgagactgccatcgaaagcaagtacagcccggattccgccatcttcgacaagaccgactcatacttcctcaagtccgacaacggcacgatctccgtgctcggcaaagacaccgacgccagcttctacggcctgaccaccctgtaccaggtgctcggccagatcgatagcctgacgatccgcaacttcaccgtcaccgactacgccgacgtggtcagccgcggtttcatcgaaggctactacggcaacccgtggagcactcaggaccgcatcaacctgatgaagtggggcggctactacaagctcaactcgtacttctacgcccccaaggacgatccgaagcacaactcgcagtggcgtacgctgtacacgcaggacgagctcgacaccaagatcaagccgctcgccgatgccggcaacgcctccaagacgcgtttcgtgttcgctctgcacccgttcatgaacaacgcgattcggttcaactccgaggcgaactatcaggccgatctgaaggtgctgcaggacaagttcgcgcagaccatcggggtcggcgtacgccagatcgccatcctggccgatgacgcggcgaacgtgggtggtaacaattacaccaagctgctcaccgatatggtcgcgtggctcaaggaaatgaagaagacctacccggacctcaagaccacgctgccgttcgtcacgcaggaatacatgggcaacggcatgagctacttcgccaacttccccaaggaagtgcagatcgtcatgaccggcggtcgcgtctggggcgaggtctcgcagaacttcaccgacacgttcacctcgaacgtcggccgcggcccctacatgtggatcaactggccgtgctccgacaactcgaagagccacctgatcatgggcggctacgacacgttcctgcatccgggcgtcgacccgtcgaagatccagggcatcgtgctcaacccgatgcagcagtccgagccgagcaaggtcggcatcttcggcaacgccacctactcgtggaacatctggcggagcaagagcgaggccaaccaggcatggcaggattcgttctcgttcgtcgaccacaactccgctgtgccgaccgccgcgtcgaacgcgctgcgtgagctgtccaagcacaccatcaaccagaacatggattcgcgcgtcaccgcgctgcaggagtccgtggacctggctcccgcactgaccgccgccaaggcgaagctggctgacggcaccatcaccgcccacgacctgaccgacatcaaggccgcgttcgtcacgctgcagaaggcagccaagacctaccgcgccaagggcgatgcgaagatgctcggcgacatcggcaaggactacaccgggcaggacgccaacgagcagatcgccccgtggatcgactgctgggatgacaccaccaaggccgcgctcgcctacatcgcgggcatcgaggccgcgctgaacggcgacacatcctcgacgctcaaggagtactccgacgcgcagtccgcgttcgccgcgtccaagaagcacggcttctactacgtgaaccacaccgagtacgccgaggtcggcgtgcagcacatcgtgccgttcatcaaggcgatggactcctacctgtccaacaaggtgcagcaggaggccgacccgaacgtcgtgaccaagacgtacatcagcgacgtgttcaccacgccgacctccggttcgatcgaagacatcttcgatggcaaggacagcacggtcacggtgttccagaacccgaactacctgcacaagggcaactacgtcggcgtgaagttcagcaaggccagcacgctcaagaacatccgcttcgcgttcaacggcggcaagaaccacttctaccactccaagctgcagaccaccacggatggcgagaactggaccgacgtgccggatgcgacgttcgagcgcccgaagggctccgaggagccgatcaaagtcaccggtctgaacatcaccggcgtcaccggcgtgcgactgatcgccaccgccgacaacggcgatgacctgtggctcggcatcaagggcatcgacgtcaacaaggtcgagaaggagactctcgctccgtacacggcgaccggcgtgcagctggagaacctcaacgccacctacagcagcaccaaggagcagatgatcgacggcaacccgtccacgatcacctacctcaaggacccgaacggcgacaagatcgcggccggcgcggccgtgatcgtcgatctgggctccagcaagccgatcggcgaggtcacgattaccggtcatgcctccagccccgacgaccgtccgagccagggcgtcgtcgaggtcagcgatgacaaggccacctggaccaagctcggcgacctgagcgacgacgtcacctccacggtgagcggcaacgtgaccgggcgctacgtacgcatccgcaacaccgccgccaagaacgtgtggtggcgcgtggccgagatcaccgtgaccccgcccgagaccgccgacccgctcaagtcggtgtacacgaacaagacgcagcacgggtacactgccacgctgggcgccaatacggcggagctgttcgacaaatcgcacacgatgcttgacggcggccagtacgccggactcgatctgctggcgatccgtgatctgaccgacgtcgaactgaacaccggcaacgcgaaccccagcctgcagatctccgacaacggactcgtctggaccactgtcgagccgggcaacctcacgggcaagaccgcccgctacgtgcgcgtgatcaatgacaccgacggagcggccttctcggtcaacaagctcaaggtcggcttttccacggtcggcaagttcggcaagctggtctcatccgacatccagaagcgcaacgattggggaaccgacacccgcgaaagcggcaacgcgttcgacggcgatatgaccacggtcatcaagttcgccggccagccgcgacagggcaacaccgcggtgttcgatctcggtcagccgatcgacatcacctcgctgcgcatctacacgcaggacacgcagtacgactacatccgcgacaccaaggtgcagatgtccgtcgatggcaagacctgggttgacgcgttcgagattggcgacggtgtgtccgacaccgacaccacgaccgcgttcggcgacataagcgacacgaacaagaagaccgattccaactacccgaacgtcttctactacggcaaggacgacatcgccaacggcaccggcatgcgctacctgcgtctgctgaccaccgccgactacccgcagcgtgcactcgcgttcaacgagttcatggtgaatcagggcgcctacgtctccaccgaggcgaacgcggcgttctccgccaccaaggtcgaggagcgcggccacgcgccgagcaacatgatcgacggcgacctgaccaccacgtacaagccgagtgcggccaatggctccctgacctacaagatcgatgacccgagcgacatcaagtcgttccgcatcgtgcagtcgggtgccgccagtggcgcgaccgtcaccggtacggtgtacgacgcggcgaccggaaccacttccggtgtgacggctcgtacagccgcccgctccacctccgaggtgacgttcggaacgctggaacaggcgatcaacgagttcaaggtgccggacggcgagcagctgctcagcgtcaagatcgcgtggggcgacgccatccccgagatctccgagttcatcacgctcgactcggccgacactgatgccgacatcaccacggccaaggcggcgctcaaggcgaagatcgacgcgaccgtcgacacttccgcctggaccgcgaacgccaagaccgcgtatgacgaggccaaggccaccgcccaggctgtgtacggcagcccgctggtcggcaaggcttcgatcgacgccgcagccagcgccgtgcaaagcgccatcgacgccgcgcagaccaaggccgacgccgccgcggtcgccgcgctgcgcaagctcgtggacgaagccgtcaccaacgacggccacttctacacgacagtgacgttcaccgcgtacaccgacgcgctcgacgaggtcaaggaagcgctgaaggacacgaccaacctgtccacagcagacgccgcaagcctcaagaaggccgtcgaggacgctctcgccgcgctgaaggactccacctaccagcgtgagctcgcgacgatcgccgtcgacagcttcgccacgatcgacgaggccgactacaccacgaactcctacgcggctttcaaggccgctaaggaggcgctcgacaccctgatcgccgccgacggcaccaagccggccacgttcaagaccaagaccgccgagtacaccaccgccaagaccgcgctggtgaacgtcgccgccctcaaggcccagatcgcgcacgagagcaactacgtggaggcgaactacaccgccgactcgtggaaggcgtactccgacgcgctcaaggccgcaaaggcggagctggtcaacggcaccaccgattcggtggccgccgcgctgaccgcgctgaccactgccgagaacgcgctggtgcgcaccacgacgccgcccgacaccaccgtgctcgacgagaccatcgccgacatggaaaaggttaacggcagcgagtacaccaccgacagctacaaggtcctgaccgacgccatcgccaaggcgaagagcgacaaggccaagggggatgccggcctcaaccagcagaacatcgacgccatgaaggcggcgaaggaggccctggtctccaccgtcgaactcaaggcgaaggtcgccgaagccggcaaggttgactcgtccaagtacaccacggccagctacgaggcgctctccaagctgctcgccgcgaaggacgacaccacctccgacccggtcgtcaagggtctcgacacgctgtacaagtccggcaccgtcaaggagctcgccgagcgcgtcgccgccatcgacgccgcggtcgccaagctggatgcccgcgccaccggtgtcaaggactacgtggacggcatcaagctcaaggacaacgacaagggctactacaccgacgccagctacaaggcctactccgacgcctacaaggcgctgaagaagctggccgccgccggtgaaggcgaagtcgggattgccgagttcaccgaagccaaggaggcgttcgaagccgccgaggccaagcttgcctacaagtccgcggactacggcaagatcgatgacctgctcgccaaggtcccctcggacctgagcggctacaccgccgactcggtggcgaagttcgaggcggccaagaaggccgtgaagcgcggactgaccatcgaccagcagagcaaggtcgacgcgatggccgacgcgctcgaagccgccatcaagggcctgactctcaagtcgcaggcacccggtggcaacaagggcgacggaacccagagcggcactcataagggtgacgacatctccaagaccggcgccgacgtgcaggtgttcgcgatcatcatcgcgctcgccacgtgcgctggcctgggcgccgtggcctacgcccgtcgccgccgcgaggcgtgacggcaggctgactagccgataacccaaggggctcccctccaatccaaggaggggagccccgatttgttggacgctgtgtaaatgtatcgcggacacgcgcgatccgcgcccgttacgcgaacaggtcgttcagcgcttcggccatggtcggatgcgtgaacatcatgtcgcgcagcgtactggccggcgcgcccatatccatcgccagcttgacgatgttgatcacctcgtgcgattcggcggcgagcagcatcgcgccgagaatgcggtcggtgccgttctcgacgagcgccttcatcatgccctccggccgacgcatcacctgggccttgggcaccgtggccaccggcagtcgcttgaccacgtaatccagtcccgccgccttcgcctcgcgctcattcaggcccacgcgcgaatacggcgtgtgcaggaacgtgcttgacggcacgttgcgacggtcgctcagcgtgtacgggcgcgcggaaccgttcagctgagaccatactacgcggtagtcatccagcgagatgtacgtgtgctgcgggccgccgttcacgtcgcccaaagcccagatgccgtcggcggtggtacgcagcaggtcatcgaccttcacggcgccgcgttcggtgagttccacgcccgccgcctcgagattcaggccctcgacgttcggcgtgcgtccggtggccaccaacaccgcgtcggtggacaggcacagacgcgctttggagccgacgtccgacgcacccctcatcgagacggacagcctgatgccgtcatccgccgatgtgatcgccttggtgtccgcgccgaacaggaacctgaccccctgcgattccagctgtgcacggatcgcggccgccacatcctcgtcctcgcgtggcaggaactcgtcgctgtgctgcagcacggtgaccgccgtgccgaaatcggcgaacatcgaagcgaactcaagtccgatgaatccggcgccgatgatcaccagccgttgcggaagctcgtcgacgtccatcagaccggtgctggtgtatacgcccggagtggtgcgaatgccgggaatgtccggaatgtgcggcgtagcaccggtgttgatgaacatcatgtccgcggccacggcgaccggtccgtcggcggtggtgatttccgcactgtgggcgccggtgaagcgcgcgcggccggtgatcacggtgatgttgtcctggtcggccagcttatggtagttcctgtcgcgcaacatcgcggtgatgcgccgcttctccctgatggcggcttcgaatgccgcttcgcgggtttcggcggtacggttcgcgccctctcgccgcgcccgatcggcggagaggatcagtgatttggacggcaggcatccgatattgatgcaggtgcctccgtacatgtcggcgctcgcttcggccacgatgaccgttcggcccgttgaagcgagctttgcggccaatgtcttgcctcccttgccgaatccgatgatgagggcgtccgcggaaatcgcggatggaacgtcggtgctgctggtgctggtcatggtgatgtccttacttatgcggatggtggtgcgcccaaaccgaggtgtatccgtctttcgtccccttccttggcgacgatgggaccggtcgacgcgagtgggcgcaccactgtacgcacgcgcgccgaagtcggagccgtagtcctgtcctatgcggctacgataccgtcatcatatcagatgcggtgggcggagcgaagcgtgaatcggacttatccacatggttatccacacccgaggtgggtccggtcacggcgttcatccagacggcccatgggtgtaatgcgaaggcccttcgcggaagctgatccgcaaagggcctcggggtcggtcgtttggtggctaacgggccgccagcccggccatgcgttgcatggatctcattcgcccaatgccttgtcgacgacgagcttggcctcgtcgagcaccttgtcgagggcctcgggggagacgaaggattcggcgtacaccttgtagatgttctcggtgccggaaggacgcgccgcgaaccagttatccttggtggtgaccttcaggccgccgatcttggcgtggttgcccggcgcctcggtcagcttggcggtgatgtcctcgccggccagctgcgtggcggtcacgtcatcgccggtgagcttggcgaacttagccttctgttccagcgtggtcggggtgtcaacgcgcttgtaccagctctcgccgaagcgggccacctgatcctgatgcagctgcgcggggttcttgccggtcttggcggtgatctcggcggccagcaggtcggggatcaggccgtccttgtcggtggtccacacgcggccgtcgcggcgcaggaagctcatgccggagctctcctcgccgccgaacgcgacctcgccgctgaacagcggatccacgaaccacttgaagccgaccggaacctcgacgagcttcgcgttgatggacgaggccacgcggtcgatcagggaggaggagaccagggtcttgccgatgccggtgccttccggccagcccggacggttgccgccgaacaggtactcgacgcacacggcgatgtaatggttcgggttcatcacgccccagttcgggcagacgatgccgtggcggtcggcgtccgggtcggtgccgcccaccaggtcgtacttgtcccaggcaccggcgttgagctggtccacgaggcccttcatcgcgtacggggagctcggatccatgcggatcttgccgtcgtggtcgatggtcatgaagcgccaggtcgggtcgacctcggggcgcaccacgccgatgttcaggccgtacttctcgttgatgagcggccaatagttcacggaggcgccgccaagcggatcgatgcccaggcgcacgccggagtcgcggatcacgtcgaagtcgatgacgttgcccaggtcggcgacgtagtgctcgcggaagtcgaagccctcgacgtactcggacttgatggcctcctcgtagggcactcgcttgatggacttgaagtcgccgagcagttcgttggcgcgggcggcgatggcgttggtggtctcggccggtgccgggccgccggtgaccggatcgtacttgaagccgccatcggtgggcgggttgtggctcggggtgaccacgatgccgtcggccaggccctcgccttcgaagcgctgggtgccgtcggccgcgcggttgtgcgtcaggatcgcctgggagacgactggcgtggggacgaaatcgccgcgggagtcgacgcgcacgtgcacgccgttggcgacgagcacctctatggcggtcttctcggccggaccggacagggcgtgggtgtcgcgtccgaggtacagcgggccggtgacgccggccttcttgcggtactcggcgatggcctgtgtgatggcgacgatgtgggcctcgttgaacgaggtcttcagtgacgagccacggtggccggacgtgccgaagatgacacgctgctccggaaccgccgggtcggggacgaggtcatagtacttgccgatgacttcgtcgacattgatcagatcagctggggtggcgggcttgcccgcattgtttgctaccatgcttctattttgccacgaccagtgtcatttgggttacgtttttgtgagaaattgtgattttttgttcgagaatgttggtgatgttgccgggcgtgctgcctgcgcatgccatgtgcgcccagctctatccgctctgtcattaggtacaccggtacattacgggttcaaatagccgttatctggtattccccgtgcgaaatggtcgtttcaaagcccaaaaacgaccatttcgcacatgcaattgtgaataacggctatttgaacccgtaatgtaccggtgtaccagataagaggatgacggcggggagggggaaggcggaaaagaatgcagcgaaaagagacgcggaggaaagggacatggcggaaaaggggcacggcgacaaggatgcgaggaagcacgattgaccctagaggattgattagtggagtgacagagtacgacggatagccccggaggacaggatggcgaagggcggaacataggggatggagacgcgggaggaagggacgagtggaaatggcacggcagaggcggtctgtgttggccatcgacgccgatatgccaacggcatggggaatcaaaggcgcttggaaccggcgagaggttgatggattggcctttgccgcgaagagggcggcaatcacgatggcaccggtcgtggaaccggtcttcgcgagcgtcttcaccgcatcggcggaaggcgcgacctgaacctgcggcttgaagatcgtgaccttcggcttgctgggcttggtcggcttggtaccgggcttaactaacgagctcagccggctgcgtcggctcgccaggcttcgtcggcgccttgtgcatgttggcgaacgtggccgcgtcaacggtctcgccatccttcgcatacgagacggcggcggtcagcgtgttgtcggccgtcgcggtcacggtgatggtcgccgcgtactcggtgctgtcatacgtgacgccatcggcgttgccggcgacctgcacgagcgtgtactcgtacgtgccggcagcgtcgaacggcagctggtcgaaagtgacagtgccatcggctgcgttcgtggtagtgcccggcatccaccacgtacgcagccgcaaggagaacgtctccgatttgcgcgacaccgtcggcgcgaccgcatacggccatgtcggcgacaacaacgatgccggtatactcgaccgcctgtccacgagcaagtacaagaacccggccgagctgtccacgtgaggcgcagacaccaccggcccagacctgaccaccaagggtgtgggtaatttcacgcaggatgatggcatcccgttgcaggtctgggacgcgtctgcgtcaccatcggtatgcccgcctgcaagtccggttcgaccagcggttggacatgcggcgtcgtcaccgccgacaaggtcaccgaaagcgtgaacgacaacggcgagctgctcgacgtgtacgacttccacttcagcgccttcctgctgagcggtgactcgggcggtgccatcgtgtccggccactactcgatcggcgtggattcgtacggcaacatgagctcctgcgatgacgcggccgatgacgatgcggtcgccggtggcttcgccatcgttgacagcaagtacaacgccgaggcgatgttcaagcacggcttcaacctgtccatcaacgtcggacagccgaagttcgccaagctcgccgccggccagatatccggtatggtcgatgccgccgccggcgcgaaggtcacggtgacggtggatggcaagagctacgtcgcgatcgtcgggaacgccggtgcctggacggttcgtctgccgaaggcgcttgcgcccggctcgcacaaggtgacggccgtggcctcgctgcagtccaagggctccgatttcgccacgaccggagccgccgcttcccggaagttcacgctgtagcggtagcgggtcttcgcggatgggcgccgtgatgcgtccgtaaggcggcgtacgtgcgggctgagccgcgagcgcgccgcccgccccgtcaattgcgggtgatgtctcgcgcggcgagatccgaaaatggttccacgccatacggccggtcggtgctctatgttccgaccggtcgtcacgctgcgcgggttttgcgtcactgtgcgcgggccgcgtcacgctgcgcgacccctcgcacagtgacgatatccccaaaacccagtgattgcaagggttttcgtcatgcgtcactcggtgcggggtcgcacagcgtgacgcggcccgcgcacagtgacgggtgcccgcgaaacatgcgtcgcatgagccggcgatgatgcttatatggatgtttatatagatgaaaggcggggcgcatcggccacccgctcatcgcccgaatggttgcgatgccatctttgtgatttatcggcgtgtcgcagttcatctgaagttaacatatcaatcgactcaatgcagggttgcaagtcgacaagacgcaagacctgagatacggataggactatccatatctcaggtctttttttttgcggcccggcaccggagacggatcaatggaagattcacggaaagggatgtgagatggcagcatcaactgcatcgcagatcatcgaagcgatcggtggcgcgggcaacgtcaagagcctgacgcactgcgcgactcgcctgcgcttcgaactcgtcgacgcgggcaaagtagaccagcaccggctggagaccatgaagggcgtgctgggagcggtgccgcagtccggcgaccgttaccaggtcgtcatcggcggcgcggtcgccacgatgtacgagaacatcatgcacctgcccgagatggcgggcgtcggcgctggcaagggcgcggtcgccggcgacaaggcgcagtccgatgccgacgtcaaagccgccgaacgcgccaaggtgcgcggcaaagtcgcgtggatggactcgttcttcgagtacctgtccgactcgttccgcccgatcctgggcgtgctgctcggcgcgtcgatcatcatcgccctgatcaacctgtgcatctccatcggtatcgtgccgggcgaggaagccaacaccagcctggtgttcatcaaggccatctggaagggcgtgttctacttcctgccgatcatgattgcctacaacgcctcgaagaagctcaaggtcgacccgtggctcggtggctccatcatggccgctctgatgaccccgcagttcgccgacctgatggactccgaaaagtggaagggcgtgaccacctgcgtcaagagcgccacgctgggcaccacctcctgctcgaccaaggtgtttggcattccgatgctgctcaacgactacagcggcaacgtgttcgtgccgctgctgatggccgccgtgctcgcgctcgtctaccacgggctcaagaagattatccctgacagcgtgcagatcgtgttcgtgccgttcttctcgatgatcatcgtcggcgccctcaccgccttcctcatcggcccgctcggcatcctcgccggcaactggctcggcgtcggcttggcctggctcaacggccacgccccgttcatcttcgcgatcctgatcccgatgctctacccgttcctcgtgccgctcggcctgcactggccgctcaacgccctgatgctgatgaacatccagtcccttggctacgacttcatccagggcccgatgggcgtgtggaacttcgcctgcttcggcgcgaccgccggcgtgctgttcatctccatccgcgacaagaacaaggacatgcgtcagacctcgctcggcgccctcgccgccggcctgctcggtggcgtgtccgagccgagcctgtacggcatccacctgcgctacaagctgatctacaagcgcatgctggtcggctgcttcgccggtggcgtcgtcatcgcggtgctcggctggctgttcccgtccgtcactgcagccggcgaatcggtgcgcggcgtgaccaccaacgcgttcgcgttcacctccctgctcaccatcccggtgttcagccagatgtgggtgtacgccgtctccatcgccgtgtcgttcatcgtctcgatggtgctgatcatcatgctcgattaccgtactcccgagcagaaggccgagatgaacgccgccagcgagtctgacgggaccgccgtcgagacggcgccggcggacgctgcaccggtggcgaccgccaccgcgaccgctactgccaccgccgttcgcaccaccacggtcggcgcccccgtcgcaggccatgtcgtgtcgctcgacgacgccggcgacccggtgttcgcctcccgcgcgctcggcgagggtgtgggcatccagcccactgattccaccgtggtcgcgccggtctccggcgtgctgcagaccgtggccgagaccggtcacgccttcggcctgaagaccgacgacggcatcgaagtgctggtgcacgtcggcatcgacacggtgaagatgaacggcgagggcttccacgttgccgtcagcgccaaccagcgcgtgaacgcgggcgacacgctggtgaccgtcgactttgataaggtcaaggaggcgggatacagcaccacgacactgatgacggtgctgaacaccgcggcgcttgccggcgtcaccccgaagacgggcgtggacgtgcaggcgggccaggaagtgctggacatccagcgctgaccgcatcaagagccaatcggcgcaacggccgagcggccggaaggaatgccgtgaaaattcttcgcgtgttcaacaacaacgtcgtactcgccaaggacggtgcccgcgaggtcatcgtcaccgggcgcggcctgggattccaggccaaacccggccagcgcgtcgacgacgcgaaaatcgtgcgcgtgttcgttccggccgacggccgagacccggaccatatcgcggaactgctgtccgagatacctccggagatcattcgactggtgacggacgccatgacggcgaccgggctcgcggaacaggccgaatcgcagcccacgcttgtcatggcgctcgccgaccacatcaccggtgcggtgcagagggcgcagcgccacgtcaacatcgcatatccgctgcaggcggaagtccagtcgctgtacgcgtccgagtacgcgcaggcctcgcggctggtcaatgaactcaaccgtcacctgaacggtgtcctgcccggcagcgaggccgtggcattggcgttgcatctggtcaacgccggcttcgcgaacggcgacctgtccgacacatacaagatgaccggcgtcatccagcagatgctgaccatcatcgagcagacctacggcgtctcgcttgatcagcacagcgtcaacgtcggccggttcatcacccatttgcgctacctgttcgtacgcatccatcagggcaagcagctcgacaaggaacccgagccgatcatcgcatcgatccggcagtcatatcccaaggccatgcagtgcgcgcagaccatcggcaccgtcgcctcgctgcgtctgggctccaacctcaccgaagatgaggtcgcatacctggcgttgcacgtcgcacgggtcgtcgcggatgcacgtaagcatgagtagcgctctcaaaacttgcagatagaggccatttttcatgaaaaatggcctctatctgcaagttttgagagcgtcggtttcgtatcaatcgcgaatcggcgggatgattcccgtcgctgacatgtcgggtgcgacctccggcacgcgcacgcacagcgcctcgcggtcgacggtgaatcgcagatgccgcgtgcggccgagcatgtcgccgtcgacctgggccagcaccggcttctccagcgtgatctccgcgctcactccctgaatctggtccatcgtcgaattcgtcgacagtgggttcgatccgggcttgccggtgatggtctggtgcactacatcgccaaacaggttcgcccagccgaaaatgccgcccgacgtgtcgatgatctcgaaatcgaggatgccatcgtcgtatgaggcgttgggcatcagcgagaacacggggatctgcccgcagttgccggccatgaacgtgcggaatgccacgccatgacgggtgtgcatgctgccgtccgtgctggtgatggtcacgtcgccccggtatttcggggtgaacaggttcttcacgccgccgacgaaatacgccagccagctgatgttcttcttcagctgcgggtcggtgtcgtcgatcatggcggcatcgaaaccgactccggcgatgatcaggaatgcgtggccgtgatcggccttcggatcgtccagcagcgagagacggccgacgtccacgtgccgcgacccgtgcgatgtggcgacggtgagcgccgcgtcgatgtcgtcgatcggaatacccatgttgcgggcgaacaggttgccggtgccgatcgggatgatgcccatggcatggccggtgccggacatggcgctcgcgaccgtgcggacagtgccgtcgccgccgaccgcgaccactacgtcggcgccgttggcgagcgcctccttggcgcatgcgcggccgtccttgtcgagctgcgtgtcgatgaattccacgtcggtcagtcccttgtcacggcagaactgttcgatgtgcgcgcgccgctgggcggcctgcggcttggacgggttcacgacgaagacgtaatgcacctgatcgtcgttgcgtttgacgagctgctgcgacaggcgcttgtggcggcgggcgcgaagggcgaacgtcacggcgacgatgaggacgatgacgccggcgatgacggctatggtgatgatggcggctagcggcatacctcccattgtgaacgttcaagtggcttgtaatggtttcgccctgccgaaattcgacgattcccacacgatattcacgggcgggggcatgcgtggggagaggaacgaagcggatgccacggcgaccggcctcggtcttgtgttgtcattgggaggtgcgtcgtcttgctcctgctggtgggagctggctcgcgtagcgagtctgacggtggcttggtgtgttggcgaccaccctcggtctcgctgcgcgcataaaaaaaccgcgtggcgggaggcacccgttggggcgcgtcccaccacgcggaggactgtggccagttcagctggccggtcagcgtatgcgatcggctcgcttcgacgtgcggaccgcggtgagaccggcggccagcaacgccatcatggcgacgaccaccgccaccacgggtgcgccggtctgcgacagctgctcgacggcgccggcgttgccgccattgccggctgcgttgttcgcgccgtcgtgccgttcatcgcccgtaccgggcttcgtctgaccaggctgctcgggcttgccgggcttgccgggctgcggcttggtcgaggtgccggcggcgacggtcagcggcagcgtcacggttgtgccgttggtcacggccttgacggtgagcgtcgccgcgccagccggcagcccggcgggaaccgcgacctgcaatgtggcggtgtcgccgtccttgacggccgcggagccgacctcggtgccgtcgatcgtggcgaccagcttggtctcggcgggcacgcccagcgaggtgagcgtgagcttcgagaactgcagatcgaacgaggtaccggccgtgaccttgccatcggccgggatgccggtgacggccaccgcgcgacggtcgtagcgcggcttgagcggcgagttcttggagatgtagtcgatccatgcgtcacggtcgaccagaccggtgtccttcgtgtccttgccggcggcgaaggcgcggaagttgtcgccgccctgcagcaggaacgagaaggagccgatgcggtactcgcgcttgaggtcgagcggcttgccgttcacggtcaccgaagtgatgtgattgccctgcgccgcgttcggatcataggtgtaggagacgttgtgcgacaggccgagctgcaggtacgggcgggagggcacgttgccgtcggcgtcggtctgccactgctgttcgagggcttccttgaactgggcgccggtgagcgtggtggtccacaggttgttgaggaacggcagcacggcgttggcctgggcataggtgatggtgccgtcggcggcgatcgtgcacttctcgttgtcgccggtcttgcagaattcggcgcgcaggccgccggggttcaccacgccgatttcggcgccgccgcggtcctcggacgacagtgagtcgagcagcgagtcggcgacgaggttacccatcgtggattcggaggcacggtcgtcgcgcgcgccgtccttgaaggcggtggtgatgtcggcggcgatggagccgactggcttgtcgccttcctcctggcccttggccacggcggcgtcgacgatgctcttcacgttcctgacggtgtcgtcgccggcggccgcgagctcgtcgtcgctcttgctggtgtcgaccgccacgttgccggacttgcggtaggtgacggtgccggtggccttgtcgtagtcgagcacgacctggccgatgttcgcggcgtagctgccggtctggatgaccgggcgtccgttgtgggccggatcggtgtacgagtacttcatgtgcgtgtgcgcggtgaagatcacgtcgaccgccgggtcggtgtcgtcgacgatcttcttgaacaccgggctggcggccttctgctcgtcgatggtcggcttggcggtggcgtcatcctcgttggaggcggcgccctcgtggtattcggccacgatcacgtcggcctcgccgttcgactcgtcgccgtcggtgagctgacgggccacgcggttcacggcctcgaccgggtcgccgaactcgatgcctttgatgccgccgggggagacgagcgtggaggtctcctgcgtgaccacgccgatcacaccgacccgcacgccattgacgttctggatgctgtattcctgaagcgccggcgtaccggtgcccttcttgtacacgttcgcaccgagataatcccactgcgcgttgcgcttgccgtcggtgccgatcacgcggccggtcaggtcgtcgtacccctggtcgaactcgtggttgccgaccgcggaggccttgagccccagcgcgttgagcacgtcgatggtcggctggtccttctgcgccgacgaattgaacagcgaggcgccgatgctgtcgccggccgccagcagcagcgacgaatccgggtgctcggcgcgcagctgctcgatggtagcggcgaacggcaccgtcaggttcttgccgatgcggccatggaaatcgttgaagttcagcagattcagcgtggccgtgccgccggtcgtgccggaggccgagattccgatgatcaccggatcatggtcggaggcgcggaactgatcggcctggtacaggttcttcgcattgtagttgtagcgcgagtattccagcgccacggattcgacggagttgatgttccagatgtccgcgccggtcacggaccgcatcgcagcctcgttggcgaagatgtggtcgagcgagccgacccctccgttcgtgttgccggattcgtccttgacggtgtaggcgtaggtgtacttgccggtcttttcgctcacctgctcgctcaggtcggtgtatccggccgccacgatcttctggatcggtttttcggcgtagtaggcgttgaagtcgccgacgaggaagaccttctccagcttgagatcgctcttcacctcatcggtgaacgcgagcagcgcgtcggcttgcgcttgacgggtgtagtcggcgttgccggagccgtcgccgggatcctggttgagcgcgttgctcgccgagcccttggacttgaagtggttggcgacgacgaggaacgcgtcggagtcggcggcgcccttggccttgaacgcctgggcgtcgggctggcggccgtgctcgtagccgttcttgccgttgaacgcgtcggagtcggtgaggattcgggttgcgccgacggtcgcgaccttggcgggcttgtagatgaacgcggtgcggatcacgtcctccacgtcgaggtcggggacggtctgcgggctgggcacgtaggcccaggtgccttcgccggcctgctcgttgagcgcgtcgaccagcgtggagagcgcgtagtcgcggcgctcgcccttgaatgatgccggcacggagctggcggccttggcagagttctcgatctcctccagcgagaccacgtcggcgccgaggttgttgatggccttgacgatcttcgcccgctggcgttccatgttggccttgtcccatgcgccgcgcacgtcgcagttcttcgcggtgaccgggttgccgtcacggtcggtgtaggcgttgctcgtggagcagccggtctcgtcggcggtggtggagaagtagttgagcacgttgaacgtggcgagcctgatatcgcctccgaccgcggccagatcgggcgtgtcggtgcgggtgctggtgaatgtcaccggctgcgcatcggcgttgtctccggtcaggcgttcggccggctggaagcgccacgcgctgttgcggtagtcgagcacgacgggcttggtgaacgtgaccttctcgcccacgcgcaccggctggtcgttcgacaggtacggcagcggcgtgtcggcgttgtccgggtacttcgtgtcgaggaagttgcggctggagccgtcgtccaggtacacgccctcggcttcgatgcggccgagttcggcctggtatgcggcaccggtttcggcgtcgcccttgaggcccttgacggtggggttgaggaacggcttgttcgatgccgcgagtccgatctcgccgtacttgttcgtgttgtacacgtccgaaacggtgtagtcgccctgcggcgcgatcagcatgctttccaggctttcgcgctcggtgtcggtcttcgggaacgccacggtggaggccttcggggcctcgaccttgtcggagagcttcgtgacggagctcgcgttgagctcggtcaggccgtagtattcgctgatcgtgccgttgaccttgacatagtcgccgatctgaagatccttgacgttcttcgaatcgtatacgaacaggccgtcggacgccttgtgctcggcgaggttgaccgcgcctccggttgccggcgtctggatggtgtagccgttgaatccgccgtccgggtaggctgcggtcaccacgcctgtggtggtcacggtcttgccgacgcacgggctggtgtcgctggtgccctggatctgcgcgatttcggcctcgccggtcgggcagtcgccgggcgtcgggtctggtttcggtgtcggctgggattcttcgccggtgccttcgggggtgatgtcggcgctcagcgtgaagtcggcgctgttgtcgtttgtgtccacgccgttcgtgcggttcagcgacttcacgtcggtgttgttcgtcggcgcggtggcagccgccttctcgaacgtgttggtgtcgccgtagccgagcgcgtcgatgatgtcggcgttcgccgtggtgtcgccgacggccgggctgagcttgcttgtcgtggcggcgaggaacagcgtgcctttggtgccgctggcgttgaggctggtggcggtggcgtccgcttgcggcagctcggcaccgtcggagccgttcgagcccgccttgatcagatagtggcccttggccttgatgacgccggtcaggtcggcggcggcgttgctcgcgcccgtgccgctcgccggacggtactgcagcgaggtgccgtcgagcgtcacgtcattgtcggtggtgttgtacagttcgatgaatttgttcttgtatgcggcgcccttgctgccgccggacagatacgcctcgttgatgacgacgcccgaccaggacgccgcggtcttttcctcggtcggctgcgcgtaggctgcggtgactggcgtcgccaccagcggcaccagcagcgctgctgagaccagcaggctttgaatgcgtgttgaaatacgcatggtactccttcttgctgaagattcccgagcgacgcgtcgcagggcgcgaacgttcgtcgcacgggagccgatgtgcaacgccagcgtaggaagcccgaagagacggcacatggagccgcaatgaacgtcatgtgaatccgctcggaactctgttctccggctccgtagtcggatgcggcgatgcaacggccgcgccggccgaggggagggagcagccgtgatgtgtgcggcgggccgttcaagggccggtcgaggggtattgtccgtgtcggcttacggcggtagtgttaggcacatgcttgatattcaattcattcgcgaacatgctgacattgtcaaggaatcccagcgcaagcgcggcgaatccgtcgaactagtcgacgaggtgctgcgctccgacgagacccgtcgcttcgcgctcaaggagttcgaggaggcccgcgcccagcagaaggagatcggcaagaaggttgccgccgcgcccgccgacgagaaggccgcgctgatcgcgcagaccaaggagctgtccgccaaggtcgccgaatacaaggccaccgcggacgccgccgccgaggaatacaccaccgccatgtggaagctgtcgaacgtcgtcgaacccgaggccccggaaggcggcgaggacgattacgttgtcgtcaagaaggtcggccagccccgcgacttcgcggccgaaggcttcgagccgaaagaccacctgaccctcggcaccggcgtggccggcatcgacatgcgccgcggcgtcaaggtcggcggctcccgcttctacttcctgcgcggcgcggtcgcccgcatgcagatcgccatgctgaccatggccgtcgatcaggccgagaagcacggcttcgtgctcgccatcaccccgacgctggtgcgtcccgaagtcatggccggcaccggcttcctcaactcccacgccgacgagatctaccgtctgcgcgagcctgacgagcagtacctggtcggcacctccgaggtggcgctcgccggcatgcacgagaacgagatcctcgacctgtccaacggcccgctgcgctactgcggctggagctcctgctaccgccgcgaggccggcgccgcaggcaaggatacgtccggcatcatccgcgtgcaccagttcgacaaggtggagatgttcgtctacaccaagcaggaggactcctacaaggagcaccagcacctgctgagcatggaggaggagatgctcgccaaggtcgaggtgccgtaccgcgtcatcgacaccgccgccggcgatctcggctcctccgcagctcgcaagttcgacaccgaggcgtggatcccgacccagggccgctaccgcgagctcacctccacctcgaactgcaccgagtaccaggcccgccgcctgaacatccgcgagcgcaacgaggacggttccacccgcgcggtctccacgctcaacggcacgctggccaccacgcgctggctcgtcgcgatcctggagaatcatcagcagaaggatggctccatcgagattccgcaggccatgcgcccctacatgggcggcaaggaagtcatcgagccgaccaagtgggaagcctgatcgcttcggcgtcgaccgcatccggtggcggagaacatccgcgccggatgtataattgaatcttgtgcgcttcatggcgcacataaggacaggtgtctgagcggcctaaagagacggtcttgaaaaccgttgtggtgcaagccaccgcgagttcgaatctcgccctgtccgcatatcggggttccgggtgcatcgcctggaaccctttttgtctattgccggcatatccgcggtccggcatctggggattgtgccacaccacgtcaatttgtggtcaaaatcgcattgtgtggcacagcgtttgccacacaatgcgatttcgacgcgtttttgagctggtatggcaacgaacaaaaaatcaggaaccgccattttccaatgatctgaggaattcgcccgaattgtcctgaatcggcgctgtaccacaccagcacaaaaaccgccaaaaatcgcattgtgtggtacaggggcggttgaaagcggcgtcgcgcggcgtgacgcgggcgcgccatgtcccattctttgtatatattgttaacaaaatccggcaatgttcgccggtgcggttcttactgaaaatcaagagaaggcaagggcaaccaatgatggtttcatccgctcgtcatcgtcgtgggcactcgcccgaacatcctccgacctgccaccgatcatggcggcgtcgcgcgacggccctgcttatcgccatggcgacactcatgtgcggcctgatcacatccggacgcctcgcgcgcgccgtggaaccggcgatcgccggcgtcacggcgagcggtgccgccgcggacggccatgctgcggccgccgcagtcgacggcgatccggcgacctactggcagtcacccgcagactcgtcgatgcaggactaccgccgcttcctcgacttcgacctgcacggcgcatacagcatctcgcagatcgacatcaccaacctcgccggatcgtactaccactacgaggtctatctgtccaaggacggcgccgactacggcaaggtggcctacaagagcgatgacgcccccgcgaccggtgccgccgacacgcatcccatcgatgccaccgaagccgcatacgcgcgcatcagcgtcagctacaactccgccgcccagcaggtcaacctcgccgaagtcgctttccacggcaccaaggtctccgacgagcaggccagccccaaggccatctccgtcaccgacttcgactcaagctcgtggggccgggagtgggcccgcgtagagaccgactccgactatgccgccgagaagaccgtcaccgaggtcagaaacctcgtcggccgcgtgatcggcgagcggtcggtcgacaagttcgacttccagctgcgcggcaaggccgacggcaaggacgtgttcgaaatctcagacgccggcgacgaccggatctccatccgcggcaacaacggcgtctcgctcgcgtccggcctcaattattatctgcgccactggtgcaaggtcgactacaacccgctgttcggctcccagctgtccatgccggagagcctgcctgcagtcggccggaaaatcctcaaatacacgaactacgagtaccggtacgcgctcaacttctgcacctactcgtacacgatggcgttctggaactgggatgattacgagccgttcctcgactgggcggcgatgaacggcgtgaacctcatgctcgacatcgtcggacaggaggaggtgctgcgcgagacgctcaccaaatacggctacagcgacgacgaggtgcgcgaatacctgtccgggccgggatactacgcatggttctacatgcagaacctgtactcggtcggaggccccctgcccgccgcatggttcgagcagcgcgtcgagctcggccgcaggatccacgaccgcatgcaggcgtacggcatcacgccggtcatccagggcttcggcggtcaggtgccggccgacttccaggagaagaacccgacgtcggtggccgcgtcgtccggcacatggtccggtttcgaccgcccgtacatgatcaagacgtatctgaccgacgccgacaaggcggccggcaaggaggactacttccagaaggtcggcgacacgttctacaaagctcaggagaacgtgttcggcaaggtgtcgaactactacgcggtcgatccgttccatgagggcggcacgattccagacggcttcgacatcgtcgacatctaccgcaccgtgcagcgcaagatgctcgaccatgacccggcggccgtgtgggtgatgcagcagtggcagtggggcatcgacgagacgaagctctccgggctcgcggacaagggccgggcgctcgtgctcgacctgcagagcgacctgcgctcgcaggccagcccgatggagaaccagggcgtgccgtgggtgtggaacatgttgcacaacttcggcggacgcatgggccttgacggagtgccggaggtgatctcccaggacatcacgaaagcctacaactccagcggttacatgcgcggcatcggcatcacgcccgaagccatcgacaattcgccgatcgtctacgagctgctgttcgacatgacttgggagcaggatccggtcgactatcgctcctggacgcaggagtatgccgagcgccggtacggcggagccgacgggacgatcgagaaggcgtgggacatcctgcttgacaccgcctacaagcacacggacggcgaatactatcagggtgcgagcgaatccatcatcaacgcacgcccgtccgacaacatcatcggctcggcgtccacgtggggccacagcgacatagattacgacaagcggcagttcgagaaggccgcggccctgttcgagcaggcgtatgactcgtacaaggactcggccggcttccgctacgattacgtcgacgtgatgcggcaggtgctggccaacagcttccaggaataccagccgctcgccgggcaggcgtacaagtcgggcgatctggagacgttccggacactgtcgtcccggatgctggacatcatcaaggcgcaggacaagctgctttccagctcggacgacttcctcgtgggcgcatggatcgacgatgcccgcacgatgctcgacggcgcggacgattggaccgccgacctgttcgagctcaacgcgcgtgcgctcgtcaccacgtggggtctgaacaagaacggctcgctcatcgactattccaaccgccagtgggccgggctgaccggcgactactactatcggcggtggaagacgtacatggacaaccggctgaacaaactggagcacggcaccgacttcaccgacccggactggttcgactacggctggcagtgggcgaaccgcaaaagcgacgaggacgggtatggtttcgcgaccgaagccgcggatgacgtcgaccagaaagcgctcggcaagatcatcctcgaccagtattcggtcaccgcgatggacgacgtcaccgacggtggcaccgcggtcgaacgcacgaacctggcgctgggacatgacgtgaccgacgaggacaccggcaccgtcgtcccggacgtgaccgacggcaacaccgacaccggctggacgcagacgggcaagaccgacgccacgctggtggtcgacctcgacggcacgtattcgatcaccggcgccggcatcaccctgcagcagatcgcggccgacttcccgctgcgctacgagatcgaggtctggaacggctcgggatgggtcgagataggccgcagcgaagccgatgccgtcagctccaagaacgaggtcgccgccgacatactcggctccaaggtgcgttggaagttgcattcgacgaacgggcgggacctgaccggcatctacgagctgtccgtctggggagccgcgcaaccgcagcccgagtacacgaacctggcgctcagcggcgccgcaagcgccggccccagcgagcggcccgcgtcgaacggcaacgacggcgacgacggtacgctgtgggtcggcaacgggtccgacccgaactggtatcggatcgacctggcgtcggcgcagcgtgtggaccgcgtgcggctcgtgttcgagacggccggccgcctgttccagttcagggtcgtcgcggggctcgctgacggtaccgagcggacactgatcgacgagacgcagaaccagggcgccctcgatcaggtgtatgcggcgaatcttggcgaggaggtcgaacacgtcaccgtggagttcacggggtcggtcggcggcaccgcatggccggcgctcgccgaactcgaactgctgcaggaggccggcgacaccatcgaaagcgtgaacatcgccacctcggccgccatcacgtcgtcgcccaccaaggacgcgcccgagaacgcaggcgcgctggtggacggcaaggcgaccgcatgggtgtcccgcgacggcgccacgccggcatggttccagctcgactacgccaaggcccgtgaggtcgacagcatacggctcaagttcgaggaaggccagcccgaccgcagcatgcagttcacgttgaaggtgatcgacgcgaacggcgacgaacatacggtcgccgaacgaaccgaagccgacctgagcaaacagcagggcatcgtgatggacgtgccggtcggcatgagcatcacacgcatccgcatggacatcgccgacgcccgcatcccctccagcggctcgcccgcatggccgctggtgtccgagatcgaggtctacgcgacgcccggcaacgtggctcgcgacgccaagacgacggcctcggacggctcgacgctcacggccgccgacctcgccaagctgacggacggagaccgcgacagcgcggccaccttgacggccacggctgacaagaccctgacattcacgctcgcgaaggccgcggacatcaacatgctcggcctgctggcctccggtaacagcgagccggtgcggttcaaggccgaataccgcgtggtgccgcaggacggcgacggtgcgggcgatggtgcagccgaccagtggaagacgctgaccgactattccggcaatgcgcagatgaagccggagatcgtggcccgccttgcacggcccgtctacaccgacgcggtacgcatcaccgtgctcaacgagaaccccgtcgccatcaacgagttgtacctgtatcaggcggatgcaggggcgtctctggaaagctacctctcgtccgtcgagaccgtgctcggcaagctcaccgtcggcgaatacgccggcaacgtcacccgggcggcgaagaccaagctcgaagtcgtgctggagcaggcgcgggcggcgctggacgccggactgacctcgcgcgaggccggccggtggacgacgaccgtcgaagacgcggtgtccgagttctaccgcaccggctacgtgtcgctcgaccgcaacgcgctgtatgtggcgatcgatgacgccgcgacgctgatcgcgtctctggacgcgcatggcctgcccgcgtcgtcggccgcattggccgaggcgagggcaagcgccaagcaggtctccgacgcctacggcacggtgacacaacaggatctcgataacgccgcggctgcgttgcggcggtcggccgacacggcgctcgcgcagcttgacgcgcaggagcgctatcaggtcgtgctggatgcggcggtcaagacgctggaggacgcgcagacggcgggcagcgtcggcgaatacgaggggcagcatccgcaaagcgccgcggacgctctgcgccaggccatcgacgacgccaaggccgcacacggtgcggccgccggagacgccgataaggtggacgccgcggcggacgcgctgcgccaggcgacgaccgcgttcaacgagtcaatcgtgcacatcgatgcggccgcgttggatgcggcgaagcgggcggcgaccggtctggtcgaatcgcagtacgacagggctgcgtgggcgacgatgcgcgaggctcttgccgccgccgtagccaccgacatggcgcacatctcccagtccgacgtggacgcccttgcggcacggctgaatgatgccatcgccgcgctgtccgacgcgcgtctggaccgtggcccgttgtccgacgccatcgtgtcggctcaggctctcagggaaggcgattacactgccgaatcgtggaaggcgttcgccgaggcgttggccgccgcgcaggaggagtgcggacggcgatccaccacgcagggcgatctggacaaggccgtaaaggccctgactcaggctcgcgacgggctggagcgcaagcagcccggcggcggtgaggaaccaggaggtggcgaggatcccgagcagcctggcagcggcgggcagaccgagcgtcccggtggcgtcaagcccggcgccggcggcaacgccgatacctccaaacctggcacggcgggcacggagaccctctcgaagacgggcgcccagacgctgctgctcgcagtgacggcgtgcatcatgcttgccgcgggattctccatcacgacggcgcgctcccgtcgccggtgaccggctgcggtatggccgggcacctgtatggggtgaccggccataccgacgtgctcgcgcacacatggtctcctgcatgaccatatcgcgccgccaaagacacccccgtaactccccgtcataaccccttagaaacatagtcccccaaatattttcccgccggcgctacacttcgaaatcacgggggggggggcttgttttgcgctttttgcgtaggatgaaccctcccgaagcaagaagtgaaggatgtatcatgtttcgggaaaatcgacgtttcgtcgtcaggttcaggcaacgattatcaatatcatccagcaaatatacaggcgatgccgccgccgcaaacgcggtgcacaaggcgcaatccccagtcatgcgcgtgggtgatgaggccccgctgaccgccgccaaggccggatccgccgctccggccgccaacatcgctctggccgcaacgcttgacatcgccaatggcgtcgacgtcatcctgaccggcgaagtcgatggtcacatgatcgattccatggccgatgccaagcccgtgctgaaaacctccacccccgacgcgccgaacacccccgaaccctcggaagtccctgtgaagtcggagacctacgccgcggtgacatccgtcgcgactgttttgggcgagacacggctgccaggcacgtcgccgatgatgacccgtgcacgccgcgaatcgtatatcggcggctgactcggccatccgcctgcctttcacgaggcagggcgggcgtcccgattcggaggatactgcggggaagacagtgcagtgaatcccggcgaacctccgtttcatgttcgtctctatcgatgagaagagtgctggagggcaccatcatgaaagacagagagtttgacgacgacgagattgactacctgcgttcactgcctgccgtgaacagcgtcggacggaaccgcatccgatacaccgaccagttccgcgaatactgcatgcagcggtatcgtgcgggggactcgccgacgggtatattccgcgacgtcgggcttgacccgtcgcttatcggatacaagcgcatcgaacggtgcatcgcgcgttggaagatgatggaaccggctgatgacgacgccgagccgatatccgctgacaaattcccgcgtaccggcaatccgctgattccgccggcgccgattcgcgcggccacgatccgcgagaatttcggcggatcggcggccaaggacctgcgcgatatgctcatagcgcagcagatccggtacatccacgagctgaccgcggagaacgacaggctccgcgaacacaaccggagactcgaatccggactgcgggaggatgagggcgagaccggcgagcagagcggggagacggaccagcccacgctctgacgccagctttcgcccccgctggcgggacgagccgtacagtagacagcccggtgggctgtctataggcgagtatgagccggcaggcgcatcagagagatgcggctgcaaggccgtccttgattgcagggcccggaggactgtcgcgtagcgactggggtggtcccggagcggttctcgccgcgccagaatcccgcgatatgatgcattgcatggttctttctgagaggaatgggccatgagatgcacgcgcatcactactatggtgcgtatgactgattccgtttccgccacgccaaccgcgtggaccaatccactgcgcgatccgcgcgatttgcgcctgccgcgcatcgcaggcccgtgcagcatcgtgatcttcggcgtgaccggcgatttgtcgcgcaagaaactgctgcccgcgatctatgacctcgccaaccgcggcctgttgccgccgagcttcggactgaccggcttcgcacgccgcgactggaccgaagaccatttcagggatttcgtccgcgagcacgtgcagcagcattgccgcaccccgttccgcgaatcgacgtggaagcagctcgcaaagggcatccgtttcgtgcaggggacgttcgatgactccgcggcgttcgcgcggttgagcgacacggtcgctgaactggaccgcgaccggggcacgcgcggcaaccatgccttctacatgtcggtgccgccgcgggcgttccccgtggtggcgcgtcagctcgccgactgcggactggcccgctcgtccgagggcgcatggcgacgcgtgatcatcgagaagccgttcggccacgatctggccagcgccaaggagctcgaccgtgtggtctccgaggtgttcgacccgtcgagcgtgttccgcatcgaccattatctcggcaaggaaaccgtgcagaacatgctggcgctgcgtttcgccaacgcgatgtacgagccgatctggaacgccaactacgtcgaccacgtgcagatcacgatggccgaggacatcggcgtggccggccgcgccggatactatgacggcatcggcgcagcccgcgacatcatccagaatcatctgctgcagctgctggccctgaccgccatggaggagccggtctcgttcaccgcctccgacctgaccgccgagaagacgaagatcctctccgcggtgcgtctgccgaaggacctcgccgcacacaccgctcgcggacagtacgccgccggctggcagggctcgcatgacgtcgtcggatacctggaggagaagggcattgacccggcgtctaccaccgagacctatgcggcgatccggcttgacatcgacacccgccgctgggccggtgtgccgttctatcttcgtaccggcaagcgtctcggcaagcgtgtcaccgagatcgccgtcgtgttcaaacgcgcgccgcacctgccgttcgagtcgaccgcgacacgcgagctcggcaagaacgcgatcgtgatccgcgtacagcccgacgagggcgtgacgatccgctttggctccaaggtgcctggcggcacggcgatggaggtacgtgacgtctcgatggacttcagctacggccgttcgttcacggagagctcgccggaggcatacgagcgactgattctcgacgtgctgctcggcgacccaccgctgttcccgaccaccgaagaggtcaacctgtcgtggaagatcctcgacccgatcgaggaattctggtccacgctcggtcagccgcagccgtatcgtgccggcacatgggggccgacggaggccgatgaaatgctcgcacgcgacggacgccactggaggatgccatgattatcgaaatgccgaacacccgcacccgcgagatatcgcagaagatcgacgagttgcacgaggagcgcggcgagtcggcgaccggccgcgtgctgacgctgctgatctccaccaccgaggacgagctggagcaggcgctggaactggccaacgccgccagccgcgagcacccgtgccgtgtcatcgccatctccccgcggcgtggaaatggcgtgcgcaagcctgtcgagggtgcgcccaagcccgccgaggacgcggatgcggcgtacgacaattccaatctggacgcccaggtgcgcttcggcgcggacgccggtgcgggtgagatcatcgtgctgcacccgcgtggtgggctggtccatcatcccgacacgttggtcatcccactgctcgtgcccgacgcgccggtcgtggcgtggtggccgaacgaggcgccggccaacccgtccaaggacctgctcggcgcgatggcgaggagtcgcatcaccgacgccatgcactcgtcgaacccctaccgcaccatcgaggatctgcgccgcaactggtcgccgaagaacgtggacatggcatggacgcgtctgacggtgtggcgtgcgatgctcgccaccatgctcgaccagccgccgcacctgccgatcagcacggtgaaggtctccggtccgaaggacttcctgcccatggatttgctggcggcctggctgcggctgaagctcaacgtgcccgtcatcatggaggaggtgcccggcgcggccgccgtgaccggcgtatacctgacgcgcgcggacgggacgctcagtctggagcggccggacgcgaaggagggcatcgccgtcatcagcacgcctggtcagtcgccgcaatccatcagtgtgcccacgaggacgcttgaggaatgcctgagcgaagagctgcgtcggctcgacccggatgaagtgtatgctgaagtcatcacccagggatggaatctgattcatcctgccgaataagcactgtcggaccggctgcaaggcgccggtccgacgacaagcggtgaatcaacgaatgaacggcgatgcgtgagcgtcacggaaccgtcacgcggcccatgcccgggcgcgggtttcggacgcgcgaagaccgaatcagaacgacaaaggagctgtaactgatgtcgcaaagaaaaaccgtaacatgcccgaaccccgatgttctggcgcaggctgtggccgtgcgcgtgctgaccacgatcaggaacctgctcgccgaaccggggcgcagccgcgtggatatagcgctgaccggcgggaccgacggcaatcgcgtgctgcgcgcgatcggcaccgacccgctggccgatgatctggacgcctcgcgcgtgcacatctggtggggcgacgagcggttcgtgcccgaggacagcgacgaccgcaacgccaagcaggcgcggcggttcctgaacatcctggtggagcgcgggctgatgccggaggagaacatccacgagatgcccgctgacacgcgcgatgccgcacggatcgccgcagccaccgacgaggagaacgatgcggtgctggccgatgcggccgccgcctaccaaaaggagctgatcgagcagctgggggaggagcccacgctggacatcgcgttgttcggcgtcggcccggatgcgcatttcgcgtcgctgtttcccggccggcctgaagtgctgatcgacgacccgcatgtgctggtcgccggcgtgcgcgattcgccgaagccgccgccgctgcgcgtgacgctcaccgttcccatgatcgcccgttcgcggcgcacgtgggtgttcgcgtccggggagcgcaaggcggatgcggtcgccgccgccttcgcccagccgcgcaatccgcaggccccgagctccttcgccgacggcgaggaactcatctggtacatcgaccaggacgccgccagcaagctgtgaggtttgtctcggctatcggatagttcggtatttgaagcttgttatttcggataacgagacaattcgaggattccgtggcacgaagcggcaaagatgcatggttttgccgtttcgtgccgcgtctcccgtcgtgaaataagatctgattggtgttcatcatggcatgggattgaggccggtctgtcaatcatggcgatgcggtccgacgatcatactggacgatccggtcgtattgcgaatttcgttcactccgcccgagggctcattgcgtgcccggtgcggtccggcatgcgaatgggatgcagcgcaagaagcgcgcagggttgcgacgccgatgcgtgtacaactcccgcgaaatggcataatgcgcgcgttgtacggggcggaatctgtacaacagccgttgaaaacgattgcgcccactgttgtacaccgacgaagttcctgaaaacgttggaattccaacgaaatgaggaatggcgtgcgaggtctctcgggacggtgtatgtacaactgctgcgtttgcctacaatgtgcgcgttgtacaggaggatatgcaccgccggcggtgactgggcgttgattggtgatgttgggatgcggctggttgcgattactgtgcgcgaaaaacgttgtgtgaaaaatgggaaccacacgatatgaatggtgtgccgatgaaacacgatggcgcagacgcccctaggggagcctgcgccatcattcgtatggttcgcgttcgatctgcgagcggtagggaggggcttgtggtgaggctcggtgtttgcttatgaccaggctcgccttcggcccctacgattgtggtctcgcttcgcgaggctcggtgtctcctcgcggctgtcaccggaaatcacgcaatgatttcctcacggccaggctcagcccacaacgtgtggaaagcaccgggcatgtcggtgcgctggtaggtgtgggcgccgaagtagtcgcgctggccctggatcagggcggcgggcaggcgcggggagcgcaggccgtcgaagtactccagcgaggaggcgaacaccggcaccgggatgccgaatgtaatcgcacgggagaccacgcgtcgccacgagcgctcggcggtctcgatcgcgtccttgaagtacggggcgaacagcagagacacgttggcttcgccgttctcgaacgcgtcggagatgcggttcaggaactttgcacggatgatgcagccaccgcgccagatgcgcgccaccgcagccagatcgatcttccagtcatacaccttggcggcttcggtgatctcgttgaagccctgggcgtacgcgacgatcttcgaagcgtacagcgcctcgcggatgtcattgatgaacgcgaccttgtcttcctcggccatcggcaccacgccggacggtccctcgaagtcctgcttctgggcttcggcgcgaagctcggcctgcccggacagtcctcgcgcgaacacggcctcggcgataccggtcaccggcacggccagatcaagcgccgactgcacggtccacgtgccggtgcccttcatgcccgcgtgatccacgatcacgtcgaccagcggcttgccggtcttcttgtcgacttgatgcagcacgtcggcggtgatctcgatcaggtaggactccagctcggtcttgttccactcctcgaacacgtcgccgatctcggccggcgtcataccgagcgcgcgacgcatcaggtcgtagctctcggagatgagctgcatgtcggagtattcgatgccgttgtgcaccatcttcacgaaatggccagcgccgttctcgccgatatgcgtcacgcacggctcaccctcggccttcgccgcgatggactcgaagatcggcttgagcgtcttccaggactcctcgctgccgccgggcatcatcgagggtccgagcagggcgccttcctcgccgccggacacgccgcagccgacgaagtgcagtccgcgggcgctgatcgccttctcgcggcggatcgtatcggggaagtgcgcgttgccggcgtcgacgatgatgtcgcccggctccatcagatcggccagctggtcgatcatcgcgtcggtcggctcgcccgccttgaccatgatgatcgcggtgcgcggcttcttcagcgacgccacgaattcctccatcgtcttcgcggggaagaactcgccctcgctgccatgctcggtgatgagtttctcggtacgcgaatagtgacggttgaacaccgccaccttgttgccgtgacgggcgagattgcgggcgaggctcgctcccattgcggccagtccgacgacaccgacgtttgcttcagcggtcatgctgtttccttccgacgaggatagggttgtgttcgttaccagtgtatgaagaacgctctacgtgggtggcgtccgtttcaccgtcggcatgggaatgtcgccgcgccggtcgtgccttgcctcatacgatgcggcggtcggctgcccagcgggtcagttcagtgcggttggacagctgcaatttgcgcagcacgtttgacatgtgggtctccacggtcttgatggagatgaacaattcggcggcgacctccttgtatgtgtatccgcgggcgatcaggcgcatgacctcctgctcgcggcctgacagcaggtccagctcctcgtcgcggccccgtgcgccgccggccccgtccatcggtgccccctggaaggcggacagcacgaatccggccagtttcggcgagaacaccgcatacccttcgtgcacctgcttgatggatgagatcagatcgtcgccggtgatggttttggtaacgtatccgcgtgcgccggcacgaatcaccgagccgacgtcctgcggcgaatccgacaccgacagcgccaggaacgcggaagcgggggagagcggctgcgatttggcgaggatctccgcgcctcctcctccctcgccgccgggtacgtgcacgtcgagcagcaccacgtccggtctgatgtcggcgatcatcgcgatcgagccttccacgtcggcggcctgcccgacgatgtggaagtacggctgcagcgtggcgatgacaccggcgcggaacatctcatggtcgtcgacgacggccacgcgaatcggcgtcgccgcagcttcgcggggagtggtatccgtatcagtggctctgccggactccacgtcgttgcactccacgctgccgaactcaccggccgccccttgcctcacatccgctcctgatgtcggtccgatgcttgtgctgtctgcctgacccatatgcttcacctgtcgaatcatgtttccttctgcgtgcgtgtgtatgatgccgcgccggatggcggtcgtccatgctgcccgccggcgttcgtggcatcgccccgctggttcggttgccgtccgcctgagatcggcatgtgcatgcgcacctcggtgccccaatgcggcctcgatacgatctccactgtaccgccccgtcgtcggatccgcccgatgatcgactcgcggatgccgagccggccctcgggaatcgcgttcacgtcgaacccatcgccatgatcgcgcacgaagacctcaaccttgtcggcgccggcctcgcaatacacggagatgggctcgccgccatgcgtcacggcgttgatgagcgcctgctgcgtggcatcgagcagcgcgtcggtctgggcactgggcctcgcgtcgcccacggtcaccacttcgatcggtttgccgtgctcgtcttccgtctgcgcggcgatggccttcagcccggcgctgaccgaacggtccgatgtggtgcgttcctgatacagccattcgcgcagttcgcgctcctgctgccgggcgagcgagaacacggtctgcgggtcgtcgctgtgcagctggatcagggcgagcgtctgcagcacgccatcgtgcaggtgcgcggtcatgtcggcacgttcctcttcacgctccttgagtgcgcgctcggtggatagggagcggatgagcgtgctcacccaaggcacgatcgccagagccgtgccggccagcagtacgaacccgccgatgatgatgcggcgaggggacgcgccccaccccggaaccgtgctggtgaacacgaagatcgcatagccgacgaacagaagcacgatgccgccaagcatcgatggcagtttgccctcgtccgcgtcgaaccgcgaccatgccagtccgaggccgccgacggcgacggccagcggcacgatcagctcccgtccgccggcaaacgacagcagcacgcttatggcgatgaacaccagaccggccaatgccaccagtgaaggtttcggggcgcggcgcagagccgccgccagtccctccgaggagtcgtcggcgtcgctgcgtccactgtcacccgcggtgccggcgtatgccgcattaccgcgggagagcggctcggcgaaacctgtcgaggccgcatccgacatggcctgcgcggcggcgacgggatcgccgaccggcatgaacatccacaggaacacgtatgcgatgacgccggccccgaacgcgagagcggccgcggcgaacgcgagtcgcaccagccatacgggcgctcccagatgtaggctcacgccacggcacacgccgacgaggacgcgcccgttccgcgggcgcatcaatggtaggctcggcgtggcggacggcggttgggcgcggcgggcctgccattgcgtccgacggggcgcgtgcggctgccggtacgggttgttcggctgggtcatggttccattgtgcgcctccggggaagacgacatggggcataacgccccggttcagggaacaatcagggtgtcccccgatgcgtgcggcggccggttgctgctgtaatggaagcatgaacgatacaacgtatgcctatgacgcgggtggcgccgccggccccggcacgaatggttcggattcgtacggttcaaatccgtacggttctcctgcgcccggaccccagccgaagccgaagcggcagagcgaccggttcttctcgtggatccgcggcagcgcgatggagcgcggcgacgaccggtggatcgccggcgtgtgcagcgccatcgcgcagcgcgtgggatggagcccgactctggtgcgggcactggtgctggcgagcgtggtgctatgcggattcggtttggcgctgtacgccatcgcatgggcgctgctgcccgatgcgcgggatggccgtatcctcggcgaggagctgatcgacgggcgctgggattggaacatgcttggcgtgataatcatgatgatgctggcggtcgccgtccccggtgccggtctcgcggcggccctgtgcgcggcgctggtgctgtgggccctggtgcagaacgccaaccggcggcatggcggatacgggtcgggcagcggcgtcagcgatgccagcggtaccggcgattctgagaacggctcataccggcgcggatggccggcctcgtcatacgcctatgacggtgcggacacgggagagcaggcggccgatgccggcacggctggctcatcagggcccaccgcgccggaaaccgcgggaagtgcagcggagtcctccgtagcgtcggtgcgtcagccgttccagcagcccgctccgggatacggcttcggccagccccataccgccgatcggcccgcacgtcctcccatgccgtaccagtcgtctccgtatcgcccatcggcggggcctcttccaccgaaatacgagcgccgcaagccggccggtttcgccatcgtcatcggcatgatcgggctgatgctcgtctccggtgcggttctgatgctggcaaacgacaactcatccatcgaatcgatgacccgtgtgctcacgctgtggattggcggcgtctgcctggctctgggtgctgtcataacggtgcttggcctgatgggacgccgctccggaggcctgattccgctcgcctggaccgccgcgttcgtcgcggtctgcgtactgggcgtcaacgtcgcttacagctatacggtggatgccatgcagtccgaaggcggcacgctggtcaatgttcgcggagtcacgaaatatggcgccaccgatcagcagatcgcccgattgcaacagggcgtgcggttcgtcggcacgaattacggcgacgaccgcgtcagcattgatctgacgcgagatggcgtgcccggcatcagcccccacaaggtgacggatgtcgacggaaaggtcaggcaatcgacgtgtccggtcggggacctgcgcatctcggcctatcgggcccgggtgattctgactttgccgcaaggatgcagctttgcgttcggcaagcgcagcgacgggtatcggctcgtcggttctatcggaggccggtatacgatcaccagaaaccagtggggatacgatttcctgcgtctggacaacacgttctcgggccgttccggtgagaagccggcgtgcgacggcggcgcatccaacctcgattacagcaccattcccgaaggcgggcccgaactgatcatcaacgtgccgtacaccatcgaggggaaagtggccgtccgttatgtcgatgacagcggcggatgctcatccgatgacgccctgtgagcactgcgggcgaatgatacaaggagcacatcatgaatgacgatcacgatatgacacggcatcttccgaatgccgaggcgatgcctgcggatttcgagcagaccgaggctttgccgacactggtcgacggcgtgtccgaacaggcttctgccgtcacacaggcgttgccggtcgagccgacacagacgctgccggttgccgagacagaggcgatgccggtagaaaaggtcgcggtgccgcagaccgagaccaagtcgttgccggttgactccgcgtcgaccgagaagttgtctgccgaaccacttgcggccggggcggtttcggacgaatcggcggcccccgtggatgacggccagaccgagaccgagcctgccgccgacgcattcgggagtcccgccgccgcttccgatcagcgaaccggcgatgttccggccggagccacaacggccggcgatgttcctgacaaagggcagcctcttgccgccgcgccatccacaggcgcgggcgccacgcaacagcctgatgccgccacggccttcgccgcgggtgatacagagcagcccggtccggcacctcagcagattccgctgtacagcacgcagcccccgcgagagcatgacggatacggaccgaaccgcccggatgcgggtcctgcatacgccgctccggccggtccctgggcccagccgggcgcgggctcaaattacgtgcaagtgccgcgggacgtgccgatgcgtccggtcatccgcaagacagggccgagcgccgccacactgacattgggtgtgttcatgctgctggtcggcgcggtggcgatcctgttcggagtgaggttccccaatggcgtgctcgcatggttcgatatggatccccgcgtgatgttcgccatcgggtgcgcggtggtcggcggggcactgatcctgatcgccatcatctggtctctggcaaagatagcgcgcaacgcacgaacgccccatgacgagtgacatatcgatcggtgccttgccggtgccctgccggcaaggcaccgattcccgcgtcagccctgtgcggcctccgcttcggcgagatcggcgaaacctgcgagggcgacggtgtgggcgatcgtctcctcggtcaggttccgacccttccggagtagatcgtcgacgaaacgccggtacagggccatcgtgcgttccgagtaggtgccgagctccccgcgcagatatgtttcgaacgacgtggattgcgcggtgtcctccgcggtgcgcagcacgcgcatggcccggccgagtttcgggtagcgggcgcggaagtcctcggcccacgccacctgcgtcgcgatgacatgctcctgcgtcgcgatacgttcgtcgctcaaccggggtatgtacggttcgatgttgtcatggaaatcctgcggtgccgtggactccatcatgcgaccgtacttctccgtgaccagattgcgcccgacgcgctcggcttcgaccagatcggccagataactgtccagcagcggatcgggccatgtcatgaactggctcgtgcgcatctgccggaacaccggccaattgccttggcaggcggcccgcccgccctcgttgttcgtgcgctggaactgatcccattcatgacgcactatccgctcgatcagctggtcgctcatccgccgtctctttcccgttgtccgttatcgtcgttgccgccgtcatctcccgtgccggtcacgccctgtcacagggaatgcagacaagccgcgtcgctggcgatgtgctcctcgacatatggccgttgccactccaggaacgtctcgtcgctgccggttagtccttctcggcgcagctcggccacgacctcggcgcagacgtgctcgatggtctgggatatcttctcggcgaccggtgccgaccccttgccgccctcgccgaaaccggcaccgccatagcaggcggcggagctcagccgcagcagcgtctccagctgcccgcacacatcggcgagcctcgtcgccatgcgggacgacagccgccgaagcgcggcgaaccgccacttgtaatacggcaggtatcccacggtgatcggattgttgagcaggaacaccagtgatgccgccgcctgcacgaactcgccgatcgacagccaggcggccgcaccgtcgccgcgcgcgagcatgcgcggcacattgtattgcccggcctgcgccatcatgcccagacgcttggatatcagcgccagccgcacgtcctccggcatggtcttgaacccctgccgggtgtcgaggaacttgcccaacgggtcggcgaacacctcgccgttggtggcggcggcaagcgtcgcctcatccagcatcagccactcgtgcgggttgttggtgcttggcgcctgacggtatccggtgatcgactcgaagaaatcgccgatgcggaacactccgtcgcgcctgcctgcaccctgagccctggcggtggactcgcgcgggccgtatcccatgaacgattgggggagcgcctcgtaatcggcctgaaggcgctcgccgatcgccgcataatcctcgtcggtgagccatagacagaagcgtgggccgaaatcatggtcgcgcgagagatcgtcatcgaacccgtagcattccgatccgtggcccaccagtcccgccgcgatgcgcccctgatattccgggtatttgtcggcgatgagtggtttgccataggcgttccagcattcgcgtgccagcttgaggccgcatatgggtgaggtgccggtgtgtgaggcggtagcggacggaacggcggcggatggggtgccggcgggtgctgcgccgggcgtgccggaaccattcccacctgcgctcgcatcctgtgaaacatcctgtgaaacattcgcgggggcatgctcggaggcctcgtgttcggcctgccgcaggttgttctcggtgatgcggtaataatcagtgtccttgccgtagcattcctcgatgacctgcagggcctggcagtacaggttcaccgcctgcccgtaatcatgctggtggaaacgcacctgcgcgtagccggccagcgccgaagcgtaatgggcgctgtgctcaagatgaccgttgcggtagatctccaacgccttcgccgcatgccagctcgcggcggacagcttgtcttcggcgagcagcgtcaacgccagattcgtgtgcgtcgaggccacgtcgaggtcggtttcggcatccgggctcgacgattccagtatgcgcagggcttcgcccagctccacctcggcctgatgcgttttcccggtctcgctgtacagcatcgacaggttgttgtgcagggcggcgagtcgccggtcgctgggggcgagcgtgcgctcgctggacgcctgcgcctgcttgtacagatcctcggactggtcgtactggccggccgcccgcatggcggtggccgcattgatcagggtggtcgtccatgcctcggtgcccgtgatgcccatacgggtcgcgagctccagcgcccgttgcacgatccactggttctccttgtgtcggccttgcgagcggtagaaccccatcgtctcgttcagcacggtgagcagcccggcgtcatcgccggcgttctccgcgtcgatcatggcctgctccaggtacggccctgccttggcagcggcgtgcgcgtcgaagatcgcgtcgagcccggcgaggaaccgttgcgtgtcaaaaggctgctcggaaggtcggggctcgtccccggcttggtccggtgccgcgtcatcgtcgaacgcggccatcagcttcgccatcagtgcatcatcgttcatgtcatctccttgccatgaaaccggtttctaccagtctaggaagccttggtgatgacgttttcggcgtgtgatgtgagttatataacaaaccccgctctcaaaactcgcagatataccggtgattcagcgaaattccacttgtatctgcgagttttgagagctatatcccgcgaaactcacaccgtgatctcgcgcatacgctccagcgcgtcggtgtgcgtctcgtgacgcatggagtatatggtcagcagcgccaccgcgatgaccgccaacggcacgccgcccaatgcggtgaagtggtagttcatgcctgacaagttcagcatgccgccgccgaccatcgagccgaccgcgttgccgaagttgaacgccacctgcacggccgcgccggccagcagctcgccgccgcccttgccggattcggtcatcagcagctgctgtggggcggagatgaagaacaggccgaacgcgatccagaacgtgaagatggcggcgctcacatggttgccgggcaccaggaacaccagcagcagaccgacgccggagatcgcctgcccgagggctgcggttcccgcgtgacgccagttgtcggtgatacgcccgccgatgatgccgccgaccaccatgccgaatccggcgagcatcatcaggaacggcaccatgtcgctgtcgtatccgccggtcttctgcagccacggcgacacgtagctccaccagcagaacacgccggcgttgccggtgaacaccgcgcccagaatcagccacggtccaggctttcggaggaacctgaactggccggccagaccgacgtccttcaccggcgcgatggcgggaacccaggcaagcgcgaggaacacggtcatcgcggcccaggcgctgagcacgatgaacgcaagcctccatgacaggaactccgacatcagcgtgccggccggcacgccgatcatgttggcgacggtctgaccggtgaccatggcggagacggcctgcgcctccttgcccttgtcggccacggtcttggcgatcagcgtggcagtgccgaagaacgcgccgtgaggcagtcccgagatgaaacgggcagccagcagcatgggcgcattgacggagaacgccgacaggacgttgccgacgaaggcgatcaccatgaacatgatgatcagctgcttcggcgggatcttgcgcccgaacaccaggatcagcgtgccgatgcacacgccgatcgcataggcggaaatgaaatggccggcggtcgggatatcgacgtgcatcgcctcggcggtctggggcaggatgcccatcatcacgaattcggccgcgccgaggatgaacgcgccggaagccaaggcaagcaggcttttcttcatggttccctcttcatcacatctcgcgggcgtgcccgcgcgtgggtgtcgtttgttgtgattgtcgctgatggttgtggtggtcccgcagtgtgaaactgcgggagctgccaagccaccagtaagaagaaggccagaccgctgatgcgatctggccttcatgttgtcgggctggcgggatttgaacccgcggcctcttcgtcccgaacgaagcgcgctaccaagctgcgctacagcccgttttggcaacgcaggctataatacaacgaaatcccggacaagccaaaccggcgtggcgtggcatcctgaaaaccgcggaatatcaacggactctcggcgtgtatcgccatctcattacactgtgacattatgagtcagacgcaagaaacccccgaatccctgaacgacgacgagacggcgcccgctgttcccgtcatgaccacggtcgaacgtgccgagatgctgctgcgacaggacgcagccatccgcgaccgcatcggcgccggcgcaactttggacgaggccgtcgatccctccaacaaggagttcggcccgctcgcgcaccccgagcaggtgcagatgcgcgtcgccaagcgcgcgatgatgcttgaggccggcatgcagccctacccggtgcacctcgacgtgaccgacaccatcgaggccgtgcgcgccaagtatgacggcaagcttgaagccggtcaggagaccgaggacgtggtcggcatcgccgggcgcgtcctgtttctgcgcaacggcggcggcctgtgcttcgtgcagctgtcggccggcgacggcacgaagatccagggcatgatctccaagaaggagatcggcgctgactcgctcaagcagttcaagcagctcgtggacctcggcgaccacctgtacctgcgcggccgcgtgatcgcgtccaagaccggcgagctgtcggtgttcgccaccgaatgggccatcgcgtccaaggcgctgcagccgctgcccgccctgcacaaggacctgaacgacgacacgcgcacgcgcaagccgtacatcggcatgatcgccgatgagaaggtgcgcaacatggtgcgcaaccggtccaaggccgtcgcctcgctgcgccgcacgttcgatgaccacgacttcatcgaggtcgagacgccgatgctgcagactatccacggcggtgccgccgcccgtccgttcaccacgcacatgaacgccttcgacctggacctttatctgcgcatcgcgccggaactgttcctcaagcgctgcctcgtgggcggcatcgaccgcgtgttcgagatcaaccgcgacttccgcaacgagggcgtcgacgccacgcacgcccccgagttcacgatggtcgaggcctaccaggcgtacggcacctacgacaccatcggtcagctggtcaaggagctcgtgcagaagaccgcgatggacgtgttcggctcccataaggtcacgctgctcgacggcaccgaatacgatttcggcggcaactggaagaccatcagcatgtatgattcgctctccgaggcgctcggcgaagagatcgtgccgaacggcgggccggacaaccccggcacttccgtggagcatctgggcgagatcgccgacaagctcggcgtggagcgtgacgacgttgagaaccacggcaagctcgtcgagcacctgtgggagcacttctacgaggacaagctatacgagccgaccttcgtgcgcgacttcccggtcgagacctccccgctggtcaagggccaccgcaacaaggccggcgtggtggagaagtgggacctctacgtgcgcggcttcgagctggccaccggctactccgagctcaacgacccgatcgtgcagcgcgagcgtttcgtggcccaggccaaggacgcgctggccggcgacgaggaggcctgcgacatcgacgaggacttcttggaggccctcggcgtgggcatgcccccggcgggcggcatgggcatgggcatcgaccgactgctcatcgccctgaccggtgccacgatccgcgagaccatcaccttccctctggtcaagccgctggcgttgcagtaaacgtgcggcgggccgctgccggccttgcgtgcggactgcgggcgatgaccgattgaaacgatatggcggggctccacgcgtgtgtgcgtggagccccgcctgtttatgtatcgatgctgtgccgacagcccccgccagcggggcgtgctgatgtcggcggatgatcatgacgacatatccacggaatccgtgaaaggcacgtacactggactacatgactgtgaaactgtggatatccggcgcacgcccgaaaaccttgacgacctccctgtcctccgtggcggtgggcgcatgctgcgcgtatccggtgatcgtgggcgatctcaactgcgcgcagacccggtccgacacgtcgcaatgcgcggcggtcaccgccgatgcgcaggcgatgatgtctcggttctggctcgtcacgctgctgtgcgtgtgcgtgggcgtgttactgcagatcgcggtgaactacgccaatgactattccgatggcatccgcggtgtcgatgagggccgcggtggcagtgagaagaagaccaagaagcccatgcggctgaccgcgtccggcctggttccggcgaagcatgtgctcgtcgccgccgtggtgagcgctctgctggcctgcgtgtgcggcctcgtcgccgtcgtcctgtcacaggcgtggtggctgctgctggtcggcgtgctttgcctgctggccggctggttctacaccggaggcaagcatccgtacggatatgcgggattcggcgaactctcggtgttcctgttcttcggtttggccgccgtgcttggcacgcagtatgtgctgagcggttcggtcagcgtgctcggcgtgttgtgcgcggtcgtcgcggggctgttgtcatgccagatactgatggtgaacaacctgcgtgacatcaacgaggatcgccggcatggcaagcgcacactcgcagtgcgcatgggggagcgcggcgcccgcgtgatgctgggcgtctgctgcgtcgtcgcatgggcgatcggagtgtgggtggtgatgctgctgtggacgccgtggggcggcatcctcatgttgtccggcatcggcgtgccgtggcgcatggtgaccagcacgggccgtaaggaattccgcaaagcgctgtcggacgcctgcttccagcccccgttcttcgccgtcatcctgctgatttcgctgatggtgtgagtattcctgcgcaagcgctcggcgaaacggtggacaaaggctcgaatttggccgggctgagcggtagactgcgagttatgacttacaaactagtactgctccgtcacggacagagcgcatggaacaagaccaatcagttcaccggctgggtggacgtcccgctgaccgagcagggcgaagccgaagccaagcgtggtggcgagctgctcaaggagaagaacgtcctgccggacatcgtcttcacctccctgctgcgtcgtgccatcaacaccgccaacatcgcactggatgccgccgatcgcctgtggattccggttcagcgtgactggcgtctcaacgagcgtcactacggcgctctgcagggcaagaacaagaccgagattcgtcaggagtacggtgacgagaagtcgtttcctgccgtacttcttccccgacacgttctacgagggcaacgacccgagcatcgaaggtctcgacaactggcgtaaggcccgtcgtgccatcctgcgttccccgatttcgcgtatgggctacggcggatacctgtcgctggccgcgaagttcccgaagttcgtcgataccgtcacccacatcgccgacgagttccgcgacatccatgaccgtaccggtggagtcgccgccgaaggcgagctcaacgtggcgattctgaactcgtggggcaagatgcgttcgtggatggcgttcacggtcgcccacgcgctgccgaacaagcagacgtattcgtattacggcattctggagtcgctgtcgggcatgcgcgtgaacgtgcggttcatcagcttcgatgatgtgctggagcatggcgtcgccgacgacatcgacgtgatcatcaacggtggcccggtcgacaccgcgttcaccggtggagacgtgtggaagaacccgaagctgaccgagaccctgcgcgcctgggtgcgcggcggcggagcattcgtcggcgtcggagagcccagttcgctggcccgtttccaggctggtcgtttcttccagctggccgacgtgctgggcgtggacgaggaacgctaccagacgctgtcggtggacaagtacttcccaaccgtcacgccggagcacttcatcaccgccgacgtgcatgtcgatcccgccgcccgcgaagcgtgggagaaggccggataccgcatcccgctgtcgggctgcggcggtggccagggcatcaagccgcttggcggcatcgacttcggcgagccgatcgcgaacacgttcccggtcaacgaggacgtgacgctgctgcgtgccgacggcggtcaggtgcagctcgcggtcaacgagtacggcaagggccgcggcgtatacgtctccggtctgccctactcggccgcgaacgcccgtctgctggagcgaatcctgttctgggcctcccacaacgaggacaagtacacggcatacagctccaccaaccccgagtgcgaggtcgcggtgttccccgatgccggccagtactgcgtgatcaacaacaccgaccgtccgcagtccacggatgtggctctgcctgacggttcgatcgagcatttcgacctcgaccagagcgccatcgcttggcgcaacctctgatctgtgcagtccccgtccgtcccgcggcatgatgcgggacggacggggacagatggatcggacagcaagacttgaggatcagggcttccgtgctttccttctccttcctccggaggccctgacactcagacccatcggtggggcaaggcatgacgatatgccttgccccacatattcgtcaaggatgtgcgaaccgcgcatatccgctgttacgtaaggacacaacacatgacagtgcaggatacagcacagcagacacctgccgaccgcttccgcgtcggcatcgacatcggcggcaccaagatcgaggccgttctcgtcgatccgcaggataatgttcgcaacgacgtgcgcattcccgcacgacgcggcaacgcgcaggtcatcgacgacgtcgtatcgatcacccatgaggtggccggcgatctgttcgatcaggtcgccacggtcggcatcggcatccccggacaggtcaatccagaaaccggtcgtgtcgacaacgtcgtcaacctcgacatcgatacgctggagcttggtgccgaagcgggcaagcgcctcggtattcccgtgcacgtcgagaacgacgtcaatgcggccgcggtcggcgccgcgcgtatggtcggcggatcccaccccgaaggaaccatcgtgttcctcaacttcggcaccggactcgccgcgggcatcgtcgtcgacggcgtcgtccagcacggtttcagcggggccgccggcgagatcggccatatcccgatcgacccgaaccgcttcccgtgcccctgcgggcagagcggctgtcttgagaccgtgtgctccggagcgtcggtcggccgccactggccggtcgaaggcaagcctccgatgccggatctcatcgagtgcgcccgtcgcggcgagcctgacgcccagcgcatactcgtcatggtcacccacgccatcgtcgacgccgtgcagatcgtcgcacaatcctatgacccgcgcatgattatcttcggcggtggcatggcgaagaccggccagccgctcatcgacgtcaccctggacgaactgcgcgtgcgcgagcgcacctgcccgttcctgacgggcctgcatctcggcgaacgcatcaagcttgcgcaactcgaccagccggtcggagcgctgggcgccgcgtgggccgcgccggaggcctgataggcacaccggtaccggcgacggagtttccaaaaccatccgggccgcacggccggatgtgagcagaacatgaatcgagggccgctccctgaacgggggagcggccctcgattcatatcgcaaggacctttcggtggttctctcagtgaccgttctcgatgtaatgatgaaccacgtcgatggcggatccgcgcagcgcgatatccgaacccacctggcaccgtcgcacggaggtatgcttgtggaacttcgacgacgacaccatgtccacacggcgctgcgtcgcctccaggaatgccgcgttcacgatgtccggcgggccgtacacgcatatgtcgttgatgtcgagcaggccgattggcatggcgagcgccgcggcgagctgctcgccgcaggatcggatgatgtccagctgctcctcgggcgtcgacgcgcggcgaatccgctcgcgaattaccggcgatgtgaccatcgtctccaggcacccgcgcttgccgcacggacacaacacccccgactccgggtcgagggagatatgcccgatctcgcctccggcatggttctgcccgatcacagtcacatcgtcgatcagcgtcgcggcaccgatgccacggtcgatcttgatgaacagcatgctcttgtcgccatgcccgaagaatcgctccgcgagcatggagcagacgacgtcgttgctgatggtgacggggaatccgaaacgacgttccagcatgcctctcagatcaaggtcccgccatcccaacaccgtcgattcgcgaatgacaccgtcctcgacgacaccagtcgccgctatgccgatgccgatgatcgtgtcggcgtcgatgtcggtgcgcagctggtcgaccagctgcacgatcatgtccgcgttgatgtcgttatccggtccgagcgccatttccatgcgctgctgtggcgtgcccagcaggtcggtcacggctccctgcaccagatgctcctgggacaggtcgacgctgatgatgtgcagacgcgacgtgtcgatgctcagcagcgtgccgcgcttgcccttgccggaggcgttgacgtcgaaaccgctctcgcagatcagcccttcgtcgagcatgctgttggcgactcctgatatcgccacgcgcgagagtccggtctgccgcccgaggtcggcgcgggatagctgcccgttcggaaatagcagcccgaacaccagggaacggttgttgcggcgcacgtcggcgggacttgccttcgtcgtcctgccgggcgtgtgcagggggaacgagatggtgttggcgtacgaggtcattggttcagtcgtttcttgtcagagcgctcatgattcggatcatgcgagctgcggtgtggtcatgttcaaatccacagtctttatattatagcaatagaaaaggggattcaggaactataaacgccgaagaatggcggtttgtcatttatgtaactataattaacaaataacggtgcgtatgcgccaacagctgctgcgtcgcagtggcacagcagcttcagatagggggtcgttgtggcggtgaagaccggcggcaacctgcggcacaacaaggaaaagagggttccacatgactgacattgatccgaaactggcggccatcgtcgatcagttcgccatcgacggcgacgtcaagggcatcaccgcatacggtgacggccacatcaacgtcaccttcctgatcaacacggatcagcaccggtacatcctgcagaagatgaacacggacatcttcccggacaccgtgcacctgatgcgcaacatcgaactcgtcaccgcctacctgcgctccaagaaccaggagacgctcgacatcgtccccaccaaggacggtgcgagctacatcgaaaacgaggaggtggacggcgcctggaggatatacaagttcatcgaaggcaccatctcctacaacctcgtccccaacgccgacgtgttccgcgagtccggcgccgcgttcggcgagttccagaacttcctggccggcttcgacgcctcccagctgaccgagaccatcgcccacttccacgacacgccgagccgcttccgcgacttcaaggctgcgctggaagccgacaagatgggccgcgccgaaacctgcaagccggaggtcgacttcttcctcgcccacgaagaccagtactcccgcatcatggacgggctggccgacggctccgttccgctgcgcgtcacccacaacgacaccaaactcaacaacatcctgatggacgcgaagaccggcaaggcccgtgccatcatcgacctcgacaccatcatgccgggttccatgctgttcgacttcggcgattccatccgcttcggcgcgtccaccgcgcttgaagacgagaaggatctcgacaaggtccacttcagcaccgaactgttccgcgcctacgcggagggcttcgtcggcaaggtgcgcgacagcatcaccgacaaggaggccgagctgctcgcattcgccggcaacatgatgacgatggaatgcggcatgcgcttcctcgccgactacctcgccggtgacacgtacttcgccaccaagtaccccgatcacaacctcgtgcgcgctcgcacccagatcaagctcgtgcaggagatggagcagaaggccgacgagattcgcgccatcgtcgacgacgtcatggaaaggaccgcccgctgatgaccacggaagagaagaaggacgactgcgcctgcggcggactcgacgccgtctacgcgagcatcgacgcgctcgtcgacttcgcgcgcaagcggcttgaactcgacccgcgcgatgccgactggacgcgcaaccgcatcttcgagctgttctcgctcgactcgtaccgtcctaccggcgcgaccagcgacgacacgctgccagacgacctgctgacgcggttccgcgccgcggccgtcgcggcggggctgttcgacgccgacgaaggatccgtgtacgcggacatcgtgatgggcatgctctccggcacgccgtccgccgtgcaggaccggttcgaggcagtggaacgcgaacatggcggcatggaggccatgcgctggttctacgactactgcgtcgccaacaactatgtcaagaagggcgtgctcgacaagaacccgcgcttcgattcccacggcctggtcatcaccatcaacctcgccaagcccgaattcaagaacatgaagaaggccgccgcgggcaactcggtggccggcggataccccgcatgcacgatctgccatgagaacgagggcttcgcggggcgcaacaagcgcacgctgcgcaccatccccgccacactcggcgacgaaccgtggttctggcagttctccccgtacgggtacttctaccagcacggcatctgcgtgaacgacgagcacacgcccatgcacgtgagccgctccacgttcgggcacctgcttgacttcgtcgaccggttccccggatacttcctcgggtgcaacgccgcgctgccgcgcatcggcggctccgtgctcgcccacgaccattaccagggcggcggcgaactgctgccgatgcacaaggcgtccgcctgggcgacgatgacgctgccggaatacccggacgcgaccatcgagatcctcgactggcccggcaccgccgtgcgcgtggtcgccaaatcgcgcgacacgatcatcgaggtgtgcgacaagatccgcgaaggctggatcaactactccaaccccgagctggacatcatctgcgaaggcgaggacggcaagcgctccgcggtgtcgcccagcgcgatcatcaccgagcgcggctacgaaatgagcctgatcttccgcaacaactcggtcagcgaggagctgccggaaggcatcttccacgcgcatcccgagttctggccggtcaagcaggagcccatcggcctgatcgaggcgcaggggctgttcatcctgcccggccgtctcatcaaccagcttggcctgatcgaggacgccctcgccgagggcaagccgctgccggaagaggtcggcgagttcacgctcgaatgggacgaactcaccgcgacactgaacggcgagcgcgaccgcgacgccatccacgccgcggtgcaggacgaactcggcagcgtatgcgagcgcatcctgggcaacacggccgtgttcaagcacaaggaactcacccgggacttcatggaaggcctcggattccatactcagcattagaatgactgttggagtcatccacagctgtttttcaaggaggaacacatgactaccattctggtaacgggcggcgcgggctacatcggtacgcacaccgatgtcgagctgctgaacaaggggtacgacgttgtctgcgtggacaactacagcaactcgtcgcccaaggcgctcgatcgcgtcgaggagatcaccggcaagaccgtcaagcgctacgagggcgatgtccgcgatgaggcgctgatggaccgcatcttcaccgagaacgacatcgactgggtgattcatttcgcctcgctcaagtccgtcggcgagtcggtcgccaagccgatcgaatactacgacaacaacctcaacagcaccatcgtgctgctcaaggccatgcgcgcccacgacgtcaagaaggtcatcttctcgtcgtccgccaccgtctatggcacgcccaaggagctgccgctgactgaggagagccagatcggcggcaccacgaacccgtacggcacgaccaaattcttcgaggagcagatcctgcgcgacgtgcacgtcgccgacgactcctggaccgtcgtcatcctgcgctacttcaacccggtcggcgcccacgagtccggcctgatcggcgaggatccgaagggcatcccggcaaacctgaccccctacatcgccaaggttgcactcggcgagctcaaggaggttcaggtgttcggtgacgactacgacacgcccgacggaaccggcgtgcgcgactacatccacgttgtcgatctggccaagggccacgtcgccgtcatcgacaaggtcgagggccccggcgtgttcacctacaacctgggtaccggtcacggatactcggtacttgaggtcatcaaggcgtacgagaaggctgccggccacgcgattccgttcgcgatcaagccgcgtcgccccggcgacatcgccgcctgctacgccgactcctccaaggccgagcgtgaactcggctggaaggccgagctcggcatcgacgacatggctgcgtcgtcgatgaattggcagaccaagaacccgagcggttaccgcgacgccgagtgacatcggcccgtgcgatcggccgatcggcgtgatttgatcgtctggccgtcttacgaatgatgcccggtggctcctgagattcaggaaccaccgggcatcattcgttttttgccgttgatattcgccggaacgttggcaaggtcatgggtcaagtcgcgtttgcgtgcttaagtgcgcgtcggaacgacgagtgcgcgaacataggaacgcaaaaccggtggtttgcgtgcttaagtgcgcacggtcgtcgttccggcgcgcacttaagcacgcaaaagggtacggacaggcccgatatgtgtggtgttcgttcagtggattgccgtgaagtgatgcgtgtgtcggcaaggcgtaccgaaggaagcggtacgagggtaccgcgactgaggaacaacgcagccgacactccatcactcctcggcaacgaggtcgagatatgaatcgttccacagatcctcgtccccgtcgggcatcagcaggacgcgttcggggttcagggcctggactgcgccctcgtcgtgggtgacgaggacgatggcgccttcgtatttggcgatggccttgaggatttcgtcgcgggaggcggggtcgaggttgttggtgggctcgtcgaggaggaggacgttggcgcgggaggtgacgagcgtggcgagggcgagacgggtcttttcgccgccggagaggacccgggcgggtttgaaggcgtcgtcgccggagaagaggaaggagccgaggatggaacgagcctgagtgtcgttgagctcaggggcgacgtgggtgaggttctcaagcacggtggcgttgagatcgagggtgtcgtgctcttgggcgaagtagccgatcttgcagccgtggccgtattcgacgacgccggtgtcggggtcttcgatgtgggcgagcaggcgcagggtggtggtttttccggcgccgttgtagccgaggatgacgacgcgggagcctttgtcgacggcgaggttgacgccggcgaagacgatgttggagccgtatgccttggagatgtccttggccatgatgggggtgcggccgcagggtgccggttcggggaagcggatgtcggcgaccttgtcctgcttctgggcgtcggaggtctcggacaggagccgttcggcgcggcgcatcatgttctgggcggcgacggccttggtggctttggcgtgcaggcggatgccctgcttcatgagccggtcggcttttttctcggcgacctcgcgttcgcggcgacgacgctcctcgtcgacgacgcgctggtggaggtaggctttccagccgagggagtacatgtcgatctggccggtctgcgcgtcgagatgccagaccttgttgacgacttcgtcgagcagctcggtggagtgggagatgacgaggaatccgccttcgtatttcttgaggaatccgcgcagccattcgatggagtcggcgtccaagtggttggtgggctcgtcgagaatgagggtgtcggcatcggagaaaaggatgcgggcgagttcgatgcggcggcgttggccaccggagagggtgccgaggggacgctgcatgacgtcctgggggaggccgaggctgtcggccatggcgatggcctcggattgtgcggcatagccgccggccttgtcgaagtcctgcatggctttgtcgtaccggttcatggctttggtcatgatgtccgggtccgggttggtcatgtctttttcggctttgcggatgcggctgatgatggaggcgatgtcgcgggcgctcatcatgcggtcgagcgcggtctgctcctggtcggcggcatgcgtgtcctgggggaggtagccgagcttgccggatacgcgcaccttgccgctggtggggagcatgtcgccggtgatgacgcgggtgagtgtggttttgccggcaccgttgcgaccgaccagaccgatcttgtcgcctttggcgacgtggaaatcggtgggatggagcaaggtgcgcgcgccgatctgaatctcaagtccctgcgcctcaatagccatgtgtcccgctcgtctttctgttgttgtccgtattcgttgaagtccaaccgtccatcatagcgaacacgtgccgactggcggtcagggtactgactcaggggtgtctcggggttgtcatccccgcggatcataagccgtttcgtccccgtggtcgatggccgggaaaccttacgaatcctaatgtttatggtgatgttgcgatgacggcagaccagtgaaggagcgacaggcatggaacggatgatgacgggagacgggcgcgttcggacgttcgccgagtgccggaacagaaggaaccgcaggacgctgctgcgcgtgtcggtcgtgctgggcgtcctgcttgccgccatactggcgctgctgttctgcctggggcgtttcgcgggccggggaccgtttgcgcccggcgccgcacaggcgaaatactctccgtcgagctggagtctgattgtcgtcaaccggtggaacaggattcccgacgactatccggcaccgaaactgaccaggctcagcaacggcgagagcgtggattcgcgcatctatcccgatctgcagcgcatgttcgatgacatgcgtgccgcggggcttcacccggaggtcacgtcggcgtaccgtacggaggccgtgcagcggcagctgctggacgagaagatattcctgtatcagaacgagggcgcgtcgaaggaggaggcgagaagacaggcgtcgcaatgggtggccgagccggggaccagcgagcacgagctgggcctggcggtggacatcaacgcgagcggggccaccggcaccaaggacagcgtcaacgagcaccagtggcttgcagacaacgcgtggcggtacggattcatcctgcgctatccgcgagggaagaccgacgtgaccggcaacgcgtatgaatcatggcattaccggtatgtgggagccgaggcggcgaaggcgatgcatgagtccggccagacgcttgaggagtacgcgaagtagctggacgggccgttgccgcagtatcaatctatgccgacgcgatggtgatggtggcgcggaacgattgctcgtccggcctgtccaattccagcgtcgcgcccatggcctcgcatgcggcgtcggcgatcgacaggcctaggccgacgccgggctcggcgctgatgcgtgagtgttcgccgcggtggaacggctgcttcagattcatcagatcgtccggcagcgtttcgtcggtgctgttggtgatggtcacgatgatggcgcagtgctcctgcctcgcggcgatgtcgagtgtgcccgagctgatgttgtgcatgatggcgttacgcagcaggttgccgatggccaagtccatcagcgatttgctggcctggacctgcacgtcgcctgcgacatcgcgcgtggtgacgaggatgttgcgcttatcggcctgctcctccacctcggccagctcgtcgtcgatgaaatcggcgagctgcagggcggtgacgtcctcggcatcgatgacgccgctctggatgcgcgagagcgtgagcagtgcctgcacgaggtcgctgccgcgacggttcgcggcgagcgcccgcctgatggcaggctccacgtcggccgggaaacggccttgggacagtggggcgtccagattggtcgcgacggcggcgatgggtgttcgcagctcgtgggaggcgttcgacacgaaccgacgctccgcttccgtggcgttctgcagtcggccgagcatgccgttgatggattcgatgagcttgccgatctcgtcatcgctgccgtcgggggcgatgcgagcgtcgagatcgccgggcttcaacgcctccacctgcttgctgatcttggccacgcgtttggacaggcgagagccgacgagccaggacacgatgagcgagagcacggcgaaaatgatgaacgtgccgatggagatgaactgcatcatcgtgatgaaggagtcggtcatggcgctcgccgtcttgccgatatgcgtcacctcgatcttggtgacggtggactccgggtcggaggtctcgacggtatcctcctgtaccgagagcatcggggagcagacggcggtggcggagctgccgacggcgtccggcgcatcctccagatcgaggtcgtagctggtctggttcttgtcgaagtacaccgtgatcagttcgccggtgtccttgtcggtgcacatgacgatgttgttcttctgctgccgtgccgcctgtgagacgatgatgttctgcgtgatgatgacggtggccagcatcgccagggcggcgatggatatggtggcgatgagccggcctcggaacgtcgacggccaggggaatcggcggcgacggcgtgtatggccattgccgccggcggtgtctttggcggcggcaatggccgcggccgtgtcggtgaccggggccgcctccgaggttgcgtctgagtctgttgcggcgtctgctgcgtgtgatgcggtcatgacagacggtacccctttcctctggtggaggtgatgccgttgccctcgccgagtttgcgtcgcagcgagtatacggtggttttgatggcgtccgtgaggtcggtggctgatgcgcccgcccacacggtgtcgaacagttcctcggcgttgacgtagctgccgtccgccttcatgatctccagcagcacgccgtattccttcggcgacaggttgacgggcttgccgtcacgggtcacggtgtggcggaccgtgtcgaggacgatgccgttgtgtgagaattcggtgccggagaagtcgcccttgccggcacggcgttgcagcgcccgtatgcgcgcgagtagctcgggatgggcgaacggcttgatcaggtagtcgtcggcgccgagttcgagaccgttgatgcggtccctgacctgcgctgccgcggtgagcatcagcacggacacggggatgtcgttcgaggcgatcgtctccatcaccgcgtcgccggacatgatcggcaggtcgcggtcgagcagcacgatgtcgatggattgctcggcgagcatgcgcaccgcttccagcccgttgtatgcgacgcgggtcgcatacccttcgaaccgcagcgcgtcgtccagcgcggcggcgaggtcacggtcatcttcgacgatcagtatgcgcatgggaacctcctcggatacgtaggttgcgtgagaaccaatccgtttccattattgtcgcggttttcagagctgagtgagcatccggcggctggtcatggaacactcaaacgttattaagaggatacgatgaaagttgtataggaaccatggtcggcatgcaatgaatggtatcgtattccgccatcggagtatgaagatgggcatggtcgcccatccggcttgttcaacggatctcttactggaaagaaaacgcttatgagtggtaaacggttgatggggggggctgacatgcggcgttgtgctatgtgagggaatgtcgcgccaagggattcaccttggtcaaggatcccgcacgtaccggaaggagtgacaagcctggcaaaggctctgtcatcgtcggcgacgaatgggcgttctcgcaatactcggactaggaggagatgatacgccggattagtgcgatctgcgtgcgcacgaaatcaggcaacgacgaaaggattcgccgtatcctcgcccacgcggcgaacatcggcggctccggcgtgtacgtcaccgcgtcggctgacctgtcacaggcgagaaacaccgcggacgactcgctgacgacgctgggcctgatgatcggcgtgatagcgctgatcgtgggcggtatgagcatcgccaacatgatgatcgtcacggtcatggaacgacgagacgaaatcggcttgcgacgggcactgggcgctgcgcagcgaatagatgacggcgcgtgccggattcgtgcgtcgtcttgcagcgaatattgtggcatcgcacaacgagtacccgtcaaatatgtggagtatttcgtcagccggacatgaaatggcggtatattgaaaccatcatattggactgacacagaaagaagttagccatgacatatccgcagcagcccggcccgcagcagccgcaagccccgcagcagcccgcgtatcaggcgccttatggtgctcctcaggctcctcaggctccgcagcagcccgccggataccagtatccgcaggggtacccgcagcagcccggctacccgcagcagcccggctacgctccccagccgcaggggccgagcttcctcgacacgatgaacgtgcgcgcggtcaccaagatctccgccattctcatggtcgtgttcatcggcatcgagacgttcctgtcgttcctcagacttgtcgatgccggcaacaacatgagcggattcggctacaagttcctcttcggctcgactccgtggctcatgctcaccgcaatcctggcggtgtgggtcataggtctcaacgtcgtgcagcacggaccgcagtggttcaagatggccgcgttcgtcgccatggtcgcggccgccggcctgagggtgctcgcgtggctcatctacctgttctccggcaattccggatattacggctacggttactcggacggtgccgccaccgcgattgcgtggattggcttcttcgcgctgctcggcctgcttgctcaggtgattgttctgctcgtcggctggctgcagcagcgggtgtgagggcgtgtgcatgatcgtgtgacggtcgcggaacggccgtgatgcggtttcgccgtgcaaagccggatggtctgatggccgtccggcttttgcgtattcgggggcgtcgcggatcggacggtgtatggtccatgtgtttgaatatgggacacgctatcgaactgatgttcgacatttgtcttgaagtcgggtattgttgagcatgatctaccgttgatgatgggatgtgcgaggaaaggcggggttgtgactggacgcaagacgtcgaaatcgggcggcggggacgtcgtgatcgaacgtgtgatgagcagcgacacgttcctgtcgcgcgagatccgcaaggcaccgatgcgcaagaccgactcctcattggtggcggacatctcacatatcccgaacgatctgaagatcaccatccagggtgcgcgtgaacacaatctgaagaacgtagatctcgccgtgccgcgcaacaggatggtcgtgttcaccggactgtccggctccggcaagtcatcgctcgcgttcgatacgctgttcgcggaggggcagcgccggtatgtggagtcgttgtccgcgtatgcgcgtcagttcctcgggcaaatggacaagccggatgtggatttcatcgagggattgagccctgcggtgtcgatcgaccagaagaccacaaaccgcaatccgcgttcgaccgtgggcacgatcaccgagatttatgactatctgcgactgctgttcgcccgcacaggcgtaccgcattgccccgaatgcggcgagctggtcagcgcgcagacccctcagcagatggtggacacgctgctgaagaacccggaacgcacgagattccagattctcgcgcccgttgtacgcggccgcaagggggagttcgccgatcttctggagctgctgcgcggcgacggctatgcccgcgcgctgatcgacggtgaggggcgccagctgtccgacgacatcaagctcaccaagcagaaaaagcacaccatcgaggtcgtggtggatcgtctgatgatccgcgacggcatccgacagcggcttactgattcgatcgagaccgcgctgcggttgtccaaaggtgtcatcgtcgccgatttcgtggacttggacgagaaggacccgaatcggcgtcagccgttctcggagcacagggcctgtccgaacgggcatcagctgcagttggacgagatcgagccccgcacgttctcgttcaatgcgccatacggggcctgccctgtgtgcgatggcatcggctacaagctggagatcgaccccgatctggtcatcgccgatgattccaagtcgctgtccgacggcgtgatcgagccgtggggaggcggcaagaccacgaccgaatactacgggcatgtgctgcagggcctggccgacgaactcgggttctccatggacaccccatggcgtgatttgcctgaggacgtgcggcattcgatcctgtacgggcatgatttcaaggtcaacgtctcataccgcaaccggtgggggcggctgcgcgagtattcgaccggattcgagggtgtcgtgcgcacgctgatgcgccggtatcacgagaccgactcggaccagatgaagcagtactacgagtcgtacatgcgcgaggttccctgccaggcgtgcaatggcaggaggctgcgccccgaagtgttggcggtcaccgtagacggcgaatccatcgccgatgtatgcgacatgcccgtcgaacgcgggctagcgtggatcaatgggctgaaactggagggagcggcggcgacgatcgccggcgaagtggtcaaggagatccgggcccggctgggattcctcaacgatgtcggcctgaactacctgacgctgtcgcgcgcggccaagacgctgtccggcggcgaggcccagcgcatcaggcttgccacgcagatcggctccggactggtcggcgtcatgtacgtgctcgacgagccatcgatcggactgcaccagcgtgacaacgcgcgtctcatcgagacgctgcaccatctgcgcgacctcggcaacacgctgattgtcgtcgaacacgaccaggaaaccatcgagagggcggattgggtggtcgacatcggacccggtgccggcgagcacggcggcgaggtgatttactccggtccggcgaagcgtctcatcgaggcgccccggtccgtcaccggcgattacatcgccggccgacggagcatcgaagtgccggccgtgcggcgcaagccgcatgccacgaagcgccttcgcgtggtgggggcaagggagaacaatctgaagaacatcaccgtcgatttcccccttggcgtgatgactgtggtcaccggcgtctccggctccggcaaatcgaccctggtgaacacgatcctctacccggtgctcgccgacaagctcaacggcgcgcgcatcgtgccgggcaagcacacgcgcgtcgagggccttgaccagtgcgacaaggtcatccacgtcgaccagaacccgatcgggcgcactccgcgctcgaacccggccacatacaccggcgtgtgggacaagatccgcacgctgttcgctaagacgccggaggcgcaggtgcgcggttacggtccggggcggttctcgttcaacgtcaagggcggccgctgcgaggcgtgccacggcgacggcacgctcaagatcgagatgaacttcctgcccgacgtgtacgtcgaatgcgaggaatgccacggcaagcggtacaaccgcgaaaccctggaggtcaaatacaacggcaagaccgtcgccgacgtgcttgatatgccgatcgaggaggccgccacgttcttcaaggcttacccgtcgatctcccgctacctcgacacgctcgtgcaggtcggactggggtatattcgcctcgggcagcccgcgcccacgctgtccggcggagagtcgcagcgcgtcaagctcgccaccgagctgcagcgcaggtccaccggcaagacagtgtatatcctcgacgaaccgaccacgggcctgcacttcgaggacgtgcgcaaactgctgctcgtgctgcaggggctggtagacaaaggcaataccgtgatcgtcatcgagcacaatctcgacgtggtcaagtccgccgactggatcatcgatttgggtccggaaggaggcgacggcggcggcacgattgtcacgcagggcacacccgaacaggtggcgcaatgcgaagcgtcctggacgggcaagttcctcaaggacatgctgtgacgaacgatatcgagcggcattcacccgaagtgtggagaaaagcggccgattcgctgcgcggggaggcggacgcttcggatgcggtcgccaaagtgaacaggaacggggctccgctgctgggggacacgcgcgacctgttccggccgaagaccggagatatccccgcccagcccggagtctacaaatggcgggacggcgaaggacgcgtgatctacgtcggcaaggcgaaaagcctgcgcaaccggttggccaactacttccagccgctgtatctgctgcatccgcgcacgcagacgatggtgctcaccgcacgtagcctcgaatggacggtcgtcggcaccgaactggaggcgctcactctcgaatacacgtggatcaaggagttcgatccccgtttcaacgtgcagttccgcgacgacaagacctacccgtatctggcgatatcgtcgggggaggccgtgccccgcgtatgggtcacccgcagccgcaagagaagggacgcccgctacttcggcccctacgcgaaggtgtgggagctgagacaatcgttggacaaactgctgcgcacattcccggtgcgtacctgcacgaccaacgtgttccacaaggccgaactcaccgggcgaccatgcctgctcgcgtcgattggcaaatgctcggcgccatgcatcgggagaatcgcgcccaaggagcaccggcgcatgtgcgagcagctggtcggcgtgatgaccggtcggctcggcaagagctacatcgcccagctgacgcgggacatgaaggacgccagcgccgaactcgaattcgagaaggccgcgcggctgcgcgacgaaatccagatgctgcagaccgtcatgcagcagaacgcggtcgtattcgatcaggacgtggacgccgacgtgttcggcatggcatccgacgagcttgaggcgtccgtgcacgccttcatcgtgcgtgacggctcgattcgcggagaacgcaactggagcgtcgaacgcgtcgaggacgtatccgacggcgaactcatcgacgacctgatcatgcaggtgtattcagacgtggccgccgacaacggattgaacgtcgatcctcatgatggaacggccccttccatggcctcgtcctccgggaacgagggcgtgccgacggccgaagggggagcctccatcgtggagagacgcgacgccatcggcagcacgcagacggtgacggccaagagcagcgtcgagcgcgcgcaggcgacacgcacgagacgcgaacggcaggaacagaccggtcgcgcggacctgctggcgccaatcgccccagtgccgcgcgaggtcatcgtgccggtcgagccggcacgccgtgcagaactcgaatcatggttgagcgggctgcgtggcgccgtggtcaccatccgcgtggcaagccgcggcgagaagaaggcgctgatgaaccgggcgaacgagaacgccgggcaggcgctgcaacgcagcaagatgagccgcatcagcgacatgggcacgcgcaccgcggccatgaacgacgtcgcgaaggcactcgggctcgctcaggcaccgctgcgcatagaatgctacgacatttcgaacaccgtgggcggggcgttccaggtcgcctcgatggtcgtgttcgaggacgccatcgccaagaaatccgaataccgcagattcgccattcgcggtgatgacggcaagggtgcgctcgacgatctgagcgccctttacgagacgctgacgcgacggttcagacacggcaacatcgccggcgactccggcgacagcatggacaacgagcgccgtgccgaatcgtccgatacatccgcatccacgacgacggcatcgtctcctgacggcatacgggacgcgggagtcgtccagcagaacacgaaccggcatcatttcgcctacatcccgaatctggtcgtcgtcgacggcggccatccgcaggtcatggccgcggcgaaggctctggccgattgcggcgtgaacgatgtggccgtctgcggtctggcgaagcgactcgaagaggtctgggtgccggacgacgaatacccgatcatcctcaaacgccagtccgaaggcatgtacctgctgcagcgggtgcgtgacgagtcgcaccgcttcgccatcacctatcatcgtcagacgcgacgcaaaggcgcgttgcgctccgcgctggatggcattcccggcgtgggtgagacctaccagaagcgcctgctgagccacttcggttcagtgcgtgcgatgcgtgacgccagcgtcgaggaactcgaagcggtcaagggtataggccatgccaaagccgaagccatccacaccgcccttcacaccgaataaccgcacacctcgttcgcccccgctggcggtctatggactccgccccgtcagcggggtgccatggactccgtccccgctggggcgtgaagtccatatcccgccagcggaattcattggtctatgacgattttgttaagaacatttacggtacgatggtggcagtgaatgatataggcagtgagcaaggaggggtatgaccgtgattgcacatcgttgcgccgtgctcggcaagccgatagcccattcgttgtcgccggtgctgcacaatgccgcatacaaggcgctcgggctggatgactgggcgtacgagcggcacgaggtcggcgaaagcgatctcgacggatttctcaaagggcttgatccgacctggcgcggtctgagcctgaccatgccgctcaagaaaaccattcagccctatggcactccgtccaatatgtgggcgcagcgtctcaaagtcgccaataccgcgattttcgactggcccgccgaacctggcatcacccccggtgccacccccgacggcgcctccgcaacgggctcgctgccggcgatccgcctctacaacaccgacgtcatgggcatcgtgctcgccttcgaccatgagctcaaggccctcggggagcctgaccgttggaagagcgcaacctccgccgccgtcatcggcaacggcaacaccgcggcctcggccgtcgccgcatgcacggtcatgctgaagaacgggcagacgaacaaacgcatcactgtggcggcgcgccacccgggcaagaaccggcagctgccggacatcatcggcgagggcgacgccatcgcatacgaggagaagacgatcgacgcgtcggccgacaccctgcgggacgcggacatcgtcatcagcacgattcccggccacgccgccgacgcggtcgccgaagccatcgggaacgacgactccttccggccgcgtggcatcctgctcgacgtggtctacgacccccgccccagcgcattgatccgcgcatggagggccaagggagggctggcgatcggcggcgaggagatgctgctgtggcaggccatcctgcaggtcatcctcatgaccggcgcggacacggccgacagctccctgatggatgtgctggaacccgcgatgcgacatgcccttgaggaggcactgtaatgaacgatcacgcaaccatgagcccggccggcgcgcctgtgccgccggcgggcgggaacaggccggagcccgcggacgacttcgaggtcctgctcatcacgggcatgtccggcgccggtcgctcccatgccgccgactgcgtggaggacatgggatggtacgtcgtcgacaatctgccaccgaaactactggtcccgctggtcgacatgatgaccaatgccggcaaggacggcgtgcacaagctcgcggccgtcatcgacgtgcgttcgcgcgagtatttcgacgacctgtcagccgtgctcagccatctcgacgacctgggggtgcgcacccgcatcctgttccttgacgccagcgacgaagtgctcatcaagcggtacgagtcggtgcgcaggccccatcccctgcagcgtggaaaccgtctgatcgacggcatccttgaggagcgcagcctgctggacaacctcaaggaacgggccgacatggtcatcgacacgtcctcgctgagcatccaccagctgtcgaccaaactatacgaggcgatgctcggctccggcccgtccacggtggccgtgcacatcttcagcttcggattcaaatacgggctgccgatggacgccgatttcgtggcggacgtgcggttcctgccgaacccattctgggtgccgacgctgcgagagctcaacgggcaagacaagcccgtcagcgattacgtgctgtcaagtccgggtgcgggcgatttcctggacgcatacgagcgggccatcctcgtggcgttggaaggctacgctcacgaggacaagcatttcgtgaccatcgccatcggatgcacgggcgggcagcatcgttccgtcgccatgagcgaggaacttgcgaggcggctgcgcgcgcacggcatatccgtcaccgtatcggcccgcgagctgcaccgggcgcgcgcatagcgagaccgtgcagccactatgcaaacatttcgtttccataatccggcagcatcgcgtattcttgtccaagtgattaggtatcacagtaagccggtggcagtgcagggagcagaacccagcaggccggggaaacattgagaagaaacaggacataggaggttggctcttggctcttctggatgatgtcaaaagcgagctggccgcaatcgataacgaattgcctacggcgaaaaaggcgcaggcgaccgctatgattcgtttcggcggcgggctgcggctggtacagcgccagatcatcgttcaagcgcagtttgactcgctcaaggccgcccagtggcttcaggacaccatcagggatctgtatgggcatgaggcggtcatgacccaggtttctcgctcgacgcccaacggcgccacggtgcagcgatacatgatccacgtggagcgcggcggtgcagcgttggcattgcagaccggcctcctcgatcggcgcaagcgtctggtgcgtggacttcccgcggatatcatcagcggcaacatcgctcaggtgaaggccgcatggcgtggagccttcctggctcatggcgctctttccgacccgggcaaagccggcttccttgaaatcatctgcccgtcgaacgaggccgccctcgcgctttcgggcgccgcacgcaggctcggcatcacggcgaagccccgacagctgcgcagttcggagcgtatcacgctcaaggaccccgacgccatcgagcgcatgctcatcctcatgggcgccccgcactccgcaagggagtggacaggcaagcgcaccgacggcgaggcgcggggcaaggcgaaccgtctggcgaacttcgacgatgccaacatgcgccgcagcgcgaaggccgctgccgaagccagcgagaaagtgcgccgcgcattcgagattctcggcgacgacatccccgaaaaccttcgtgccgcgggccagctgcgccttgagcacggggatgcgagccttgaggaactcggacgtctcgccgacccgcccatcaccaaggatgccatcgcaggccgcatccgccgtctgctgcagctcgccgacaagaccgcgaagacccgcgaccgggaacagtccggcgcgtccgtcggacgctgacggcgtccctctgctcctgaaaagcgccggaatcaaatcccgtcatgcaccgcgtccatgttcgctatggacgcggtgttttgttccgtgccgcttgtaatattcgaattggctaaaaccggccattcctcgcatatgcggataggaaaggatacacatgaagacactcaaggatctcggagatctcaagggcaagcgcgttctgatgcgcgccgatttcaacgtcccgctggacggcaccacgattaccgatgatggccgtatcaaggccgcgctgccgactatcacggcgcttcgcgaagaaggcgccaaggtcatcctgatggcccacctcggccgtccgaagggcaaggtcgtccctgagctgtctctggccccggtcgccaagcgtctgggcgagctgctcggcgtcgaggtcccgctggccaaggacacctacggcgaggatgcccaggccaaggtcgccgcgatgaacgacggcgacgtggtgctgctggagaacgttcgcttcaacccggaggagaccagcaaggatcccaccgtgcgcgccccgtacgccaagaagatcgccgccctcggcgaggtcttcgtctccgacggcttcggcgtggtccatcgcgcccagggctccgactacgatgtggccgccgatctgccggccgccgcgggcaagctggttgagaaggaagtcaaggccctgtccaaggccaccgagaacccggagcgcccgttcaccgtcgtgctcggcggctccaaggtctccgacaagctcggcgtgatcgagaacctgctcgacaaggccaaccgcctggtcatcggcggcggcatggtgttcaccttcctcaaggccaagggctacgaggtcggcacctccctgctcgaagaggaccagctcgacaaggtcaagggctacatcgctaccgccgagaagaacggcgttgagctcgtgctgccgaccgacgtggtcgtcaacgccggcttcccggccggtgacaccccggtcgccccggaggtcgttgccgccgatgccatcccggccgacaagatgggcctggacatcggcccggattcccagaagctcttccacgacaagatcgtcgactccaagaccgtcgtgtggaacggcccgatgggcgtgtttgaggttcccgagttcgccgccggcaccaaggccgtggcgcagggcctcgtcgacgcgaccgcggccggcgcattcaccatcgtcggtggtggcgactccgcctccgccgtgcgcaacctcggcttcccggaggacggcttctcgcacatctccaccggtggcggcgcctcccttgagttccttgagggcaaggagctgccggggctgaaggtcctcgactgatcttcacccgcaattcggctccccgggcgcttgacgccggggagccgctccatacggaaaggacatcaatggcgtcacgcatcccgctgctcgcgggcaattggaagatgaacctcgaccatcttgaggccacgtatttcgtgcagaaactcgtatggctgcttcgtgacgcacgcttcgactactcccgctgcgaaatagccctgatgccgtcgttcacgtcgctgcgcagcgtccaggtgctggtcgaagccgacaagctcaagatccgctacggtgcgcaggccgtgtcggtgaccacacagggtgcgttcaccggcgatgtctccgctgacatgatcgcgcatctcggttgctcgtacgtcatcgtcgggcattccgaacgccgcaagtaccatcccgaagacgacgtcaacatcgtcgatcaggtgcgtgccgtattggcggccggcatgcagccgatactgtgcgtcggagaaagcttcgaggaacgccgtcagggcatcgagctcgactttgccgtcggacaggtgcatgacgtgacccgtgacctttccgacaaggaggccgcgaagctcatcatcgcgtacgagccggtctgggcgatcggcaccggcatggtcgccactccggacaccgcccagcaggccgccaaagccatccgcgacgacctcggcgagatgttcggccccgccgtcgccgatactgtgcgcatcctatacggcggatcggtgtcgtccaagaacgcgacgcatctgatcggcgagccggatgtcgacggattcctgatcggcggcgcgtcgctcgaccccgacgaattggcgaagatcgcccggttgacactcaaggcgacacgtcgatagggaaacatgcgcatatccgcacgtttttcaatgccctgcgctatgctatgacacagtacatttaatggaggtttccccgtgcatattctgaagatcgttcttgagatcatcgtcgtcatcgcgtccatcctgctgacgctgctcatcctcatgcacaagggcaagggcggcggtctgtccgatatgttcggcggtggcctgacccagaacgccggcacgtctggtgtcgcggagaagaacctgaaccgctggaccatcttcatcgcactggtctgggtcgccatcatcatcgccctcggtctgatgacaaaattcaacttggtgtgagcgcgattcgctgaagcactgtatgcagcacgttgagccatggtcacttgatcatggctcatttcattgggcaacgtttatcggatatcgtttgaggagcatctgacatggtcaccatgaacaggaacaaagtcgtcatcgtcggcaccgggcaggttggatccaccgcggcgttcgccatcgtcacccatggtctgtgcaacgagctcgtactcatcgatcattccgccggcaaggcgctcggcgaaagccatgatctcgatgacggcagcgaattccaggaccggcacgtcaaggtgcgcaacggtgactacggtgactgcaaggacgccgacatcgtcgtcatcaccgtcggacgcaagccaccggccaactcaacccgactcgacgaactcggcttcaccatcggactcgtcggcgacgtggtcgaccgggtcatggcatccgggttcaacggcgtcatcgtcatggtctccaacccggtcgacgtcatggcatggtacgcgtggaaacgctccggcctgccgcgcacccaggtgctgggcacgggaaccgcgctggacacctcgcgtctcaagaccatcatcggtgaggagaccgggctggacccgcgcaacgtcggcggtttcgtgatgggcgagcacggcgattcgcagttcaccgcatggtcgaccgtctcgctcggcggcaagccgttcgcgcgattcctgagcgacaacgccgaccgattctcatccgtctccacgcatgagatcgaagagaagacccgtacgcgaggcaacgagattgtcgcggcgaagggcggcacgaacttcggcatcgcctcgacggtggccggcatcgtgcagaccatcctttgggacgaacgccgcatcgtgccggtatcgaccctgctcgacggcgaatacggcgaacgcgacgtgttcctcggcgtgccgaccgagctgcgtgccaacggcgccaacgagattgtcgagctggaacttgccgacgacgagctcgccaagctgcatcattccgcggagctggtccgctcctactgcgaagggctgctgtagccgcagaccggcacgattctttttccccctgacaggctttacggagaaacgccatgaccaaccctgaacagcgactcatcgtcaccgacctcgacggcacactgctgcatgacgcccccaccttcgaggagcggtttatcacgcagcgcagcattgacacagtcaaacgcatgcacgatgccggttaccggttcgcggtggcgaccgcccggccggtgagcaccggcttcgagtacgcgggtaagttgccggtcgacgcgtacatttatctcaacggtgccctgattgatttcgcgcccgaacgttccgattacgatctgctcatctcggggcggctcccctccgacgggcatctgctgaaggtcggcttctcctccgcacgggcctgcgaggtgtgccggtatctgctcgacgagatacccggcctcagcctcggcgtcgtcatggatgacgtgcgctacacgaacttcgacgtgagcgtgtactggaagacacagacttggcaattcaccgatttcaccgacgtccccgacggtatcgccgacaagatcattatcttccccaagtcggagcaatgggcacatctgaagacgctggttccgcccgatttcgacgtggcgatctccgaaggctcgatgtggatgctgatgagtccgctggcgaacaagcggcaggcgttgaagacgctgtgcgaacgcatggacgtgcggctcgacggtaccgtcagtttcggcgatgaccttatcgacatcggcatgatgacgacatcggaaacgggcgtggcggtcgccaacgcgaaccccgaggtcatcaagatcgccgacgagatctgcccgcccaacaacgatgacggcgtcgcgcaatggatcgaacggcatctgctggcatgacggcggacagctccgggctcggcacgaaaccggtcgcgcggctcgccctgacgatgtcggttccgaccatcgtcgcgcaggcggcgaacgcctcatacaccatcatcgaccgactattcatcgggcatatccccgaggtcggcgacgccgcgatgaccggcgtcggcatctgcttcccgatcctgctggccgtcaccgcgttcgcgtcgctgatcggcgcgggcggcgcgccgagggcgtccatcgaactgggtcgcggcaatttcaagaaggccgaacgcatcctaggcaccagcgcggcgttcctcgtggccatcgccctgacgctcaccgtcatcctgcaggcgacgaaggagccggtgctgcgcgctttcggagccagcgacgccaacatcggatatgcggtcgacttcatcaccatctacctggtcggcacggtgttcgtgcagctcacgctcggactcaacaacttcatctccgcgcagggcaagaccaccatcgcgatgacctcggtgctgatcggcaccggcaccagcatcatccttgacccggtgttcatcttcgtgctcggctggggcgtaaagggcgcggccgtcgcgaacgtgatcgcccagttgatctcatcggtgtggatcatcctgttcctcgcctccgggcgcagcgccatccggttgaggccgtccaacatccgcttcaatcgagtcatcgtgccgatcctgaccctcgggttggcgccgttcatcatgcagatcaccgaatgcctcatcaacgtggtgttcaacgtcgggctgcaacgatacggcggtgacgactatgtcatgtcgatgaccatcatcacctcgctcatgcaggtggtcagtgtgctgaccaacggtttccagcagggcatccagccgatcatcgggttcaacttcggtgcccggcgcatggatcgcgtgcggcaggccatccgcgtggcattcatcgcgcagatcacttcggccacggtgctggtgtcgcttcttgccgcattcccaagcgtgttcgccgcatggttcacgtcgtcgccggaagtcatcggcatcgtgacccgcatgatgccggtcttcgtcgccggatggggcgtgttcggcatccagatgggcgcgcagtgcgcccttgtcggcatggggcaggccaagcagtccgtgttcctggcgatcttccgcaagatcatcatgctggtgccgctcgccctgacactgcctcactggatcggagtgaccggcatcttcctcgccgagcctatctccgacgcgacttccggcatcgtcgcgggcatcctgttctacgtcacctaccggtcgctgacacggggcaggatcgcggatgatgccaagaaccggtgaaggcggcgaccgccgtattgccggctgccaatgctcattggggggcatgttcgtacaatggtgtcatgggaaggaggcgggagcgcccggaccgggcgagcaccggcttgatgtcgaaggagacatgatgacgatgcgttcatatcatcagacgaggatgcgggttccggcaatactggcggtcttagccatgatactggtttttgccggatgcggcggtcgggtcgtttccgtggcctgtgacgccggcgtgcagtacggcaatctcagcgatgccgtcgctgcatcggatgtagtcaccgttgccacgattgacaggatgaagcaagccgatggcgaccaacaggatctgtatgacatgacgctgaaatctggacgcgtctcaaggggtctgtggaaggtagtgatatcacggtcaccgtcaatcttggatgcgaaggagcgggcgccaaggacgatttcatcgcgaaatatggtgcggagaccaagatcattgtcctgctcgccaaaacggacgatggaacctaccagctctctaatctgacccaaggtatccggcgatacgatgacacggccttcaaggagtgtcggacgccgtagcgtagtttgtgatgaccaccccagtcgtcctacgcgcctcattagcccgttccatctcctatctcgatttcgaggggttgattccggcgtcccggaacatctatctgcgtttcaaggggttgcctgaatgcggtacccggagtatatcggggtgttcagcattggaatcatgcggttcccatggtgtttatactcgggcaccaacccctcgaaacgcagttagatgtctgagcgagcctcaatcaacccctcgaaacgaagatagccctcgaatcagtcggtcatcgtttgaacgacgaatgtgcagcactgtcaagcacgccgatgagcaagcctgccagcgccggaatgatccatcccagttgaaattgctgcagcggcagcatgttcaatatggcctctagccatggcagggagccgccgaataccgtgacgatgctcgccagacatgtggcgaatgacacgatggccaccagcagtaccatccagaagtacacgcgcgggaaatgaacggcgaggattcgatgggtcaatgcgagcgtcaccaacacgatggcaatcggatacaatgcggcgagcacgggcacggacaccttgatgatcatgctgagtccggcgttggacaccacgaaactgaacacggtgaacagtgcctgccatgcgcgatagctcacgcggcgaccggcgacggtggcgaatcgcgtgtggaagtatgtggcgcacgtgcagatcagacccgtgcagacattcagacaggcgatgacgaacacgatgcccaaaaataccatgccgaacgtgccgaacaacgaggccgtgagattggtgagtacggtcgcgcctgtatcggtcgctggattgaccgaggcaatgctcccggacacgacacccacatagccgagcaccgcatagatcacgatcagcaggatcccggtgccgagaccggcgtacgcggtctcccgacgaataagcgtgttgtcggtgacatgcatggcgcggacgttcgccgaaatcacgatgccgaagtacaaagcagctagcagatccatggtttgatagccgtccaggaagccccgggacgcctgatgcaccgcataatcgcctgtcggttgcgtcggtgttaccgcaccatgcgccaggcaggctatgaacagcactgcgatgaacgccaacagcagcggccccatgaaccgtcccaacacggccgacagtttctcgggatgctgggccagcaggaaagccacggcgaagaacaccagtgagtacgccagctgcgtcgtccagccgccccatccagtgcgggagggcaggaatggcgccaccatcatctcgtatgacgtggtcgccgtgcgtgggatggcgaagcacgggccgatggtgagcatgatcgccacgccaagcagcgaggcgaacgccggggacacacggcgggcgagctcgtcgaagccacccgcgaacgtgacggcgagcacgccgagaatcggaaggccgaccgccgagacgatgaacccgatgatggcgggaacggtggcagcgcccgcctgcgccccaacgaacgggggaaagatgaggttgcccgcaccgaagaacatcgagaagaacgtgaacgccatgacgaggcgtccggagaacgggagacggcgccgaccgccggattcggcggtgttgatgtctgttggtatgggagtcgttgccataacggtactgctttctgttgcggcggctcggcgcctgtcttctcggcgcctgtcttctcggcgcctgtcttctcggcacctgtcttctcggcacctgtttcggactcggttcccggcggtcggcatgaatccacccgcgtcgggtggcccgacccgtgataagcccatggcagcgcagtttaacacattgctgtgcgttggggaataggtcagtggcgggcggtcgcccatgccgccgtggaatgcgcgtgcgcgagcatcatgccgatcacggccagcagacaagccagagcgaccatgaggatgatgtcctcatgtcctttcgactgtagcgccgcgcccgtcagcgctccgagaaacatggccaatacggcgacggcgcgccggccgagttttgacatctcatggccgtgggcggatgtgtcggcgacgatgccggtcacggtcatcgtcagcacggtcgtcggcaggtcgggcaccgcgagccgccgggcagtggagttctggatgcccatcgcgggggcgatcagcacgatcagcatcagatgatggacgtcgatgtggcgggcggtggggaagttgaggctcggctgcgatgacgcccgcatactgcccatgcccagagccggttccgcggaatagtggttcagcaggtacagcccgatcagcgcggcgaggatgaacgcggcctgcacgatcgacgagatcagcagatggcgggcccggtgttctccgaaccggcgtatgatgcggcctccgatgaacgcgccgaaggcgaagcacaccaatgtcagcgccgatgtccaccagacgaacccctgtgcgtgggcgagcgcgaagccaaggaagacgatgttgccggtgacgttcgccacgaacacatgtcccaaggccaagtagctcagtgcatcgaccagaccggcgatgaacgtcatcagcaccatggcgggggagagcagcccgtattcgtcatccttgcggggaatcagcgtgcgtcctgcctctgccagatgcaagttcatgtggttgacggtccttctgtttgtagtttctgcttgagtgatgcgctggcgcatgttcgcggcgagagaaatacccttcggcatgatacacgaaggggcgtcattcacggcctttcccggtttcgacatggcgttcgtgtgcggtctagcagtgtatcacgtgagaagcccccggccgttatcgggtcgggggcttctcacgattatgtggtcaggcgtatgtcacgcttgaccggtcggtctcaggcgttcacgcggtcgatgccggactgcacgtcggccagcacggaatcccaggacttgatgaaggcggcgacaccgtcggcctccagcttgtcggtgacgtccttgaggttgatgcccagctcggccagcttgtcgatgacggcgtgggactcctcgtaggtgccctcgatggacggagcgccgttgccgtgatcggccagagcgttcagggtcttctcgggcatcgtgttgacgatgtgcttggcaacgagctcgtcgacgtacttgcagtcggagtaggcggcgttcttggtgccggtggaggcccacagcggacgctggaccttggcgcccttggcggccaggtcagcccagcgaggatcggcggcgaacttcttctcaaagagctcgtaggcgaggcgggcgttggcgacagcggccttgccctcaagggccttggcctcatcggagccgttggcttcaagcagcttgtcgaccgcggtgtccacgcgggagacgaagaaggaggcgacggagccgatgtgcttcaggtcgtggccgttggcggcagcctgggcgatgccctcgatgtaggcgtcgatgacctgctcgtagcgctccagcgagaagatcagggtgacgttgacggagatgcccttggcgagggtggcggtgatggccggcaggccttccagggtcgccgggatcttgatcatcgcgttcgggcggttgaccttctcccacagctcgacagcctgcttctcggtgttctcggtgtcgtgggccagacgcgggtcgacctcgatggagacacggccgtcgacgaagtcggtggcctcggcgatctcgcggaagatgtcggtggcgttgcgcacatcggtggtggtgagctcgcgcacggcggtctcgacgtcgaccttgccgagttccttgagctgggcgtcgtacgggccgacctggctcagagccttctggaagatggacgggttggtggtcacaccgacgacgttcttgtccttgatgagctcctgcagggagccggactcgatacgggtgcgggacaggtcgtccagccagatcgagacgccgttgtcggacgtgcgctgagttgcttcagtcatattgttttctcctttgattccgtaatggaacaaatcttcaatggcgcccctcccgcgaggggcttgtcggccgtgccgaccgggagggagccgcccgacgcgtattcgcctcggcgggcggctcccgatggatcacttggcggcttcggcttccgcgatggacgccttggcggcctcgaccacgtgctcggcggtgatgccgaggtcgatcatgttctgcgcgccatcgccctgcagaccgaactgttcgatggagacgggcttgccgtaggagccgaggtacttgtaccacggcatcgccacgccggcctcgacggacacgcgggccttgacggaagcgggaagcacagcttccttgtactcggcgtcctgctcctcgaaccattccatggacggcatggacacgacgcgagccttgacgccctcaccggccagggtcttcgcggcgtcgacggcccactggacctcggagccggaagccatgaggatgacgtccggggtgccctcggtgtcgaccaggacgtaagcgcccttgcgcacgccgtccttggccttggcggcggtctcggcgagcaccgggacgccctgacgggtcagcaccatggcgccgggcagcgtgttcttcttctcgaagaagtagcggtaggcctcggcggtctcgaaggcgtcagccgggcggatgacctcaagctgcgggatggcgcggaaggaggcaaggtgctcgaccggctggtgggtcgggccgtcctcaccgacggcgacggagtcgtgcgtccacacgtacaggttcgggatctccatgagggcggccagacggacggcggagcgctcgtagtcggagaacatgaagaaggtgccgccgaacggacgggtgtgggagcccagcaggatgccgttggtgatgcagcccatcgtgaactcgcgcacgccgaagtgcagctgacgtccgaactcgttgcagaccggccactgcttggtggcgcactccgcaggagcgaaggtggcagcgcccttgaggtcggtcttgttggagccgccgaggtcggcggagccaccccacagttccggcatgacggccgcgatggcgttgaggacggagccggaggcgccacgggtggcgaccttcttgccgacctcgaaggtggcctcaagatcgtcgagggccttgtcgaagccttccggcagctcgccggccttcagacggtcgtacagggcggccttgtccgggttggccttgcgccaggcgtcgaacttctcgtcccattccttgtgggcttccagaccgcgctctgcgaccttgcgggcgtgggcgagggcttcctcgtcaacgtggaaggactcttcggggtcgtaaccgagcagcttcttgaggccggcgacggcttcggcgcccagcttggagccatgggaggacgggtcgttggtcttgcccggggtcggccatgcgatcagggagtggaccttgatgagcttcggctggtcaggcgcggccttctcggccttggcgatgacctcggccagaccctcgatgtcctccttgtaggagccgtcgggctggatgaagctgaattcgtcggtgtaccagccgtaggcctggaagcgcttgagcacgtcctcggccagcaccaggttggtgtcgccttcgatctggatgcggttggcatcgaagattacggtgatgttgccgagcttctggttggcggcaagagcggcggcttcgccggagatgccttcctcgatgtcgccttcaccgcagatggcccagatcttgtggtagaacggggactcttccttcggggtctccgggtcgagcaggccgcgctggaagcgttcgccgtaggcgaagccgatggcggaggcaaagccctgacccagcgggccggtggtcatttcgatgcctggggtcagaccgtactcggggtggcccggggtgcgggtgtccgcgccgccgcggaagtgcttgaggtcgtccagagtgacgccgtagccggagaagtacagctggacgtactgggtgagcgaagcgtggccaccagaaaggatgaagcgatcgcggccttcccagttggggtcgttcggatcatgcttgatgaaatgctggtagagggtgtaggcgacgggcgccagggagacgggggaaccggggtggccgcttccagccttctcaaccgcgtcggccgacaggaccttggccatgttgatggcgcgctcgtccagctcggtctccttgaattcggtcatggatgtactttccttccaatacttcgggcaccacgcatttcggcttatgccgcgccatgcatgccctcacattgcaatcccatactaacgttgtgaacagacttagtggttcgcttttggcgtgttttggtagattatgttatgttagcgctcacaacttgtgactgactcatgccggcggctgcgtcatgaaatcatctgataacgaacgcgttagcactcaagggcaaagagtgctaatactgggtacgtcatcgttcgaccgacccactccgggagtgtcgggcgtgtcgtgaatacgggaaagccgtgaaggcgtgaatgccggggaagaacaggaggagacatggcgcaaccacgacgcatggtggtgcttcgcgccatcgtggaggattacattcgatcccaggagccgataggatcggccgctctgacgaagaagcacgacctcggcgtcagctcggcgaccatccgcaacgacatggcgtccctcgaggaagaggggtatctcatccagccccacacgtcctcgggccgcatcccgacggagaagggctaccggtacttcgtggaccgcctgtccaccgtcgtccccctctccgacgcgcagcgcaagggaatcgcggcgttcctgtccggatccgtcagcctgcaggacacgttgcagcgcgcggccagactgctttcccacataaccggtcaggtggccgtggtcgcctccccgtccccggccaaggcgaaggtgctgcgcgtgcagatcgtccccgtctcatccacgttgctgctgatcgtggtcatcaccgacgccggcaacgtcgcacagcatacgctcgccctgtcgccccagccgacggatatcacgctcgccgacgtgggatccgtcgtgaacggagcctgcctcgggctcaccttcgcgcaggctgccgaacgggtccgttccctcaagtcgtcgcggcgggaatccgttgcgctgcttgaagggctggcgcaggtgttcgaggcgatgggagacaacgaaaggtccagtgaactgtatatggccggcgcgtcgcacctggcccatcggcgtgacatcgccgacatggcgccgctgttcgacgcgctggaggagcagatcgtgctgatgaaactcatgagcgcgctttcggaggacaccgacgcctatggggtcggtgtagccattggttcggagacgcacacgccggaattgctgcatgcttcggtggtcaccagcggctacggaaactcgccggcatcccggacggaaccggcggaatcggacgcgggacatgaagacggcggtggatccgcgcttggcggcgcggcgcatgccaatacggctcagaccggcatggcgagggagctccgcataacggatgacgccgacgcggagcccggcaaaatggacgatggcgatagcgtcgcgatgccatctctcgacggcgggtcgggcgggtcgggcgaatccagcgggccggtggccttcgtcggctccatcggaccgacgcacatggactatgccgcgaccatagccgccgtacgtgccgtggcccggtacctgacccgtgcgatatcgtcgtacgatgacggcgacggcaactgactgagccttatggcacaatagctccccgaacaccaacaagaaagaacgagcagtggcagattactacgaggtgctgggcgtcgacaagtcggccagcgacgatgagatcaaaaaagcgtatcgcaagatgagccgcaagtatcatcccgatatcgccggccccgaatacgaagacaagttcaaggaagtgaacaacgcctacgcggtgctctccgaccccgacaagcgccgcatgtacgattccggcgtggaccccaacgaccccaatgcgggcggattcggcggcgcatcgggattcggcatgggtgacatgtccgacatcttcggccagttcttcggaggagcgttcagcggcggctcgcagggccccgttccccgcacccagccgggtcgcgacgcgctggcgagcgccaccatcgatcttaagacggcggtcttcggcggcaccacgcacatcaagatcaatactttcggtctgtgccagcagtgcgggggctcgggcaccgccaacggttctcagcccaccacctgcccggactgccacggccaggggttccggcagaaggtcgtgcgcacgatgctcggccagatgatgacctccgcgccctgcgagcggtgcgaggggcacggaacggtgatctccgacccctgcccgtcctgcatggggcacggccgcgtccggacatcgcgcgaggtggggatctcggttcccgctggcatcgcggacgaatcgcgcatacgcctcgcccatcagggcgaggtcggtgaaggcggcggcgcggccggcgacttgtacgtcgacgtgcgcatcaaggccgacaagcgcttcacccgcagcggcgacgacctgcattgctggattcaggtgccgatgagctgggccgcattgggtcacgacatggagatcgacaccttcgacggcaagcagaaggtgaccgtgccggccggatgccagcccgaggagacgattgtcctgaagaacctgggcgtcaccaagctgcgccaatccggcgagcgcggcgatctcgtcgcccatgtcaacgtgcacatcccgaccaagctgaccgactcggagcgttcgctcatcgagcagttcgcggccagccacgacgcctcggcgtcgcacgtcgcgcagagctcgcgccccgccaccggcagccagcgcaaggggtttttcagtaagttgaaggacgcgctgagctgaattcggctatgctcgtccatgctcggcagcgctcgtcattcgcgccgatcagcggcttcggcattgaaaagggctttcagacactctggtctgaaagccctttcccgtacatatgcctcttgttgcgggctcctgctacttgagcagcgagcggcacatggaacggtattcgctgatgtacccgccgccgaagaacacgcagtgcccggcgatcggatacagttgccacagcgtcgtgcgctcctgccatccggccttcagcggatgcacgctctggtaaccgtccatgatctcggtcagatagctcatgccgaacaggtgcagcatcgcgagatcctcctcgcgatgaccgccgtgtgcggccgggtcgatcagcacggcctcgcacgagcctcggtcgtcggcccacatcacgttgccgctccacaggtcaccgtgcactcgtgccggcttgtcctgcgccgcacgccccagaaggtcgggcatcgcgtcgatgacgcggttcgtcaggtccatgtcggcctgggtcagctctccgcgacgcatgcccagttcgaccatcgggaccagccgcccctgcgcgaaataggtgatcgggtcatcccacgcgccggtcgccatcggcaccggatcctgcagcggcccgaaatagcaggtgccgtcatatccggccggagccgagccgaagtggtccgtccccgcgtcatgcatccgcgccagggccgcgccgaaatcgtgggccgccttggccgtgggggagcagggggatacgcgttcgatgtcgagaaaatccttgccccattcgtagacgtccaccacgcggggtccgccctgcgcctgcgcctcgccgagccattgcaggccgcggccctcgcactcgaaaaagccctgcggcgcccacatccttgacttgcggtatcgtgccataattcctccccgtgacgtcccgactatccacccctcattgtgggttttctgtacgacaatacgatgtttgacacattcttaggggacgctgagtacccttgtccacggtaaaggacggacaatcattcaagagggatcatgaatttcttccaagcgattattctgggaatcgtgcaggcgctcaccgagtattttccggtgtcgtccagcgcgcatatccgcatcatcggagatctgatgctgggcgcggatcccggcgcggcattcaccgccatcatccagatcggcaccgagctcgcggtgatcctgtatttccgtcgtgacatcatcaacatcctgtcgcactggttcggatgcctgttcggcaagaacggcccggactggcgtgcgcgcatgggtcgcggcgacaagtacgcgacgctcggatggaacgtcatcgtcggctcgattccgatcatcatcctcggcttcacgctgcagaacatcatcgagacgtcgctgcgcaacctgtggatcaccgttaccgtgctgttcctgttcggtctgctgctgtggatcgtggacgcccgctcccggcagatcaagaccatggacgacatgaactatcgcgacgccttcctgttcggcctcggccagtcgatggcgctcatccccggcgtgtcccgctccggcggcaccatcaccgtcggccgtgcgctgggatacacgcgcgaatcggccgtgcgcctgagcttcctcatggccatccccgcggtgttcggctccggcctgctcgaagcggtcaaggccgtgaagaacgccgggaccgatcgcatgttccccggctggattccgaccatcatcgcgatgatcatcagcttcctgctcggctacatcgtcatcatcgggttcctgaagttcgtctccacgttctcgtacaaggcgttctccatctatcgcatcggcctgtcggtgatcgtcgcgctgctgctgctgttcggcgccctgaagccgtatgagccggtgaaggccgccagcgcggccagcgtcgtcaatccggtcagcatcgtcaccgtggagcaatccgcagccgcggtcagatgacggcggcagggtgacgttgcagtcatcgctgtaacgtcacgaaacacgcttggatggcgtccggttcgcggcttcgcggaacggacgccatttgcgttgccgtgagattatgcggcccgcgtcacttgccgcgactgcgcaggaaggcctccgcctcgcgcaccagctgttccgcggccggagcgccgaagcgcgccacctgatcggctttctcctgcatgtcgtaatcatgctcaaggtgtttcacgtattgggcgaggtcgtcgttgcagcgcgtcagcaccgaagcctgcgccttccactgttcggccttgccggcgaggtcgcccggatccagctcgacgccgatgcggtcggacaatgccgcgagcatctgcatggtggcctgcgcgcattcgtcgctgccgaggtattgcgggacggacacccacatcgacgtggtcgagaatccctcctcgcatgccatgcaatccagcacggtcgggatgccgacagggccgctgtattcccggtccatgtcgcactgacactgctggtcgctgatgtcgagcggcagcgcgcgcgtgtgcgggcagtcggcgaacatggcgcccatggtcacgatatggcggacgtcaagctcctcggcgatgcgcatgctttgacggcagtagtcgttccaacggtagttgggctcgggcgcgatctgcgcatacagggtcgtcgagggcgccacgtcgatggcgtagaacgtcgtctgcggccataggatccggcgtcggcccgtcaccttgcacagcatcgggcgcgcgacctggtagtcgtagtacccatcgcagcggatgtggcggatctcgcgtgaatcgtagcgcgacacgagatgccggatgacgttggtggctgcctggcatgcgtcgttccagccttcgaatgcggcgatcatcaccggttcatgcgctttcgcttcttcactcatatcaaccaatgtaacggttcctcgcagttggtgcaggcggcttatgccatcagagaatcgcggtatagcaaggcctgtgggtgatcggtcgcaggccgtgacatcgcgcgacacgccggatttggcaaatcccatggttgtcactatagttgctatctgttgcttgacggcatgacgctggtcaaggaaacgcggacatagcttagttggtaaagcgcaaccttgccaaggttgagaccgcgggttcgagtcccgttgtccgctctaaggtccgaagagttgacgacctttgcggtgggttagccaagcggttaggcagcggcctgcaaagccgtatagacgagttcgactctcgtacccacctctcgtttgcatggaatccgtaacatgatggtttccgtcaaatggtacagacccgggcggttggcgcagaggtagcgcacttccctgacacggaaggggtcacaagttcgaatcttgtatcgcccaccatattcctcttatatgtagcgccttcgggtgtttctgcctataacccgtttttaccgtgcctcattgcctccgctggcaggctgatacccggtatctccgcttcgaggggttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctataacccgtttttaccgtgcctcattgcctccgctggcaggctgatacccggtatctccgcttcgaggggttgatctcgcgctctcggaacatctatctgcgtttcaaggggttgcccaaacgcgatatccggagtatgcggggacatcccgcattggaatcatgcggtttccggcccggctctactcgggcaccaacccctcgaaacgcagatagatgtccgaacgagcctgaagcaccccctcgaaacgcaattagactccagaaccccgcccgattgctcatcccgcgttgcattgcccggagtggatgcgttccgcggcccggtcggtgaacgcatccatgcgatactgcttgtgcccggtgctggccgcgtaatcgatgctctgctggatcagggcgcggttcgcgcccatgtacttgaccgcgtagctgttcgtcacgccttcggtgcggttcacgccgttctgcatgatggcctcgggctcgatggtgccgcagcgcatgtggatggcgtggtgggacaactcgtgcctcacgcccgcggccggcgcgtaggtcatgttccagtcgggcatgctgcggttgccgtagatcacgttcggcgtggcagggcagtagaagccgaacgtctcggacttcgtcagcgccttgttgtcgccgtcatcggtgcccgcaaacgccgggcactgtctgaatccctcgtcgatgtcccagctgagcttcatgtccgcgagctccaccagtttctgcgcgctggcggcgttgccactccccagcgagttcgaggctttggcgacgcgctgttccagctcgtcccaggtaggcctgagcgtgattgatttgctgccgtcgaccgtgtacttcttgccatcgttgccggtaacggtcatcgaaacgccgagcgcctgccctttcttaaaccgtgcttcaagggtgtcgacggtggttcggtacgagtcgatcttcgcatccagcgcatcggggtcctcgctggtctcgtccgctgccgccttggcctcgttcacggtgcccagcaacgccgccatgtatcccgtcatgtagtcggtgccgtcctgcgtgtcgggtatccggtattcgctcatgaacatggtgttgttgttgagtatctcgtccttgtaatgatcgagtttgtcggtcacgtaggtcaccatgctctcgtatccgggccactcgtccatgcggtagacggtggcggtcggctcggggtcggcctgattcgggtcggagggagacgcgttgccgtagctgttggtcggctcgttggcaccttggctgatatggttcttcgccaccgtcatgagcccggcggtcacggcgatgaacagcagcgcgggtatgacgattacggcggcgactatcgccgtgatgccgcccgccccgatgcctgttttcctcgggggctgcatcgggcggtactgctggtatggcggcatcgggtacggcgggtatgggggatgggcctgacgatttgtttggcccgtggtgaacggggatgatgccgacgatgatgcgccgttgagcgtcctggaccatggggcgggcgcttcgtatgagccctgtgtcgcacgggcttcaggagtcgggaaagggccgggcgcatacggcccggatgtgggaggccgcgtggctgaagagaatccgtatggggtgtgcggttgtggtgcctggcgctgccgtgatgctcctgtcgggcccgacgcgcctgtgatgggtatcgactcggtcggcattgatatggtcggcactgactcggtcggcgtgccttccctgtatgactcgtattgcggatcgccatagggttcctgcggctgctgttcggtcatgacgtctcctttgcccccgttgcgtcgattatcgcgtgtcggtctgcgttgttcaagtcatgtgctttcgtcgtagccgcggactgcatggcgactcgccgtaatggttgcgctcgccgatgatgtcacgtaaaatgaacatttgttgtttgcgggtgattggcgcagcggctagcgcacttccttcacacggaaggggtcgtaggttcgattcctacatcacccacgatgccggtcttgtatcggtatactgcggacatagcttagttggtaaagcgcaaccttgccaaggttgagaccgcgggttcgagtcccgttgtccgctccatcaatccgctctggtctatggggcttcggatacggtgttttcagcgcccgtacaataccccgctgctcgcttcgcgtttcacctaccggcgtaagagcttcagtcatttaggtaattgccgcagtcctctgctcccaactttgaagcggtactgttaagcccttatcgaaaaaaccgatagcacttccgaaatgttgtttcgtccgctactgtacggtgaatcgatggaatcaagagcggtgccgcacctgtatcaggcgtcgcgtcgtcatgacacgaaaggagatgacatgtccgatacggcatggaattgggtggcgctgggtgccactgttgtgctgtttgcgggtttggcttatctgagtatcaggaagaaagcgggattcagcgtccgcgtgctgatcgcgaccgtactgggcattgtggtcggtatcgcgttcaagggacataccgactatgtggcggcgttcggcagcgtatggtcgaacgcgatcgcggctattgtggtgccgttgctgctgttcagcgtgatcgcggcgatcaccaatctgggagaatcgctcaagctgaggaacatcggtatcaagaccgtggtgttcctgctcatcaatacgtttaccgccgcgctgatcacgctgggattggccctgctgttccgcgtgggcgagggcttcaagttcacgctgcccaccgactaccagcagcgcgaggtgtccgctgtgctcgacacgattgtggcgctgttcccgacgaacctcgtccagaactggtattccaatcaggtcgtgcccgtggtgatcttcgcgatcctcgtggccgtcgcctacaactccgccgccaagaccgccaagggcgccgcggccgtcaaaccgttcaaggcgttcgtggatgccggcaacgtagtgctgtccaaggccacgcagatcgttgtcggattcactccgtacgcggtgctcgcgctgatcgccgccgctgtgagcaacagtgatgtggcggcactgctaccgctggtcaccgtgctcgtggtcgcgtacgtcgcgatgatcctgcagctgttcatcgtgcagccgctcatcctgtccgtcacgacgcgcctgagcccgattccgttcttcaaggcatactggcccaccggcgtggtggcgttcacctccgaaagcagcatcggcacgattcccgtgaccgtgcgcaacctgcgctccaacggcgtgcccggcgatatcgcgtccttcgttgccagtcttggcgcgaacctcggcatgcctggatgcgccggcgtgtggcccgtgctgctcgctgtgttcgcagtgaacgcccagggaatttcgtactcgcccgcccagttcctgttcctggtggtgctcgccctgcttgtgtccatcggcacagtgggcgtgcccggcaccgcgacgatcaccgcgacctcgctgttcgcggcggccggtctgccgatcccgttcatcgcgatcagccagccgatctcgcagatcgtcgatatgggccgcaccgctctcaacgtggccggtgccgccaacacggcggtgatcgtggccgccaccgagaaggacctcgacaaggacctctactatggacgcaaggagttcgaggatgaggacgccagcgaggacgaggacgccgtcgcggccgcgcaaccggaagccaaggcacccgtcgaagcgccggcggcaggcaagccctccggtctcggtgccgtgaagggcgcctcctccgccaacctgctgaacttctctccagcctccgcgctggagggcaccggtgaggaacaatgcggcatcaagccttccagaaagaaggactgatactccgcctccaaggtacgttgccggggccgtcgccatggttctccccatgatcgggaaccgcggcgacggccccgttcgcatgcccggcggccccggccgcggagcatgaacgaggcattgtctgcgcgggttcctatcgttgccactgttgattaccagtccaggcctgcacattggtaacgcgggccccgatagcaaaggacacatcatggcgctaagctccatctccatcacagtcaacggcgaagcgaaggaggtggaagcaaccaccaccggcgtcgagctcttcgcggacgacaaggacatcattgccgtccgcctcaacggcgaactgcgcgacctgtgcacgccgctcagcgacggcgacgcggtcgaacccgtcgcgatcgattccgaagacggcctcggcatcatgcgccactccgccacgcatgtcatggcccaggcggtccaggagctgttcccgaacgtgaagctgggcgtcggcccgatcatcaaggacggcttctactacgacttccaggtcgacgaacccttcaccccggacgacctgaaggcgatcgaaaagcacatgcagcgcatcgtcaagtccgcccagtccttccgccgccgtgtggtcaccgaggaggaggccctcaaggaggagaccgaccagccattcaagatcgagctgatcgaggacaaggaagcgcacctcgacccgtccaccgccaccgaggtctccggcaaggagctgagcttctacgacaacgtcgaccgtgacggcaacaccgtctggaaggacctgtgccgcggaccgcacctgccgaacacccgcttcatcaaggcgttcaagatcgagcgttccgccgccgcctactggcgcggatccgagaagaaccccaccatgcagcgcatctacggcaccgcgtgggccaccaaggaagacctcaaggcctaccagacccgcctggaggaggctgccaagcgcgaccaccgcaagctcggcgccgagatggacctgttctccttcccggaggagatcggacccggtctggccgtgttccaccccaagggcgccgcggtgatcaacgcgatggaggactactcgcgtgagatgcaccgtaagcaccactacagcttcgtgcagaccccgcacatcaccaagggcggcctgtacgagacctccggccacctgcactggtacaaggacggcatgtacccgccgatgcacctggacgaggagtacgacgccgacggcaacatcaccaagccgggcgccgactactacctgaagcccatgaactgcccgatgcacaatctgatcttcaagtcgcgccagcgctcctaccgcgagctgccgctgcgtctgttcgagttcggcaccgtgtaccgttacgagaagtccggcgaggtccacggcctgacccgcgtgcgcggtctgactcaggacgactcccacatctactgcacccgcgagcagatgaaggacgagctgaccagcctgctgaccttcgtgctgaacctgctcaaggacttcggcctgtctgacttctaccttgagctgtccaccaaggatccggacaagtacgtcggttccgacgagatctgggaagaggccacccgcacgctgcgcgaggtcgccgaggcatcccacctcgacctcgtggccgacccgggcggcgccgcgttctacggcccgaagatctccgtgcaggcccgcgacgcgatcggccgtacctggcaggtctcgaccatccagctcgatttcaacctgcccgagcgtttccagctcgaatacatcgcgaaggacggcacccaccagcgtccggtgatgattcatcgtgccctgttcggctccatcgaacgcttcttcgccgtgctgctggagcactatgccggtgcgttcccggcatggctcgcccccgtgcaggtgctcggcgtgccggtggccgacgagttcgcgccgcatctggccggtttcgtcaagtcgctggaggacgagatggtccgctgcgagatcgactactccgatgaccgcttcgggaagaagatccgcaacgcctccaagtccaaggtgccgttcatcctcatcgtcggcgaagaggatatgaacaacaacgcggtgagcttccgcttccgcgatggcagccagctcaacggcgtgccggtggacgaggcgcgcgagaagattctcgccgtcatcaagaagcgtgcgcaggtcaactccgcggacgacttcgccgccgcattggcataaggtgacgcacgggcccctcgcgcccgttgaagacccccgtcagcaaccgtttcgctgccgacgggggtctttccataagtgatgtcaagactcgctcattttgtgcactatatttacaaaaatgggatgacgtgatatattgacgctggaatgtaaagtcgcggtccattcaataggccggataatggtgtggttcaatagcgagcctgccaggagatacagagaaagagccatcatcccatgaatatcaaacgacgtggcctcgcaagattcatgtcactgatctgcgcatcggcgatgctgctggtgccggcctcatcggccttggcgcagcacaacgcagaggcggcggcagcggcggaatcatccacttccacagtgtccaacctcgcgaccatggcgacggtcaccgcgtccggtcgcgaagtcagttccggattcgggccggaactggccgccgacaaccaggatctgccggacaaccccaccgacaaaagcgtgcacaacgcatccggcgcctcgcgctggagcgccgacagggggagcggcccctggtggctggcctacgaattccccggcgaagcgacgatttccagtgtgaacatcgcctggggcaacacctatgcgacgaattactccatccagacttccgatgacggctccaactggaccgatgtgaagacgggactcaaggcgacggcacaggcgcaatgggtcaaaaccacattcgacacgccgatcaaaacccggcacatccgcatgatcgcgaccacgaagagccaatcctggtcgctttccgtgtgggagatgcgcacgatggggaccatctcggcagtcgccaccgacccgttgagccggctcaccccgaggccgctatatgcgcaatccgctgacggagaggcgtttgaacttaagaagaacacctgcgtgtccgtgagcgacggcagcctcctgcctgcggttgacgtcatgcgtgacgagctcggcacctcgtacggcctgaaactcgccgaaggcacgaactgcccgatcaccttcacccttgacgagaacctagacgtcaccggtcacgtcggttccgcccagtcgatcaccgccgatgaggcctacacgatcgtctccgacgccgactcggtcaccgtcaaggcccgcagcgccaccgcgggcatatgggcggcgcagacgttgctgcagctgatcggtccgtggacgaactccacggtgaagcttgccgatgtcgctttcatcccggccgtcaacatcgccgacgccccgcgttaccagtggcgcggcgtgctggtcgacccggcgcgttccttctacccgctcgatgagatgaagcagatgatcgacgtgatgtcggcctacaagatgaacacgctgcacctgcacctgagcgaggacgagggcttccgcgtcgagatcaccaatgacgggcgtgcggacggcgatacgaccgactacacgcagctcgcgatcaagtccggcgccatcagctaccagtccgcgtggaccagcaactggtccccggcacaggacgggcgcaccggctactggacgcagagcgagttcatcgaactggtcgcctacgccgccgatcacggcatcgccatcgtgcccgagatcgacggtcccggacattccttcagcctgctgcacggccttgccgagctcaacaccggcaactccaacccgaagcctgcggccggcgaggacacccccgccttcatccagtctgcgcagggcaggagcagcctcgcgactgacgccgacatcacctacaccgtgctggggcatatcatggaccagctcgacggcatgatcgacaagggcatcaaggcgtccaccatgcctgcgtccgagctcaaacgcatgtacttccacctgggcggcgatgagctgttcctcagcggcggcgccggcaacaagacggaacgtctacaggagtatctcggacggtccggagcgctggtcaaggaacgtgacaagaccaccatcgtgtggaacgacggcctcgacgcggttgaccagatccccgaaggatccgtggtgcagcattggaccggcaacgcagccaacaatgccagcatccagaagctgctcaaccagcgcaacggcaagatcatcatgtcgccggccggcaacacctacttcccgcagcgtcccggcaccgagaccactggcgtgacctgggcgtgcggcgcctgcacgaccagcaacttctaccagtggaacccgacctcatccgccggcaccaccgaggacaaggttctgggcgtcgaggatgcgctgtggagcgagcacctgcgttctctcaacgacgccgaattcctgatgtacacccgcatgatggcgaccgccgaggtcggctggacccagcagaaccgcaaggattacgacaactggaacaagcgcgtcggcgacatcgccatcgacctgatgaaccgtggcgccaacttccacaaggccactgaggtgaccagctggaagggttcgtacgcggctgtcgacgcggccgagcagaaggtgaccgacggcaaggtgcttgtcggacggtacgccgaacccggcctgaccggcaccgatggcctgagcttcactgccacgtacacggccgagggcggtaccgcggtcaatctgccggtgacaccggacatgaagcagacctacagccaacagcagctgaagaacggtcgtctcgtcgtcaacggggcgcacatgaactccatcgtcgacgtgtacgtcaccttgccgtccgacgtgctcgcggccgacagcgaggccgtaggccgtctcgacgtctccgtgtcctcctccacctacccgatcccttcggattcctcgatgagcatcgctatcaaggacggtaaggtgactcagacttggaccggcgacgagcgtccgacgcctgatccggatcccgaaccggaggtgacggtcgtctccataaaggcttcgacctcgcagtccgacgtgaaggtcggtgatacgttcgatccgtcgaaggtgaaggtggtcgccaccaagagcgacaagacgaccgccgtgctcgcagccgcggattacacgatcgcggtgaccgacaaggacggcaacgcaatcgatgtgaccaagccgttcgaggccgccggggatttgaccgtgaccgtggcactgaaggatgacggttcgatcaaggattcgttcacgatgaccgtcactgacaagggcacggtcgatcctgatcccgatccgacccccaagccgaatccggacccgcagaagccgtccggcgacaacaagccccagatcaagcccgaaggcggaaagcccggtgatgtcgtcgccgagaccggtgccagtgtctctggcgccgcactggccgcgatgatctgcgcggcaggtgccatcgtgatgcttgcggttcgccgtcagcgtcgctgattcgaatcggaacctctgaccaatgaacgaggcctccgccgtacatttcacggcggaggcctcgccgtattgccggcccggcaggcgtgcgcagctccatcatcgtccgtcatcccgcgaaagtcccatttctgtgtcatcagatgggactttcggcggtgcctgcggttcctcttgcggcgtaatgaccggcagcggcagaacccaggactgccgttgtcgtcttgccgctttatcatagtgacgtttgtcagtatccgtatacctgtaggagcattatgtcagggcattccaagtgggcgactaccaagcacaagaaggccgccattgacgccaagcgcggcaagctcttcgccaagctcatcaagaacatcgagatcgcggcccgtatgggcggcggcgacccggatggcaacccgtcgctgtacgacgccatctacaaggccaagaaagcgtccatgccggccgacaacatcaagcgcgccgtcaagcgcggctctggtgaagaagccggtggcgccaactacgaggacatcgtgtacgagggctacgcgcctgccggcgtcggcctgatcatcgagtgcctgaccgacaaccgcaaccgcgccgccgccgaagtccgttccaccctgaccaagggcaacggctcgctggccaccagcggttccgtcagcttcaacttcgagcgtaagggccagatcgaggttccgagcgagggcgtcgacttcgacgacctgttcgagaaggccggcgacgccggtgcggaagacgtgatcgacgacggcgacgtgttcaccgtgatcaccgatccctccgatctgcatacaatccgcaaggctctgcaggactctggtttcgactacgactccgccgatatggtcatgcgcccgaagaacgaggtgtcgctcagccttgaggacgcccagaaggtctccaagctcatcgacaacctcgatgacctggacgatgtgcagaacatctacgccaactggaccgcatccgacgaggtgatggcccagctcgcggacgaggagtaatcccctgtgatcatccttggcgtcgatcccgggctgacacgctgcggggtcggcgtgatcgaagccggcgctaaccgccggctttcgtttatccacgtcgatgtggtgcgttcggatccccatacgtcgcaggacctccgactgctgacgatctacaacgggctgtgctccaaaatggaccgattcattcccgatgcggtgtcgatcgagcgcgtgttcgcccagtcgaaccgcaacaccgtgctgggcaccgcccaggccgcaggaatggccatgctcgccgccgcgcaacgggggattcccgtggcgctgcacacgccgaccgaggcgaagctcgcgatcacgggcaacggcaaggccgagaagatacagatcgaacgcatggtggccaaggtgctggggctgaacacgttgccgcagcccgccgatgccgccgacgcgctgtcgctggcgatatgccatgccctgcgcccgcaaggcgccttgcagggaggcgaacgggaacagcatctgactgcggctcaacggcagtgggcgcaggcggcgcagaaggccgcccgacgcgccggcgtccgcagcggcatgtaatgtgtatcgaacagatgttctgcattatgtggatgggccgtctcgacaccatatcccgcacgacgtgccagttcggggcgggcgcgttcggcatgtgctttcgttatgcgatgcgaggcgaacgagctcgtggcggcccattccgcgtgcggttcggcgaggaaaggacgacgtgatgatcagtacgttaaccgggcgcgtcgagtcggtggaggcatccagcgccgtgatcgaggttcatggcgtcgggtacgaggtccgcatggcggcggccgatcttgcggcgttgcatgccggtcaggaaacgcacgtcttcacctcgctgaccatatcgcaggatgccgtcaccctgttcgggttcctgtcacccgcgtccaaacgcatgttcctgcaattgcagaaggtcagtggcatcgggccgaaggtcgcgctttccctgttgtcgacgctgcctccggaccgtctggccaaggccgtcgcggacggcgacacggcggcattgtccaaggctccgggcctgggcaaaaaaggcgcacagaagatcatccttgaactggcaggccgcatcgacctcgaccagatacggcccgaagccgatgggccgtcggaaagtcgcgaccccggagccaggcaggtgatcgaaggactcgtctctctgggatggcgtccccagaccgcggaggaggccgtacgtcaggcatgcgatgccgcgcccatagccacccccatcagtgcggaggacgtgccgcgggtgctcaaactggcattgtcgtcgctggacagaggaaggtgatattccatgacatccaacatcgacatgcaggatgggcggaccaacaccggcgtctcggaggactccctacgcatggtctccgccaccgcaatcaacgacgagccgatcagcgacgaggaactgcggcctcatgcccttgacggattcgtcgggcagccgcggctcaaggcccagctgcagctgttcctggacgccgcccgcaaacgtgacaccgcccccgaccacatcctgctcgccggccctcccggattgggcaagaccacgttggcgatgatcgtagccaacgagctggaggtgccgattcgcatcacgtccggtccggcaatccagcacgcgggcgacctggcttcgatactcagctcgctggacgcaggggaagtgctgttcatcgacgagatccaccgtcttccgcgcgccgcggaggaactgctgtacatcgccatggaggatttccgcgtcgacgtcatggtgggcaaggggcccggcgcctcgtccatcccgttgacgctgcccagattcaccgtggtgggcgcaaccacccgggagggcatgctgccttctccgctgcgtgcgcgtttcggcttcacggcccatctcgacttctacccccacgatgagctcgaaaagctgatcgagcgatcctccggcgttctgggagtctcattgggagagggggctgccgcggaactcgccctgcgttctcgaggcacgccacgaatcgcgaacaggctgttgcgccgtgtgcgtgactgggcgatcgtgcatgacctgcaagtcgtggacgttgatgacgtgcgcgccgcgcttgcgctctatcagatagactccgagggccttgaccggctggacatcgccgtgctcaacgcgatcgtgcgcaacttcaacggagggcccgtcggcctgaacaacctggccgcgatggtcggcgaggaatcggagaccgtcgaaaccgtatgcgagccgtatctggtccgtgaaggatttctgatccgcactcccaaaggccgggtcgccacgaccaaggcctggtctcatctgggtctggagccacaaggtgaaacgaacgcagaggatgtcagcaagctcttctaacattggttgtttgttgaccgacgtccatagagcattcgttccctactgcaaggagaaatcatgccgcaaggttcatcatcctatctcatcatgatcgttttcatcgtgctgatcggcatcatgatgtggtggcagtcccgcaaggccaagcagcagcagcaaaagatgaaggacttccgctcctcccttgagcccggaaccgaggtaatcaccattggcggcatcatcggcaaggtagtgtccgtggacgaggaatacgaggagatcgtcatcgactccgagggctccctgctgcgcttcaccttccgcgccatcaacaaggagtacacgcgtcccgccttcatccatgatgacgaagtggaggacgcggagcagaccgacgaagccgacgaccaggcccaggtaccggtggacaaggcgctggaatccgccgagaacgcaacgcagtccgacgattccgcgcagaccgcagacgccgagaagtgacgggggagcgcgagaccatgacgcagtctgacatcaccattgagagactggccgatgtcggtgccggtgacgcggcatacctcgtctcgaagattcgcaccataccgggattccccaaagagggcatcaaattccgtgatttcatgccggtgctggcggatggcaaggggctgcgcattctcatgaaggcgctccaggccagccttcccgtcaccgaagactcgttcgacgcggtggcagggctggaggccagagggttcctgttcggccccgccctcgcggccatgctcggcaaggggttcatcgcgatccgcaaggcgggcaagctgccgccggagaccatcgccgaggaatacgatctcgaatacggcaccgaaaaagtggagatcgagacgtcggccatccgtccgggcgatcgggtgctgatcgtcgacgatctcatcgcgaccggcggaacggcgaaggcggccatggatctggtcgaggcggccgggggcacggtcgtcggattcagcttcgtcatggggctgcgaggactcgacggactggacaaactgggcgacaaacccagcagcacactggtgtcgatgccggcgtgacccggcggtgccgtgcgtcgggacgcgccgcacggcaccaatcatcattcgaagaacacatcataggaacgtgaggcgtcgaacatggatctttatgaataccaggcacgagaattgctggaggaacagcatattcccacgccgcgggccgttttcgcccagaactcccacgaggtcgccgaagcggccgatgccatcggatacccgtgcgtgatcaaggcccaggtcaagatcggccatcgcggccaggcgggcggcgtcaagatcgcccacaaccgggacgaagcgatactgctgtccgaatccatcctcccgatgaccatccacggccataaggtcaacggtgtgctcgtcgccgaggcgaagaacatcctgcacgagtactacgtgtcgatatccgtggaccgcacatcgcgggacttcgatgtcctcgccaccgcgaacggcggcaccgaagtcgaggagatcgccaaggaacatccggaatcggtcaagcgtctgcacatcaacgccctcggcgatttcgacatggaggccgccaagcgcatggctggccagatcggcttctaccacgccgacctggatcaggccgccaacatcctgctgcgcatgtggcagtgcttcaaggacaacgacgcgacgctggtggagatcaacccgctcgccaagatcggcgatcccgacgatgaggcgtccaaatcactgtgcgccctcgacgccaagatatcgttggacggcaatgcggcgttccggcacgacgggtggacccgcttcgacgatccgatgcaggccgatccgttcgaggcggcggcggccgaacacgggctgcactacgtgcacctcgacggtcaggtcggcgtgatcggcaacggcgctggattggtcatgagctcgctcgacgccgtctgggacgccggcaaggagcagggcacgaatgtcacgcctgcgaatttcctcgacatcggaggtggcgcgtccgccgcggtgatgagtgacagcctgtctatcgtgctgtccgacccgcaggtggaatccgtgttcatcaacgtctacggcggcatcacctcatgcgagcaggtcgccaagggcatcctgcaggcgttcgaggagctgcacacgtcgaagccgctcgtggtccgcttcgacggcaatgccgcagccgagggcctgcagatcctcgccgcggcgaacaaccccaacctacatgtggaaggcaccatggagcaggccgcagccgaggccgctcgtctggcggcgaacgccaaggcatcgaaggaggccaagcaatgaccgcattcatccaggagggtgctcccgtcatcgtccaaggcatgaccgggcatcagggcatgacacacaccgctcgcatgctccgtgccggtacgaacattgtcggtggcgtcaacccgcgcaaggcgggcagccaagtgacgttcgaggccgcgcgtgagggcagggacgtctccgttccggtgtacgccacgtgcgccgaagccaaggaggcgacgggcgcccaggccagtgtggtcttcgtgccgccacggttcgccaaaggcgccgtggtcgagtccgtcgaagccggaatcgggctcatcgtggtcatcaccgaaggcattcccgttgcggacagcgcctacttcgtcgaactcgcccttcagcgtggcgtgcgcatcatcggaccgaactgccccggcctgctcaccctgccgtcgcaggagaacgagcatggcgtcaacctcggcatcatccccgatggcatcgtgggccgtggtcccatcggactggtctccaagtccggcacactgacctaccagctgatgggcgagctgagcgacatcggcttcaccgcctgcctgggcatcggcggcgaccccatcgtcggcaccacgctgctggaggccttgcaggaattcgagcaggatgccgacacgaaggcagtagtcatgatcggcgaaatcggaggcagcgcggagcaggacgccgcggcatgggccgcagagcacatgaccaagcccgtcgtcgcatacatcgccggattcaccgcgccggaaggcaagcagatgggccatgccggcgccatcgtctccggaggcaagggaaccgcgcaggacaagaaaatcgcgctggaggccgccggtattcccgtcggacgcactcccggtcagaccgcggacctcatgcgcaaggtgctcgccgaacgctcgctggtatgaggaagcgtatccaggcctggctcagggggccgatcatcgccatcggctcgatggcgttgtacgccatcgccctgggctgctttcttgcgctcatgctgctggtcatctcgatggaggaaggtggggaaaacctgtcgtcctcgacgttggacatgacccgcatcgtagtcctgctcagccagggcatcggattcgagaccgactcgctttccctgtccatcatgccgctgctgctcaccgtgctgctgataggcctggtctggtcgttcagccggaagatatgcacggatatccgcgcatacgtcagcggcgtggtggtctggatttttatcaacgtcatgggcacgcagtcgcttcccgtcggattgcttgactggccggctctggtatgcgtcaaatcgtccgtggtgttctcgcttggattcgccggcgccgcgctgtcgaagggcccactctccgggcagctgcgtgaacttatccgtcatcatgtgtccgacggcgtgcgccgcacgatcaggaccggcctgatggtgggtgtcatcatgatgggcgtgtacctggtcatgggactgatcaccgtcatcgtgtggggcgtgctgaaccgttcggccatggacacgctgttcgccgacatcggcatggggaccggctcgcgcatactgacgacgatcgcatcgcttgcatggctgcccaacctgtgcatatgggcggtctcgtggctgttcggtgccggattccacatcggagagcttgcgacattcaccccttggatcgggcaggggcgttcgcttccgcctcttcctgttttcggcctgcttccgcaggcagtcggcgatgaaggcatacggttcgccgtcgtgctgattccgctggttgttggattcgtcgccgggctggcatccatggcgatgaaatccggtttccgcatcatcgtcggcagcgcgtccgatcccctcgaccgcaaggacctgattctcgaactcgcctacccggcgggcgggttctgcctgtcgagcgtggtcatatccctgctgtcgtcggtcatgttcggggtgtcgaacgggtcgctgggaaaggccaggctcaaatacgtcggcgtcgacgtgatgcagtccgcgcaggccgtcggacgtccgagcgccatgggactgtgcatggcctgggtgctggcgctgattggcgtcgccattgttttcgggatacgctggattgcacgaagaacgggggcacaacgagccgcaacaacgcacccgcgtaccatcgtttcccgcaagtccatacaaccaacaaccaagaaggagcacgatgaccaacacgaatcgaccgatacgacgggctctggtgtccgtcttccataaggaaggcatcgaagtactggccgaggccttcatcaaggccggcaccgaagtggtgtccaccggctcgaccgccaagcgcctcgccgaactcggcgtcgccgtcaccgaggtgagcgaggtcaccggattcccggagtgcctcgacggccgtgtcaagacgctcgacccgcacatccacgccggcatcctcgccgacatgaccaaccccgatcacgccgcccagcttgagaagttcggcatcaagcccttcgacctggtcgtcgtcaacttgtacccgttcgccgatacggttcgttccggcgccgacgaggccgcggtcatcgagaagatcgacatcggcggcccgtccatggtgcgtggcgcggcgaagaacagtgccaccgtcgccatcgtcaccgacccggccgactatgcgctcgtcgcggcccgtgtggccaatggtgaaggcttcagtctggaggagcgccgctggctggccggcaaggcgttcgcccacaccgccgcctatgacgctaccatcaacgagtggaccgccaagcactggcccaagcccgccaccgtcgaatccgccgacccggccgaaggcgagaacccggtcaacgaggcgaagttcccggccgcgttcacccgcacctgggaccgcgcgcacacgctgcgctacggcgagaactcccaccagcaggccgccctctacctcgacccgctcgaccgcgacggcttcgcgcacgccgaacagctcggcggcaagccgatgagctacaacaactacgtggacgccgacgccgcatggcgtgccgtgtgggatatggcacccgccatcgccgtggccgtggtcaagcacaacaacccgtgcggcctcgccatcggagccaccgcagccgaggcccacaagaaggcccacgcctgcgatccggtgagcgcctacggcggcgtcatcgcctgcaacaccaccgtcacgttggagatggccgaaagcgttcgcccgatcttcaccgaggtcatcgtcgcccccgcctacgaggacgcggcgcttgaactgctcaagaccaagaagaagaacctgcgcatcctcaaggtggccgagccgccgaagggccacacgcagttccgccagatcgacggcggcctgctcgtgcaggacatggacctcatcaatgccaccggcgacgatccggacgcatggaagctcgtggccggcgaacccgccgatgaggccacgctcaaggacctcgtgttcgcctggcgcgccatccgctgcgtcaagtccaacgccatcctgctcgcgcacgatcaggctacggtcggcatcggtatgggccaggtcaaccgcgtggactcctgccatctggccgtcgatcgcgccaacacgctggccgacggcgccgatcgcgccaccggttcggtcgccgcgtccgacgcgttcttcccgttcgcagatggtgccgagacgctgatgaacgccggtgtaaaggccatcgtgcagcccggcggatccatccgtgacgaggaggtcatcgaggcggccaagaaggccggtgtgacgatgtacctgaccggcacccgtcatttcttccactgatcctccgcccggtcaccgattcacggatcggccgccgaccgtcaagggttcgcggccgatccatcacgataaccaatccccgaggaagctccatgaatcagcatcatccatacgtgtccgaagtccacgagggcaagccggcattcgagtggtgcgtgctcggcgtcgtcatcgtcgccctggtcgtcgccttcctcggatatacgatggccgcgacggtgatcatcgccgtcacggccatcgtcacggccctgctgcgcatcatcatgcgcgagaagagcccttggaaagtccggtcagtcctgttcgacgccattatcggcatcggtttggggctgggactgcttctgttgtatttcgcaccgtcactgttctggattcgttgacggaacctggggcgccgcattgaccgccgcgtccacggcgatgtcatgtgcatccgcctcagcgtccgtcgcctcgtcgatgggcgcatccgcaggcgtcttcggcttgcgtttcgacgccatatcagcgatgatcatgaccagcgccacgatcgccgcggccaggaccggcgccagccagaagatccacaactgctgcagcggctgcgttgaaagaccctgattctgcccgaacagcgcgatgccggtggcgcgggccgggttcagcgcggcaccggtgaccgtataggtcatggccacgccgaggccgtatgcggcgccgatcaccggagcgtacgtcgcattcggcttgccgttcgcatcggtgtgacgcatcgcgaccgcgatgatgatgatcgcggcgatcacctcgacgacgatggccatggagatgccgaagctcaccgatgcgctgctggtggtggcgctcgatacggaaccggtgccatagccgttgacggcgggcgtcagccacgtcttcatggtgacggtctgcgaggtcggcaggatccacctgaccgcgccggccgccgcgatcgctccgaccacctgcacgatgacgtacaggatgccggcgactaccttggtcttgccggtgagtatcgccgccacggtgatggcgggattgaactggcctccggagacacgcccgagcatcgcggtgacgaccgcgtacgccaacgcggtgcccacgacgatgtacgccaggtcaagcccgtagatcgaagtgccgaacgtgcagatcatatagatggcgaagcagacgaggaagctgcctgcaagctccgcgcacacgcgcgccccgatcggataagcgcttggctcggtgttctgttcttcagtcatgatgttgtagtgtcctttttctgatgttgcgggctttgcgacccgccgaacgttgcaagtttaccaacggggggacgatacgatacaatgtattggctgtgttttccctgtgagttcgtccgggagcgcagattcattgtcaatgtccggccacgttgggagaacgatgccaaacgtatattcgcgcgcactcaaagcgcatgacgacaacaacaacgaaggaatccgcctgcagaagatcctcgcgcaagcgggcttcggatcacgccgcaagtgcgagcagatgatcaccgatgggcgtgtcgaggtcgacggggagctggtgaccgaactcggcacccgcgtcgatccgaagaagcagcacatccgtgtggacggctcgcgcgtccacctcaacccgaaccatgtcacgttggcgctcaacaagcccaagaaggtgctcagcgccatggacgacccgaaaggccgctacacgctggccgacatcatcggggacaagtacgagcgcgtgtttcacatgggccgcctcgactacgattccgagggcctgatcctcatgaccaacgacggcgagctgagccagcacgtcatgcacccgaagtacgaagtggagaagacctacatcgccacgattgatggcaagatcggcggcaacgtctgccggcgcctggtgacccagggcgtccagctggatgacggcctggtcaagctggaccattgcgccatcatcgacgccaaccgcgaccagaccatcgtcaaggtggtgctccactccggcaagaaccgtatcgtccgccgcatcttcggcgccatcggatacccggtccgccgtctggtgcgcacccagatcgggccgatcaagctcggtgaccttaagtccggcacctatcgtgtgctgtcccaggtcgaggtccgttccctgcagaaggaggtcgggctgtgatacgagtcgccatcgacggccctgcgggcgtcggaaagtcctccacttcgaaggcgctggcccgccatttcggcttcgcctacctcgataccggcgccatgtaccgcgcatgcgcctggtggtgcctgcatcagggcatcgacctcgacggcgatcaggtggatgagcagcagatcaccgaagcagtcgccgaattcttcaccggcgaccacttcgacatcggcgtcgacccggaccatccgagcatcaccgccgacggcgaggacatcagtgaggccatccgctcctccgaggtctcctcgcacgtgtcgaaggtgtcgaacgtcatcccggtgcgccacgtgctcatcgccgcgcagcgcgcctacattgcgcgcgagtccgcggccgactccttctcgctgggccgcggcatcgtcgcggagggccgtgacatcaccacggtcgtggctcccgatgccgaggtgcgtgtgctgctgaccgcccgggaagaggtgcgtcaggcgcgccgcacggggcaggccgtcgccggcgccggcgtggggggcgaggacgtggccgcccgcgaccgcgccgattccaaggtcaccagcttcctgaccgcggcggacggcgtgaccaccgtcgacaactccgatatggatttccagcagacgctggatgtgctgatcacgctggtcgcggacgcggtcgaagtgcaggagtacgagcagtatgccgccaatctgagcgattacgaactggatgagggcgacgagcagatcatcgccggttcccggtacgggatcgaagacgagtcgccggctcccaaggccgtcggagtgctcgccgtggtcggccgcccgaacgtgggcaagtcgacgctcgtcaaccgcatcctcggccgtcgcgccgcggtcgtcgaagacacgcccggagtgacccgggaccgtgtcagctacgacgcggaatggtccggcaccgaattcaagctcgtcgacaccggcggctgggaggccgacgtcgaaggcatcgaatccgccatcgcctcgcaggcgcagatcgccgtgcagctgtctgacgcggtcatcctcgtcgtggacggccacgtggggctgacggacaccgacgagcgcatcgtcaagatgctgcgggccagcggcaagccggtcacgctcgcggtgaacaaggtcgacgacggggccagcgaatacctgaccgccgagttctggaagcttggcatgggcgagccttacgggatctcggccatgcatggcaggggagtcggcgacctgcttgacgccgcgctggattcgctgcgcaaggcggacaagacctcgggcttcctcacgcctacgcatctgcggcgtgtcgcgctcgtcggccgcccgaacgtgggcaagtcgtcgctgctcaaccagctcgccggcgaacagcgcgccgtggtcaacgacctcgccggcacgacccgcgacccggtcgacgagaccatcgacatcgacggcgaggactggctgtttatcgacaccgccggcatcaagcgtcgactgcacaaggtgtccggtgccgactactactcgtccctgcgcacgcaggccgcaatcgagcgctccgagcttgcgctggtcctgttcgactcgtcccagcccatctccgaccaggatctgaaggtgatgagccaggcggtcgacgccggccgcgcagtggtgctggtgttcaacaagtgggacctgatggacgatttcggccggcagcggctggagcgcctgtggaagaccgagttcaaccgcgtgacgtgggcgcaacgcgtcaacctgtccgcgaagaccggatggcacacgaaccgcctcgccgacgcgatgcgcaacgcactggaatcctgggacaagcgcattcccaccgggcgtctcaacgccttcctcggtcagattcaggccgcgcacccgcatccgctgcgcggaggcaagcagccacgtatcctgttcgccacgcaggcgtccacgcgtccgccgcgcttcgtgatcttcgccaccggattcctggagcacggctaccgccggttccttgagcgctccctgcgcgaggagttcggcttcgaaggcactccgatccagatctccgtcaacatcagggagaagaagcgccgcaagtgacgcggggtctctccctgcacggatgagcgtgcatgcgcggccgtcgcggattcctccgcggcggccgctttcgttgccgggccacgatcccggcccgctccggcccgcggccacgcccagaatgtaggacggaacgcgcggttgtcgtctgccatgaattacagtggcgactgaccgaacgatctataagggagcattatgtcggttttggacgaattggttgccggggcgttggaagaccagcgttcccgcgaatgtgtcgtgtctcttgaggatgtgaggcgggccgctctggccgcgccggcgcctatcgacgcgacgcgatggctcaagcgtccggacggcatccccgtgatcgccgaaatcaagcgcgcctccccatccaaggggcatttgagcgatatccccgacccggcggccctggcccgcgaatacgagcgcggcggtgcgagcgcgatttccgtgctcactgaaggccggcggttcctcggctcgctggacgatttcgacaaggtccgctcggcggttcacattccgctgctgcgcaaggacttcatcgtcaccgactaccagatctacgaggcgcgtgcccacggcgccgacctagtgctgctcatcgtcgccgcgctggacgacgacaagctcgcgcacctgcttgaactcgcccacgagctcggcatggccgtgctcgtcgaaacgcacaccaccgaggagatccgccgcgcggtcgcggccggtgcccggatcatcggcatcaacgcgcgcaatctcaagaacctgaaggttgacgtgaacaaatacgccgaactcgccgaaggactgcccgatgacgtgatccgcgtcgcagagtcgggcgtgttcggttcggtcgaggtcgaggattacggtcgcgccggcgcggatgccgtgctggtgggcgaaggcgtggccaccgccgacgaccatgtggccgccgtacaacgactagtaaaggcaggtcagagagtgaaagcatccgaatcgaccccgttgagcgagcatcagggaccatattggggacggttcggcgggcgatacgtgccggaggcactgatcaccgctctggacgagctggagcgcatctatgatcaggccaaggccgaccccgagttccgtaaggaattcatgacgctgcagcagcggtacgtcggccgcccgagcccgctgacggaagccccgcgattcgccgcgctggtcaaggacaggaccggactcgacgcccgcatcttcttgaagcgcgaggacctcaaccacaccggcgcgcacaagatcaacaacgcgctcggccaggcgttgctcgtcaagcgcatgggcaagacccgcgtgatcgccgagaccggtgccggacagcacggcgtggccaccgccaccgtgtgcgcgatgctagggctcaagtgccgcgtgtacatggggcagatcgacgcccgacgccaggccctcaacgtggcccgcatgcgcatgctgggcgccgaggtcgtcgaagtgacactgggtgacaagattctcaaggatgcaatcaacgaggcgctgcgcgattgggtgaccaacgtcgccgacacgcactacctgctcggcacggtcgccggaccgcacccgttcccggccatggttcgcgacttccagaagatcatcggcgaggaggccaagcagcaacttcaggactggtacggcatcgaccacccggacgcggtgtgcgcgtgcgtcggcggcggatccaacgccatcggcgtgatgaacgcgttcctcgacgacgagcgcgtgaacctgtacggctatgaggcgggcggcaacgggccggcctcgggccatcatgcgatccgtttcgcaccgggcaccggacagctcggcatgttccagggtgccaagagctacctgttggagaccgatgaaggacagactctcgacacgtattcgatttcggccggtctcgattacgcttccgtcggccccgagcacgcttggctcaaggagatcgggcgcgtgaactactcctgggccaccgacgaggaggctatgaacgccttccgcgacctgagccagaccgagggcatcatccccgccatcgagagctcgcatgccgtcgctggcgccttcaaggccgccgttgatctgaaggccaagggatacgacaaggccgtgatgatcgtcaacatctccggccgcggcgacaaggacatggccaccgcgggcaaatggttcggatacctgaccgacgagcaggccgcggcgctcgatatcaccggcgcgcagggcgacaccgtcgcctgaaccggcccgtgaagcagaaggagtttttgattatgacgaatgcagcaaccacgccgtccggacagccgctcggcatcagtcacaagcccagcgcgacggaagccatgttcgaccggctcaaggccgaaaacaagccggccttcatcggatacctgccgtatggcttcccgaaccccgacatctcactcgacgcgctcaggaccatgatcgagcacggcgtcgacgcggtcgagatcggcctgccgtactccgacccggtgatggacggccccgtcatccaggcggccagccagatcgccctgaacaacggggaaagcatcaacggcgtgttcaaggcggtcgagacggtggccaacgccggcggcgtgccactcatcatgagctactggaacctgatctaccattacggcgtcgaacggttcgcctgcgatttcgagaacgccggcggtgccggcctgattacccccgacctcatccccgatgaggctggcgagtggatcgaggcttcggatcgtcacggactcgaccgcatcttcctggtctccccggattcggcctccgaacgtctcgaactggtcgcccgcaacgcacgcggcttcgtctacgcggcatcccgtatgggcgtcaccggcgagcgcgacaccatcagcgcatcgcccgcaacgcttgtcgagcgtgcccgcaacgccggggcgagaaacgtgtgcgtgggtatcggcgtatccaccccggagcagggcgcgaaggtcggcgcctacgccgacggcgtcatcgtcggttctgctctggtgcacaccctgcttgacgacgacaacgccaccgcgaaggcgccgaaggaaggactgcgcgacctggccgccaaggtcgaggcgctgtccgagggcatccacaacgagtcacgctgacacaccccgcgccggcgggctgcctttaccgtgcatccgccggccatggggtagggtagatggcggtaacagcggtctagacaaacgaggcactgcatgaatcttgcgtatatcccctcaccggggttctccaagttctccatcggaccggtgacgatccacatgtatgcgatctgcatcctgacgggaatcatcttcgccgtgtggatcctcaccgtcagatggaagaagaacgggggcaccttcgaccaggtgctggacaccacgctggtcgcagtgccctgcggcctggtcggggcccgtctgtaccactgcatcacgacgcccgacatctacttcccgccaaccggcaacctcatcaacatcctcaaggtgtgggaaggcggcatggccatcttcggcggcatcggggtgggggccttggccgcgttcctgtggtgccgccaccggcgttatccgttcgccctgctggccgattgcatcgcgccggcgctgatggtagcgcaggccatcggacgactgggcaactggttcaaccaggaactgtacggcatgccgaccacgctgccatggggcctcaagctcaacgatgcggacgccatcggcaaaagtgagatctgctacaacggacaggcatgcccgaccggcacgctgttccaccccacgttcctgtacgagatgatctggaacctgatcggcgccgcgattatcgtgtggctcggccacaaactcgtcgacgtgctcaaatccggacagcagttcgccatgtacatgatgtggtacgggcttggacgcacctggatcgaaagcatccgcatcaactattcgacgatcatcctcggcctgcgagtcaacgtgtggaccgcgatcatcgtgttccttgccgggtgcatcctgttcgtcgtgttgtggcgcttcggcagtgagacacgcgatctgacatccagactgcgcgcggtcacggccgacgagatggaacgtcagcgccagctggaggagcgggccgccgcgaaatccggcaagacggccaagaccgcgaagcccgagactcccggcgaaaccgccgagagcgaggtccatcaggactgagcgcccgcatccgtccgaatcaggatatcgcacaagagcatagaaaaccgcaataccataacacacaaacaagaacgtcgtgtaggcgcaagccgtctcgtcgttcttccaccatagaatgagagccatgagcatacaaatcgcacccagcatcctttccgctgatttctgcaacctcgaacgcgacctcaaggccatcgccaacgccgacctcgtgcatgttgacgtgatggaccaccacttcgtgccgaacctcacccttggcgagcccatcgtcaagcgcatctgcgaggtcaccgacctgccggtcgacgtgcacctgatgatcgaggaccccgaccgttgggcccccgaatacgcgaagctcggtgccgcctccgtctcgttccatatgggcgccacccacgcgccggtgcgtctggcccgccagctgcgtgacatgggctgcaaggcatgctttgccgtgcgtcccgccgagccggtcgaaccgattttcgacatcctcgacgagttcgacatggtgctgatcatgaccgtcgaacccggtttcggcggacagaagttcctggacaaccagatggcgaaggttcgtcgcctgcgtgacgagatcacgcgtcggggcctgtccacccatattcaggtcgacggcggcgtcagcccgaagaccgcccacatcgtcgccgaggccggcgccgacgtgctggtcgccggctccgccgtgtacggcgctgagagcccggccctgtccatcgaccagatcagggacaaggccactgccgcataccgcgactgacggcggaaacgcagaacatggcacgcgacggctccgacaccaatgccggaccgcgatcgcggcgacgccgtcgagtgcctcaaccatgcacaatctcaagggacacatatcatgaagacgtttgaatcgctattcgccgaactgtccgagaaggccgtcaccaagcccgaaggctccctgaccgtggacgagctcgccaagggcacgcacttcatcggcaagaagatcatcgaagaggcgggggagacctggattgcggccgaatacgagggcgcggaccgcacggccgaagagatgagccagctgctgtaccatctccaggtcatgatgatcgccaagggtatcaccctggaggacgtttataagcacctgtgacaaacagaccggccggtctggagggagaaacaccatgctcagaatcgcagtgcccaacaagggcatgttgtcggagcccgcttggaacatgctgtccgaggcggggtatcgtctgcgttccaatccgcgtcagctcgtggtggaggacccggacaacgacatcgagctgttctatctgcggccgctcgacatcgccgtgtatgtcggccgcggcaccatcgacgtcggcatcacgggccatgacctgctgctgaactccggcaccgaggccagcgagcacatggagctcggcttcggtgcgtccacgttccgcttcgccgcgccgaacgattccgacttccatacgctgcaggacattcagggcaagcgtgtgggcacgtccttcgacaagctcgtgcacgactatctggtggcgcacggcatcgaggccgagaccatccacctcgacggcgccgtggagtcctcggtgcagctgggcgtggccgacctcatcgccgacgtggtgtccaccggcactacgctgcgcaacgccggcctgcgcatcttcgccgaccccatcatgcactccgaagcggtgctcatccgctccccgcgcctcgaccccgaggacgagcggctcaccatcctcagccgccgcctgcagggtgtgctgaccgcgcagcgctacgtgctgatggactatgacatccccgtcggcaaggtggcggccgccgtcgcggtgacccccggattcgagagcccgaccgtatccccgctgcacgacaagcagtggaatgcggtgcgcgtgatggtgcccaaggcgaaggtcaaccagctgatggacaagctgtacgaggtgggtgcccgggccatcatcgtgaccgcgctgcaggcctcccgcatgtgacgaacggtgttcgacaatggatacacagcagcacgccgacggcggataccgccagaagatcaagcagaagttcaaccaggagtacagccccgagccgagggacatctacttcaccgtgccgaacctcatcagcgtcctgagaatcgcgtccatcccctttatcgcatggctggtcgccgatcaccggatggtgcccgcactgatcgtcctcgccgtttcggccatcaccgacagcctcgacggcatcatcgcgcgcgccttcaatcaggtgagcaagatcgggcagatcctcgatcccatcgccgaccgcctgctgatcatctgcagcgtcctcgcattgggcgtcgccgggatcatcccctggtggatgatcatcatcatcgcggccagggacgcatggatgatgctgctcgtgctgtggcttgctcaatacgattacggcccgctgccggtgcatttcgtcggcaaggccggcactttcatgctgatggtctccatcgtcgcgctgattttctgcgacatctgggtgaaccccttcgtcgggcttctgcacctcgccgcgctggccgccggcatctggggcgtcggactgtattggctcgccggttgcatctacagcaagcagggcatttcactgctggtgaaagagaaacgtgccgatggacgctgatccgatcaagccgctgtcgtttcccgtgccggccgagaacgcgccggtgaaacgtcgcgcggtgttttcggattccgtggcccagtcgcagtcccggcatgtcaggcccgcggaaggcgggcagaccatgccggcccgccgcagacggctgcatgacgattcgctcaagctcatcgacgatctcaccaaccgccccatggatccgctgttctcggattcgaggctcgaccagcgtccgcgctcgcgtctgtcgacgtgggcgacgaagtttctggtgttcgccatgtgcatcgccgtcggtttctacgggtcgctgttcatcgaacggctgcattccgacccgcgcaaggtcgtcaggcaaagccttgccagcgagctgcgcgagacgcgcggccaggccgacacgctcatgaacgaagtcaacaatctgcgcaaccaggtcacggaacgatcgaagaagctgggcggcacgggtgaggattcgacgctggtcaacgacgagatggtcaacgggcttgtcgccgtggaggggccgggcatcagcctgaccctggccgaccccatcgccgccggctccgacggggcatcgacgccacgcgagtccagcggcatgcagattcgcgtggtcaccgacgccgacctgcggctgctggtgcgactgctgtggcaggcgggcgccgagggcatagccatcaacggcaaccggctcggcgtgcagacatcggtgcgcaaggcgggatcgaacattctcgtcggcgtcaccgccgtgaccagcccgtacacaatccaggcgataggggaccgcgacacgctggcctccgcggtcagcaagtccacgcagcgcagtctgtatgattcgttcgcccaggcgggcatataccctcaggtgaataaagagagttcgattacactggaagcggcgccttccggcgaattgtcctatgcaaagaggagcgagtagatggcagcggtactaggtctcatcatcggcgtggtgctcggcgtgttcgtcaagccggatatccccatcattctgcagccgtatcttcccatcatggtggtcgccgcgcttgacgcgctactgggagcggcccgcgcgtacttcgagcgcagcttctccgacaaggtgttcgtcatctcgttcatctcgaacgtggtcaccgcgacgctgctggtgttcctgggcaatcagctgggcgtcggatcccagctgcagacggccgtcatcgtcgtgctgggaatccgtatcttctcgaacgtgtcggcgatccgtcgcttcatcttccgggggtgatgaaccatggtggcgcacaaatcgtctcgtgacgtgctgtcgcagctgcacgagcagcatgcgcaggacaagaagaacgatcgcatggagaccggctcgttccccgtggtgcgcaagaagccgaagcgccccgtcaaggacggctcggcgcgcatgcgcctgatgacgagcgtgctcatcctcatcatgtgcgcgctgctgggatacgggtacatgatccagatcaacaacgccgacgccacatacgagacgctgagcgaggacgagctgaccaggctgatcagcgagaccggcacacaggtgcagaacctggagcagcgcaagtcggagctgaccaatcagctgggatcgctcaaggccgcggcgaacaagacgcaggaggcggagcgcatcgccaagcagaacgaggagaccaacggcatcctcgccggtcgtttgcccgcgacgggcaagggcgtgtcgatcagcatctcccaagggtcgaagacgaagatcgacgcggcgacgatgtacaaactcatcgaggaactgcgcaacgcaggcgccgaggtgatggccatcaacagcgtgcgtgtcgtgacgaaaacctatgtcagcgacacggacgacggcctggaatgcgacggtgtcgcgctgaacgcgccgtatcggatcctggccatcggcgatccccagaaccttcagaacgccgtcaatatcgcgggtggcgtgggttcgagtctgaaggtgaagtacggcgcgacggtgagcgtgacgtcctcggattcgattaccatcagccaaattcgcaagtcaaccgacaatacgtatgcaagggctgtagaatagcgtttatgacagatccgattccaagtgcaggcgagacgaccatcattggtctgcccgccatccagattcccatcaccaccacaggtgaccgtcccctcacgcaggaggacatcgaaaccatcgcgcggctcgcaccgggcaccgcactgctcatctcgaccagaggcgccgtttccgggtcccgctacctgctcgatgaggacgaggtgacggtcgggcgcgactcccgcgccgacatcctgctggacgattcgacggtatcccgttcccatgccgtgttccgccgcgtcggcgacacattcgcggtatacgattccggcagcctcaacggcacctatgtgaaccgccagcgggtggaccatcagcagctgcgcaacggcgacgagatcatgatcggtaagttccgtctggttttcttcaccaaatccgccgttatcgcgtgatgatgcgaagccgtgcgcgttagactgggacggtacgacattcatgtgatcgtgcatgtgccggttcggcgcatgcacaggacgggggagtgcgatggctgagcagacagggagccagacggccgggctgcatctggtcgtgccgctggagcagaggctcgatctcggtgcgtccgacgccgtgcagggggagctgttcgtcgacgaaggcgccagccgcccgacacggggctaccgtggtacggtggcttccaaggtcgccggcatcacgtaccgtcagctggactattgggcgcgcaagcagatcgtcgaaccatcgatcaccccatctcacggatcggggtcgaggcggctgtactccttcaaggacgtggtgattctcgcggtgtccaagaagctgctggatgcaggcgtgaacctgcagaacgtcactacggccatcgggttcctgatgcagcgcgatgtcgaccagcttgagcatgtcaccatcatgtgcgatggggaagaggtgcatgaatgcaccaccagcgaccagatgatcgcactgctgcagagcggcaaggccgtgttcggcgtgtccgtcggctcgctgtggcatcagattcatgacgcgctggagaccgaggactacgtcgatctgcagtcgtcctcggcgaacgtcggctccgcagggtcgggacgtgtcgccggtcggccaatcgacgagcttactgccatgcgcatgcgcaggaagattgccgcccagcgtgccgcacgcgaggcggcataaccggaggctggcgtatggatgagctgcttccgctgttgttgtgggtgttcgccgtcgtgtggatgctctcggtgtgcggcatctgcattgtgagaagccggttcggcacgggggagaggcaccccgaggtgaaccccgtcagctggaatgtggtgctggcccagatggtgtccgtgctgttcgcgggcatccccttcatggtgtatctcatggcgagcgaggaactgtcccccgcattccacgatttctacaccgaccacttggtgatcggcgcggcgatagtcatcgcgctggtttttgtggagctgttgctgatgggtatccaggcgcatcgtgcgcatctcaccgaagtcgaccgtgtggtccgcggcgccacgcataccgaggcgtgacgcatgcgtctgtgagacgagaatatatcgttatggattggggtttgccatcatatggcaaaccccaatccataacgatatctggccgtacgttcaccgctgcaagtgttatagattacgatgaatgcgttcgtaccaagagcatccggcgtcagtttcgtcgcgtccaattcgatgttccatgatcccgagctgtcggtttggaacgtgatgggcagttcccccaacaaagtgtctccctgcacctcgttgtcgtcgttgccgaacttgacctctacgaccggcatgttgaccgtctgcttgctggtgatgatgcatgagaagtcatcgaacgcgttcatgggcgcgcgcctgctcatggaccgcgcgcacgagtacgacaggctcgacgaggccttcctcgccgacctccggctcatcctcatcgccacctacctgaaaaacacagccaaaatctgcacgaagatatctttatccggcgaaagtcccataatcacgtcttgaaaaataggactttcgccggataaaagtgcaaaagcggaacgtcaactgccccgaagatcataaatctgacataacgtacattatcggataatagtacggtatgtcagatggtcacttcgcaaaataatcattcaccgcggcggcaagctcatcgacggtatcgatgatgcggtatgcgccatgttcctcaagctcaccggcttcggcgtacccccaacggcaacccaggcaatcgagcccgcatgcgacggcgccgtcgacgtcggtccaacggtcgccgaccatcagggcgcggtcaccggcattcgcatcgaatccgatgctgtcgaagcagtatcggatgacctggtccttgtcgatgcgcgaattgtctgtgctggcgccgtagatgccgtcgaccatggtatcgagatggaaatgctcgcacactggctcggcctgatattgcggcttgcacgtggcgattgccaggtgcaagccgtcggcgcgcaatgccgccagctgctcgggaataccggcgtacacgctgttgtacagtcgtccgggaattttgtggccgggattgttcgggtcgtcgaacaccgccttgtccgcatagtattcgcggtatatctccacgccgcggtccagcagctcgtccggcatatggttgcgtctgaacgattcgatgatggccggtccgatgaaccggtgcatctcctgatcgtcgggaaccggcaggctgagctcctcgaacgccttggtggcgcaggcgatgatgcccggatccgattgcgtcaacgtgccgtcaaggtcgagcagcaccacgttcctgcgctgccgggtcgtgacctgatgctgagacatgcctctccccttactcgtagtcgggaatccagccgctgtggtgcatttcaagacgcttgtccagcagcttcttcagttcgtcctcgctgcgacgctccagcagcatgtcccagtgggtcctggtgggcttggcgatctcgttggcctcctcgtcgccgtcgccctcgcggtgcgcgatggtgccgcagcggcattcccactcgtcggggatttcggcgccctcggcgaacggcaggatggtccggtgtcccttgggacagatgtacgccacttcgctgcgtgcggcgaagtccacgttgtcgtcggattccagtgattttgcgccgatgctcataccgcgtaggctgcgttccgccatgacgttcctccttgtggtctttcttgtcgatctttcccgaaaactattatcacgctacaaaacagttcggacgagtcgtatattccccgttccggtcctgccttgccgcctgcgacgattccgtcagccctcgccaatgcccgaataggcgacgatgccgcggttgaccagttccatggccttgtgcgcgacctgggcgaggtgcgcgctcccctgcggcagatacggctctgccgccgagatctgctggaggatgtcggacagacgcttcgcgttgcgcacgaaatcgccgccggtcatgtcccggtcatgcagcacatatgccagactgttgccgctggcccagtcgtacatgatgtcgacgatgccgaagtcgagttgctgcaggtcgtcaagcccttcatcctcgcacagcatcgtgagctgcgcatgcagacggtccaaagattgcgaagtctgggcgaccgggccttggatgccgccgggccagcgcctcggttctcccccggtgcctcccctggcttcgaacaccagggcggagagcaccgcggcgagctgtcgcgccgtcagatggtcgaacatgccgcgttccagcgcttcggcaagcacgatgtcctgctcgctgtagatgtggcgcagcagttgcccctgctcgctcaatcgcatgtccgtcccgtcgcgcttcacgtatcccagctgttccaggatggagcagatacggtcgaactgccgggccacggatccggtgcgcgactcgtacctgtgctgcacccgctcgtattcgcgcatctcgcgaatccagcgatgaccccatttcatatgctgctgcatgtcggggcactgccggcacggatgttcgcggtcgcgcttcttcagggtctcgatagactggtccagctcgcggaacgtgttcttgcgctgctcgtcggtcgggaaggcggtctgcttgagcttgcgccggccgttcttctccaggtcggacagctccatgcggatgcgcatcagagacgcgaaatccccgtactcgcagtggaatgcctgctcatagccgtccaacgcctgtttcagcgtggtcagttgcgattcgagctgccaggccgactcgttggcctcccactgggcgaaggaatggtccagcgtggcgcgagtcgtctcgtagtcgctggtgttgagcagattgacggccatgttgaacgtggcatggaagctcgaatgcagcgggtagacgcgcttgctggacaatgcggcggcggtcgcaggtacgaaatcgcgatggtcgacgacgatcgcgtgtccgatcgtatcgatgccgcgacggccggcgcggccggtcagctgggtgaactcccccggtgtcagcggcacatgcccgctgccgttgaacttctccagcttttcgacgatgacgcagcgcgcaggcatgttgatgcccagcgcgagcgtctccgtcgcgaagaccatctttaccagtccctcttcaaacaggcgttcgactatctgccggaacagcgcgaccatgccggcgtgatgggacgcgaagccctcctccagcgcgaacctgaaccgggagaactgcaacgccttgagatcctcctggctcaactgcccggcgaccatctcgtcgacgatggcgcggatacgccgcatctcgtcctcggtggtgagttccagccccgcattgatgcactgctcgacggcctgatcgcagccgttgcgcgagaatatgaaatagatgccgggaagcatgtcgagatagttgagctcgtcgaccaccgcccagcgcttgggcgtgtggcgctgcgccggcgcgtggccccgcgaatggacgcggccgcgggagcgtgagttctcggcgccgcggcggcgcgccgcctgacggtcaagctgatcgagccggtcgatcaggcgcgcgttgagcttggtggtctgctcgccctgggcgtcacgccggtacaggtcgagcagctccggctcggtgtggtcgtcggcctgcacgagcacatgctgctccagcgggacgggacggcgctcggagaccaccagcttagtgtcgccgcggacggaggatatccaggacgagaaatcctcgacattggagaccgtggcggacaatccgatgacgctgacctgccggggaagatggatgatgacctcctcccagaccgggccgcggaaccggtcggcgaggtaatggacctcgtcgagtatgacgaaccgcagcgcgttgagcgtggtcgaatgctcgtagagcatgttgcgcagtacctcggtcgtcatgacgacgatgtcggcctcggagttgatcgagatgtcgcccgtcagcagcccgacgcggtcggcgccgtaaacggcggtcaggtcatggtacttctggttgctcaacgccttgatcggcgtggtatagaacgccttgacattgcgctcgcgggccagatacatcgcgaagtcggccaccacggtcttgcctgcgcccgtcggggccgcgacgagcacgttctccccccgctccaacgcgtctatcgcgtcctgctggaaatcgtccaggtcgaacggcagcgtggctgcgaaacgcgcggcgacgctcgcgttatgcgcctgacgcttctggaatgcggcataccgctgggaaggcgatgggccgggtcgatccgccgccgaatgattgcgctgatgtttgaccatgcgtgaaaccccgttcgtcacagacggccatcgccgtcggattctcgtattcgcctgcgtgcatgagacgatgccgcgggccgcgccgcagcttgcagccgcagtccgtcaacggttgaaacgtgaccaccgcgcccacgcacgcgcgtgacgttcgcgcttcgcgttccggtgcctgatgacgtcgacctgcgcatcgtcataccggctgatggcgctgttcaacggttgggtgaatgtcggaggggcgagcggctcgcgcacgtccgcaccctgcggaacgtccgcgagctcggagaggggcttgccgagacggctgccgatctccgcaatgccgttcaacgccctgaagccgtgaagggcggcgtacgcgatgcccgccacgatcatcgccagcatgaacagcgagagaatgagccagatccaccagggcatgagatcactcctcttccggggtgtcttcttcacgtgtgccgaggctgagctcgcgctgcgcacgggcgacgatcatcgtgcgcagggtctcgggtgcgaccgcggtgatgtgacgcgcatgggcgatgcagaaggcgacgaaccaggaatcggacgacacgatgatatgcaccttctcgcccgggctgcacggctcgacggtggctcccggcatcgacttgatgaacggaagatccggctgatccgtgatgaacacggccggagtgccgttgtcgaagctccacttgcgcaactcactcaccggcatgtcgggaatgtccacgcgcttgaccggagcgatgacctcggcgtgctcgatgcgggcgagcctgagcacctgccatgtgcggggcttgccgttcgccttgttgatgagctggtcgcgtgagacgaacttgcgccggtcctccggagtggagtccagcacgtcggtccagacggcggcatagtagacgccctcatccacgaagatcttggacggggcgacgaccttgcggcgggtccgtcccgcgccgtccgtgtactccatgtcgagcagcgattcggtggagatcgcgcgcttgacgacggagaagcagtggggctccagctcgtagccggtcaggctcagccaaggggtctcccccggcttgaccagctggcgcagacgctgatacagcgaggccgcctgcgtgcgctgcgcctccggcagcagcggcgaatgcgcgaggtagctcactgaagcggtgagcatgctcaggtattgcggggagatgccggcgaggcgttccagtccgagcgaattcgtcgcggacacgatgccttcggcgtcaagcagcgaccaatcgatgtcgaagaactggcttccggccatctcgccgtcgtcggagaccgtggtcagcgtgttgatgtctttgtggatcacgttgacgtatttcttgagctcgtcatccgacttgggcctgccgatgaagcgttccgcgagttccgcgagggagaattcctcaccgaggtgggcggacaggaagagcatcagacgcagtctgcggtcgacctcactgccggtctggaacgaggtcccggacttcttctggtggtttttcttggggtcggcgtcctccggctcgggggtcgtgctggtgatggtgggcgtggcgaccgtggcgctgccggtatcgtccgacgatctgtcggccagcgccatgtttgacgccgcctggagacgacggttgaaggcgtcgacggcctcctgcgggctgacgatcactgcgccgggatgttcgagcacgaacatggcgaggtcgtcggaatcggtgtaggcgacgttgatgttctctccgtccacgtcgaccgtcgccgcgaaacggcgggagtcgacgacgcgcacgagagccggcggaatcgtctgcgtgccgagtcccggggcgatggaatccaatccgaggccggggatgggcgtctgcggcacccttggcgtggtgcgggacacatgctgcggcgtcacggtctgcgattgcgtggacgatacggaaatcgaacgtgcgagatagttggccgcggcgagaaccggcagatcctcctgctcgaagcgcaggcggatgcgcggctcgtccccgagctgcagtcggtacgacgcgaagtcctgtccctcggacttcgaggagtattcaggctggcgtgactcaatggcgattcccattgccgcgagcttggcgcggtcgcgctggaactgcttggcgaacgcggccttcgcggcctgatcggcaagttccccgtaggagtcggcatatgccttgacgcgctgggcgatttgccgcgaggtcagccactgcggaaacgcagacgacagcacggccaacacatccaactcatgtttgccccatttgtcggaaaagcggcgtctcccgttcgatccctctgccattagtcctcacgtatcgttagcattccaattaaatatgcatgggtatcacgcacaccacatcccatgatagagggttttgttgtgtgcggctcgcattttgtcaaaaataggtattttttcttcgtacggcggacacatcacacccaatcaccgggctcgatgcccatcggtccgacgtattcgccgttgggtacgtaactgggctcgtttctatcctccagacgcgcgtcggcgaacatgatgacgtcacgtccgaatgtccagtctcccttgatgctgaccgagttcgcggcggcgagcgacggcacgttgtaggggaaccgttcgttgaagtcctcgatgttcttgtagtaccgcggatcgaggtcgacgttcgggaaaatgtagctgccgtcctccatctcatacgagtccgtaaggtggaaccgatcggaacgcataatgaacaggtcgttggtcgtcttcaccggcaagaaccgcatgtggtccacctgcacacagatcgcgccttcgaacaggccgatcgccgcgcccatcgcggtctccagctggaccaccgccggggactgggggtcggtcgggtcgacggtcttgttgttgatgatgacgggaagcggcagcacgccgtcatgctcggcgagcatgtcgcgcagcacgtcgatgcgcacccagatgttgttcgtgttgaaatacgggtgcttggcgatgtcttgggccgcgtccttgtcgtcgggatgcacctgcgacatctcccgcaggatcagtcggccggtggccgtgtcgcgcacgatatggccacccttgcggtccgcgtacgtgcgattggcgacctcgaccatgaacggggcgcccgtgtcctcgaaatactgggcgagcgtgcgagacgggcgcgcacccagattgtcggagttcgagatgaacaggtattcgaagccatgctccagcagagtgtccagcaggccggactcccgcagcgtcgagaacaggtcgccgtggccgggcgggcaccactccagatctgggttggccggccaagacgccggcgctccggtggccgcgtcgatcttcggctcctgatgctggatgatctccagagggatgtcggtctgcttgaacttgcgctggtgtcgcagtgccttcatcgtgtcatccgaagtgcggaacgagttcatgaacgtgaccggcagaggcacgttcagcctcgtgcgcgcggtgagcacctgaccgaggatgatgtcgaggaagcgcatctgccgagccttgtggcggcgcaccggcagcagcgacttcgcgcattgcaggcccatcgaggttcccaggccgccgttgagcttgaggaatgcggtcttggcgaacgcgtgcactgccttgtcatgatcgatggtcttgtacacgtcatggaagctccgtacgccgcgcagcggctcgacggcgtcctcgcggatccacgcgctctccttctcgctggcccacacatggtatgcgtgcctgaactgcgagatggcgatctcgctcatgccctgctcgcgcatcttctgcgccgactgctcgaacacatcgtccactgtcatcttctccgtccgtttcagatcttcggcaaacattcctatagtctactcgcgtggtgcttcgttcgccaatcatcccgcagacgtatccattacgggggtatccggggtggggcggctggctgccgcactgcaatggtatgcgcagatggaacttggataagacttggatgggccatgccgtctatgtagctggtgtctccctattgcgaggtgatagtcgggaattacccgagtcgcgacacgcttgttttgcgttattgacgtcatatggtaaattctcttctcggtgcttttcgcactgttcgggccgtagcgcagtttggtagcgcacttgactgggggtcaaggggtcgcgggttcaaatcccgccggcccgacaagaatggcgggatcccaacgattacaagtcgctggaatcccgctttgtcatacttgggggacatgaacttcacgaacacggttccaccacgtgttccgcgatgaaccgcccccgacgcgcatgagcgccaccgcgatacggcgcagccgcctgccggccccgaaggtcccggcacccacattcaacccggcgacgcaccagtcagcacaagacgtgacggcttatcccggacacacattctggcctataacccgtttttaccgtgcctcattgcctccgctggcaggctgatacccggtatctccgcttcgaggggttgatttcgcgctctcggaacatctatctgcgtttcaaggggttgcccaaacgcgatatccggagtatgcggggacatcccgcattggaatcatgcggtttccggcccggctctactcaggcaccaacccctcgaaacgcagatagatgtccgaacgagggcgtggtcggcaaggctatccgcgaatcagaggtgccgcgagaggacatcatcgtcgcgtcgaagctgccgggtcgtcatcaccagtacgatcaggcacgcgtcacgatcgaggagtccgtggcccgcatgggactcgactacatcgacctgtatctgattcattggcccaacccgtcgcagggccagttcgtcgaggcgtggcaggcgctcgtcgacgcgcagaagcagggcatcgtcaagcacatcggcgtcagcaacttcctgccgggtcatatcgacttgctgatccgctccaccggagtcacgccggccgtcaaccgagtagagctgtaccccttcttccagcaggccgggcagcgcgcctacgatcaggcgcatggcaccatcaccgaggcgtggagcccattgggccacgccaaccagatgcttaaggatccgacgatcgtgcgcatcgccgcgatggacaatcccgagggacgttccttcgcgtagaacccgcactggcacgaggaagcctgacggcccgcgccgactgtcacgccttcgccgccgcgtcggcgatgcaccgcaacgcgttgagcgtgcgcggataaccgatatacggcgtgcactgggagatgacggcgatcaggaacctctcgtcgttgcccacgcgcatgttggccaccgcatgggaggtgagctgcggctcgcaccctccctgcgcggccaggaagcacagcgtgatcatctcgcggcggcgcgtgtcgagcccgccgcgcgtgtaatagtcgccgaagcagttgccggccagccacttgttgatgtgacgggtcttctccggccctgattgcgcgaagccttgcatgcgctcgccgaagatgtcgatttgcgcctgctcgcccgcctcggcgcgggtttcgggcgtcgtggtggattgcggttcgagcgggaggtggatgttcttcgcctccagtatctcattggtcttcttcaggaacggcagtacacgtccgaaaccgagatatgcgaccgcctggtagacgatttccttgacctggacggcactgacgccggattcgaacgcgaccggcaccatcagctcgaagtcgtcgagaccctggcatccgatcaacgccgccagaatggccatggagcgtgtggagtcgtccagatcggggtgattcgctcccggctcgttgacgacctcgtcataagcgaagttcgagaacagctcgacgaattccgggtctgtctgtgccagcgtcctgtcatcgttccagaacttgttcatgcggcttttcagctcatcgaacatgatatctccttgcggtttgactgcgatcggcggtcattatgactcgctttgagatgtcacggtagccgcttcgagcgcttgaagtacagcggcggcgacacttccgcgtgtcgtcgccgcagccgtcacgtgagagcccccacggtccagccgtccgccgcgagtgctcgtaccgctcgcgcgcgcgaactcgtgtaacggtatcgcagacgcgtcgccgcgacggctcgacagcgagtagagtggagggacgggcaaagtccgattgatggaaacgatccatgaaccaaggaggatgcatcatgccagggcagacagatgagaacaggctccacgttcttcgtcacgccgccttcacggcgcgagacgtgcgggagatggaacggccactgcttgagaacggtgtccccctgatgaggatggcttccgccgccacagcccatgtcgtcgccgaaatgatcgaagatgagggcgtcgcgttggaggagtcgaacattgtgctgctcgccggcagcggcgacaacggcggcgacgggctgttcgccgcgacgatgctggcgagcaacggcgcttcggtcaccgccgtcgcggtcggccgcacgctgcatggcgagggcttcgccgcattcgtccgcgccggcggcaaggtgctgatcctcgacccggcctccgagattccggggtgcgctgccggcttcagcgctggagaggccggtgaaaggcttcgggccgcggtggaactcgcccagcacgcgcatgtcatcatcgacgcgatgacgggcatcggcctgagcggggcgctgcacggcatcgcgggcacggtcgcatcctcgctgggcgtcgacggcacgatccccgaccgcaccgcccttcccgccggcgactcgaccggcgagttcccgttggtcgtcgcggtggacgtcccctccggcgtgggagtcgacgacggtgccatcacaggcccgtatatccctgccgatgtcacggtcacgttcggcgccctgaagccgtgccttatgctgcctcccgcggcgtacgcctgcggtcgcgtgacgctggtggacttcagtttcgacatcgacggccatatgccgttcgtcgaggcggtttccggcgacaacgcggctgagaccgtccgactcccccggcttgcagacacgaagtacttacgtggcgtgaccggtctgatcaccggctccgaacgataccccggcgccgcggtgctgtcgtgcaaggccgcggccaagacaaacatcggcatgatccgctacatgggtccgcaggtgtgccgtgatatggtgctcgccgcggtcccggaggccgtactcggcaaggggcgcgtgcaggcctgggtcgtgggctccggcgttccgacgggtgagaccgaggatgatgatttccagcgtgagaccatcgccaagcttctgacgcattatgcgctgtcctctgacgatgacccggatgacgatgatgacctcgcctatgatatgcccccgctggtggtcgacgcgggcgctctcgacctgctgcccgacgaggtgccgccgcaggtcgtcatcaccccgcacgccggggagctcgcctcgctgctcaccgccaggggcgaggatgtggatgcgtcggatgtgcagaacgagccattgcattgggcgttgcgggctcatgagctcaccggcgccaccgtgctgctcaaaggtgcggtcacgattgtcgtgggcgagccggccgacaccgatcgggagtcggatgcgcagggtggattcgcggatgatgagcagcatgtgcgtgtggtcgtctccggccgcgccccggcgtggctgggcaccgcgggggcgggcgatgtgctcgccggcatgctgggggcgttgctcgcccaacaggacgacgaggacgtttcggctcccgatgtcgccgcctgcgctgcctacctgcacggatatgcagccgctcaggcgtcgcagtcggatcagcgcgggttcacgcccccgacgatttacggttccgatgaccgtcatctgcgcaccaagctggggcatcccatcgtcgcatccgatgtgatcggcatgattcccgcgactttcgcggaactgctgtcgtaagggcgcgagggcggtcgggatgcggaggccggtatcgcatgatacccggcgtcgatgcatcccgaccgcttgcgcgactgcgccggccggagacctattccgtccggatcaacaaatcagacaccatcctattccccctattccaacgttgaggagcatcatgagcaactcccccatcaccgatgtgattttcgatttctgtggcgttctgctggactggcagacccgcgcatgcctgaccgggcatttcccccaggacacggtggacgcgatatgcgcgcccgacgacccgcacgggttcttccgctatgaggaccgcatggacgccggcgaggacttctctcacatctaccccgacgtggtgcgggagcagggcgaggacatcgctccgatcttcgcctattacatcgaacattacggcgacgccctgccgcgcatgctgcccggcatggaagatctgctgcgcgacctgaagcggcatgggtacggtgtgtggggactgacgaactggtctcatgagacgattcacatcgcgttcgagaaattcccgcagattggcgaactgctgcaggacactgtggtctccggcatcgagaagatgcacaagccgaacgccgacatctacgagctcgcactgcaacgattcggcctcgaagccgggcattgcgtgttcttcgacgacacggcgaagaacatcgtcggggccaacgaggtcggtatccacggtcttctgttcgacaatgctctccaggcccgcgaatcgctcgcttcgctcggtgtgaggctgtaggaataaccggattcggcgctctcaaaactcgcagatatggggcaaaaaacgtcagtcgtccggtgtatctgcgagttttgagagcgtgccttgcgcataccgcaccgcaagcccgccgcatgataaattgagcttatacccccgcacctggtgaaatgccggcaatcccaatgatttcaatggtttcgtccatggtcggccttataaatgctgcttatgacactgctgcagctgaaatacatcgtgaagatcgtcgagtgcggatccatgaacgaggcgtcgcatgaactgtacgtctcccagccggcgttgagctcgtcggtcaaggaactggagaacgagctcggcatcgagatcttcactcgttcctcgcagggcatcgccctgacggtggacggcgccgaattcctcacttacgcccgtcaggtgctcgaccaggccgacctgcttgaggagcgctacaagaacgcgaagccgcgcaagcagctgtgctccgtgtccacgcagcactacatgttcgccgtcgaggcgttcgtcgagatgatcgactccatcaagtccgatgagtacgagttcacgattcgtgagacccgcacgaaggacatcatcaaccaggtcgcgaacatgctttcggagatcggcatcatctacctgtcggacttcaacaaggacgtgatcggcaagatgctgcgcgagaagcatctggagttccatccgctgttccgtgcgccgctgcacgtgttcatctcgcgcaacaacccgctcgccggcaagaagaaggtcacgatggacgacctcaagccgttcccgttcatccagtacgagcagggcgaggagggcagcttcttcttcgccgaggaggccgtgtggccggagtactcccccaagcagatcaacgtgaccgatcgtgcgacgatcctgaacttcatcatcggcctgaacgggtacacggtgtgcaccggcatcgacaacggcgacctgaacaacgagaagatcgtcaccgtgccgttggacaccgacgaaacgatgctggtgggctgggtcaccaatgagcgcgccaaactgtcgaaggccgccgagacgtatatcgagaagctcaagtccgtggttgccgaccacggttacaagctgattgactgaatgcgattatgggctccctgtggcggggagcccgatttcgatccgtgtctcgttcagaagccgcgcacgttgtagtccgcggacaggtcattcatcgcgtgcagcagcttgtatatatagatgaacggtcccactgcgatgagcgagccgaggatgccccacagccagaatgtcgaggcggtgaccgtgacgggcagaccgcgcgcggcctgttcttcgccgatgcggccggatacgcggtgataccacaccagccagccgatgcccagcgtgacccatcccaccaggaagaacatcaggcagtagtgcattgtgtgtttgccgtcgcgtttgaacgcgagcaggttcaggctgtctcccacttcgctcatctgccagatgtcgtagatgctgaacgtgacgagaccgagcagcacgtatttcagcagtccgcgctgcgtacgcaggggtgcgaccggccggggagcatagggctgttgcagctggaactgggggctgcggttgaaagccggattgctgcggctgggcggcatatggcgcgttcggattggtcatggatccttcttcccaagaagaccttcactgttatgggcaaacggcgttgatttaccctgtttcccattacaggtccgtgttcctgaattatgtgatccatcagtggatggcgcattttggcgcactcccgttgccgtcagcgccggtggtcgatgatgcgccggatgccgtcgcggatggactgggggttgcgtggttccccgcccagcgcccggtgcagtgtcaggccttcgatcatcgcgtcgagcagcaccgtggtctcggagtcgaagaaccggcccatgaccttctgtgtcgccgacatccagcggtcactgatgtcgcggaaggacaggtcgcgcgcggcgagcgtgtagaactcaaggttgatgttcaggtcgcgctggttaccgagcatgtctcgttcgatgctcagcgcgatggcgtcgcaggcttcgtcgacggtcgaggcgggctgcatgcgcgcggcgaatttcagtacggaggcccgggcgaactggtcgaacgcctggtgcagcagatcgtgcatgccgtcgaaatagtatgtcatggagccgaggggcacgtgcgcctcggcggcgacgacgcgatgcgaggtgcctgccactccacgtgacgcgatgacgcgcagcgcggcgtcgatgatgtgctgctgtcgctcggggtcgactcgggatgactgggatggcatatcggcaatcatagcattcatgcgggttccatgctgtccccctcgtatatgtacgttcgtacacatcggaaaacgggacctctgcccctcctgcagtcggccattgccggccaatgcgccgctattgctcggaatcgagcaccgaatccacagcggcccagcgccgacgcagcagcatccacaatccgatgatcatggtcaacgctccgagtccgatgccgagcagcccggaggattgtgcggcatgttgcgcgccctcggcctccggcagaacgtcctgcgtgaccacgagcgagagcatcgcgtcgatgaacgtcacgaacttcaccgatgcgtcgacacgtcgcacagctggaaatcgatgtccgggtaggccttgcgagccgcctcgatcatgtccggcgagctgtcgacgccgagaatctcggcgtgcgggtagcgttcgcgcagcacggccgtgctgttgcccggcccgcagccgatatccagcatgcgcttgacgccgccgccgtcctctggcaaaggccacctacaagcgccggataggactgacacgacataatgaatgctactaatatagtagtaattactatataatttcataagtattgctaaaatattagtatgtatgatttgttagatgagccgcttcccggagaagtaatggccggtatcgcccggcgaatgaccatgagacgcaaggaacacggcatgacgcagtccgatctcgcccgaaaatcaggggtgagtctcgggtcgattcgtcgattcgaacaactccatgagatatcactgaacgcactggtcggcatcgccttcgccttggactgcgaacgggatttcgacgcactgttctcccagccgtattaccgctcgatcgatgacgtggtcacagcgacgcgccacggaaaggacatcggatgaccccgctgctggatgtagaccgcgtgcgcgtgctgctcgcaggcaataccgtcggaatgcttaccatgtcaccttcccgcacactggcgttcgcctacgacaagacctggctgacgcacggtttttccatcagcccgataagccttccgctcagagatggcgtgttcgtcgcccaaagagatccgctgaacggcatgttcggcgtgttcgacgacagcatgcccgacggatggggacgactgctgaccgaccgaatgctgcgtcaacatggcatcgacccgtattcggtcggcccgctggcgcgtctatcgatcgtaggtcatggcggcatgggcgcactggaatacgaacccgcttcaacaatcgacgatgacatgcaatcattccccgatctcgactcactcgccgaggaatgcctgaatgtgttgagcgccgacttctcgaatgacctcgaccagctgtttgttcttggcggttcgtcaggcggagcccgcccgaaaatcctcaccacaatcaatggcgaggaatggatcatcaagttcccctcatccgtggacgcacccgatatcggcgagatggaataccacatatcgaatcttgcacgcacttgcggaatcgacatgccggaaaccaggttgttcccttcacgtcgatgcgcaggctattttggcgtcaagcgctttgaccgcataccgctcacgaacggcgaaatcggcaaggtgcacatggtttccgccggcggcctgttggagacttcacaccgcatcgccaatctggactacgccttgctgatgcgattgaccatgcgcatgaccggcggcatcaaggaatgcgaacgattgtatcgactcatgtgtttcaatgtgttcatcggcaatcgcgacgaccacgcgaagaacttctcctacctgcatgatgcggagtccggcgcttggagcctctcccccgcgtacgaccttaccgagaatcccggtatcaacggcgaacacaccactgcggtcaatggtaaggggcgcggcatcaccgttgaggacatggcagacatcggcatgaaagccggcatcccacgaacccggtgcatatcgattgcgcggaacatacgcgaacgcatcgcggatgccggttttaccgtacgcaactgaaggtggaccgaacaccttcgagcggacccgacctcaccggaagtcgattcagcggaaacgttcgtcgagcagggcgtcgcggcgggcgtggtgcggatgcggccgtgcatcgggaagacgcatacgccaagtatttcatcgggcagagctatctggcaccgctggtctcgggcaaggaagtcaacgtttccaacgtcacattcgaggcgggctgccgcaacaactggcatatccatcacaaggcctgtcagattctcaccgccgtgggcgggcgcggctactaccaagagtggggcaaggagccagttgagctcaaccccggcgacgtggtgtacgtggcgccggagaccaagcactggcatggggccgcgccggattccgacttcgcgcatatcgccatcatgaacgcggtggacggtgcctcgaacgagtggctggagtcggtcgaggccgaatacgacgcgttgcgttgaatcgaaggcctgtcgctcgcgctcgtcagaacaccaccgccgacacgatggtcagtgaaagcagcgagaacagcgtgcttacgagcacgaagccgaccgcgtagtcgggcatgttgttcctgcgggcggtgaacatggcgatggtggtcatggtcggcagaccggccaccaacgtgatcatcatgatcatgtcgtgggtgatcggcagctccggcagcgcgccggcggccgcggtgagtagcgcgtacaggcccagcgggaaggcgatcatcttggcgaccagccccacgtacagttcgtagcgtttcagcacgccccaccatttggtcagcgcgaacaggccgcccaggtagatcaacgacatcggcgtggccatgccgccgatggtgcgcagcggagtcaggacgatcgagggaatcctcacgccgagcatgatcagcaccaaggcgagcataaccccgatgaacgcggggttgacgaacctccccagcagattgcgcacgcgcaggccgagcgtgggccggccggcggcgtcgggtgatgcgacggtaccgggttcgggaaccggctcgcacagccatacgccgtacgtccatagcagcgtctgatcgacgatcgacatcaacgcgacgtagatcgcaccctcgtgcggccataacgccatgatgatcggaatgccgatgaacccggcgttgccgaagatcagtgccgcctggaacacgtggctacgcgatccctcaagccgcaacacccacgcgaccaagcggaacacgaggataagcagggcgtacatcaccgcggtcagcagcatgacgccccaattggcctcgacctgcgcgcggtccgcacccgccatggcgttcgagaacaccagcaacgggataagcacgttgagcagcagcgagcacatgccgtcgagcgcggtctggccgtagaagcgaagcctcacgcatccgtatccgaccatcagcatgatgaagaagccgaccaactggccaaccataatagcgaattgacccattgccccttacatctccagcatcgaacgcagccatttgagttcggcggcgatctgcgcgtcatgcacggtgatgatacccttgcggtacgggtcgtcgatctgctcggcgctcaacggattgcccgcgtcacagtagaagagatgcacgtcgtggccgttgagcaaatcgtaacggcggcgcaacaccgcgtcacggtcggttttgtctggcacgacggacaggaaggtaagcacgacggtccaccgggtgaaatcggtgggattgaaaccactggtgcttttaagctcgtcgatcaacttggcgcgccccgcgtccagcagggtgaacacgcgacgctggcgcccgtcgcgaatcgacgcctgttcggagatcaatcccgcttcgacgagcctattggtcgccggataaatcgcgccgtcgctgaatttgcgcgcatacccctgcagctgctccatcttcttgcgcaactcgtaaccgcacatggaacgctccgaaaggaaccccagaatcatcatctcaatcaagctcatgattgtccatcataactcgtttgaacatacccgtggcaccgtctcgtcactccgtcgggcgaggagcagcctctcccggtcgccacgactggagaaacgactcgttttttgccgcatcgtcgcggtaggctttgccgaactcgtcgatgagcccatggaattcctgaaggtcggcgacgtccagcccggtgtccagcaccacgggggcatacgccttatggaacgccgggtatccgtccggcgcatcgaagccgaggaacgcgaacaggcgccgtgcgtaggtgtcggccacgaacgtgcggcgggagaacacgtagagcatcatatcgtcggccgtttcgccgccgatgccgaacaatccgagcagttcggcgcgcagctcggcgtcggtgatgccgtcggctccttcgggagaggcgtcgcaacgctccacataccaacggctcaacgagcgcagggtcttggatttgttgacgtagaagcccgacggccgaatcagctcctgcaaacgctccggctccacgaccgtcaacgcatgggggtcgagcatgctctccgccttcaacgccgcgagcgaacgatccacattgccccacgcggtgttctgcgtgagcaccgcgcccaccatgatctcgaatgtggtgtccgccggccaccatccggtcgggctcagctccgcggacagcgcgcggtacagcgactcgatgtcgccggctgcgggcctgcgccgggattgcctgccattgccgtgcgccgatgccatggtcaacggtacaggcgctcgatgagaatgtcggagacggtgaggcgcgcctcgctgagcaggttgtcgagcaccacgccggcgagatcggcggcgggcatgaacgtgtgctgcttgtcgagtgagacgtagtcgtggctctcgcggtagaagtcggtgtcgatgccgccggggtacacgcccacgacggtgacgctcgaccccttgtacgcggccttgaggctctgtgtataccccttctcaccccatttggtggcgcagtacacggattcgttggcgttgccgcgcgtagcggcggtgctcatcacgttggcgattttgaggttctgttcgtcgcatgccttgagcgtctggacgcaccacagaatcatgcccttgaggcctttgaggcatttgtccacgtcggcggcctcgtaggcggtcggcgtcttgaacgagggctgcccggcattgttgatcagcaggtcgatgtgcccgatcttggcgatctcggccaccgaggctttgacgaagtcctcgtcggacacgtcgccgacgaacccgtggtaagagccccgggggaattcgccggccagttcggtctggcgttcggcgttgaagtcgatgccggcgacgaaccatccgcggtcgatgagctgtcgcgtgagttcatagcccagtccgagggcgctgcccgtcacgatggcgatgcgtttgccgttcgtccgttccatgattcgtatgcctccctgccttcgtcggttcgtcgccgtccggcgatcactgcccgatgccgcgacgaaacgctgttgaaaacgtatgcacaatgcattttatcgaatccgtccgacccgtcgccatcgcctgcgcatggggcggcgaatcagctcaattcgcgtaggatgcggcgcatgaatggaatggtgaccgcgaaggtgagcacgtcggacaccgactgtgccatttccacgccgagcacgccgaacgccaacggcagcaccagtacgatcggcgccagaaacaggccctgccggcacaatgccaggaacgaggcgatgccggtgcggcccatggtctgggtcatcatattgcccatcatgttgaagccattgaacaccaccgtgcagcattgaatgtgcaatgcggacacacccaccgccaccacggccgggtcggagcggaagatctcgaccagatgcggggcgaacatccacagcagcgcggccaacgccacaagcacgccggtggcgagccgcacgcagaaccagtacccttccttgacgcgcgcgtacaggccggcgccgtagttgtatccgcacaccggctggaagccctggccgaggcccacgatcaccgagttggcgcccaacatgatgcgcatcacgatggccatgccggcgatggccgcgtcgccgaacgggttggcggcgatgttcacgcaggtcacggagatcgagcccgcaccctgccgaatcagcgagggcaggccgccgccggccacctcgcgcatgagcagcacatccggccggcagttgcgcaacgacagtttcatcacgccgattctggcgctcatcgtcgtcagaatcgcgaagctcaccgtctggcagatggcggtggccagcccggcgccgaatatcccgagacccgccacgaagatgagcagcggcgcgagcaggaagttcagcagcgcgcccgaaaccaagccgatcatgccgaacgccgactggccttggtagcgcagcagcccgttgagcgcgaacgacccgcatacgcagggcgcggcgaccaacaatggcgtcaggtattgcaccgcgtacggcgcaatcgtgggagtcgaacccagcatgacggccagcggccgcaacgtcagcagcccgatcgcggcgatcgtcagacctgagatcaccgcgcccgcgaagcctacggccagcagccgggatgcccgctcgttgttctgtttgccgagttcgcggctcatcgagttgcccgcgccgttgccgaagaagaagccgagcgcctgcatcacggtcatgatggagaacgcgatgccgatcgcgccggattgcgcggtgcccagctgccctatgaaaaaagtgtcggtcaaattgtaggcggtggtcaccagattggagatcaccgccggcagacacagtctgagaatcaacggtttgaccggctgaccggtcatctgccggtatttcgcgtccgcgctcgcgcgtctgatgccatgaacctgaaccacggacggtcatcctactcgcgcggcatccctcgcagccgtgcatgaccgccatgtgggtcgcccacggatacagtcacctcaggtaccggcccgtgatgctgttcgcatcggccgcgatctgctccggcgtgccggcggcgacgatgcgtccgccgctttcgccgccgcccggccccatgtcgatcacccagtcggcgttggcgatcacgtcgaggtcatgttcgatgaccacgacggtcgcgccggacgccacgagtcggtcgaacacgccgagcagcacccgcacatcgagcggatgcaggccgatggtcggctcgtcgaacacgaacacggcgtgcgactgagccctgcccatttcgctggcaagcttcaggcgttgcgcctcaccgcccgaaagcgccggcgtcggctcgccgagcgtcaggtagcccagacccagatcgtgcagcgtggtcagtcgcgcatgcaccttgcgcatgtcgacggtcacggccaacgcctgatccacgctcatcgccatcagctgcggcagggtgagttcgcgcccgtccttggtcgtgcggtgaatcgcgtcggcttcgggcgcataccgggagccccggcagtcggggcattcgatgtcgatgtcgggcaggaactgcacgtcgagcgaaatcgaaccggtgccgtcgcatgtagggcagcgcagtctgccggtgttgtaggagaagtcgccggccttccaaccgcccgccttggcttcgtcgcttcgggcgaaggcgcggcgcaggtcgtcgtggatgtcggcgtaggtggccactgtggaacgcacgttcgcgccgatcggcgtggcgtcgatgaggttcgcgcgctcgatgccgtcggcgtcaatcgagcgcacatgctcgggcggcttctcccccgcagaccgtgtcttgagcgcgggaatcaacgattcgagcaccatcgtggttttgccggagccggatacgccggtcaccgccaccagacggccgcgcggaatatcaacatccagcggcttgaccgtatgcagctgactggttgtcatgcgaatatgcccaaggtcgaacatatgcgagacgggcatgcacccgcgttcacggacactttcgccatcggccaggaacggcgcgatgcggctgcgtggattcgccgccacgtcgccgaccgtgccctgcgcgatcacatgcccgccttcggcaccggcgaccggacccatttcgatgagatgatcgcatgccttgagcacacgcacatcatggtcgacgaccaccacggagttgccatccgccacgagatcgcgcatcacgccgagcagaccgtccacattcgccgggtgcaggccgatggacggttcgtcgagcacgtagagcacgccggtggtgcggttgcgcacggcgcgggccaattgcacgcgctggcgttcgccggtcgacagggtcgctccggcgcgatcgagcgcgaggtagccgagtccgagctccaacaaccggcgggccacatcgaggaaggattcgcagatgttcgtcgccatcgggcgcatgtcggccccgagcgacccgggcacgctacgcacccagtccaccgccgcgtccaaggtcatcgcgctcgcctcggcgagattcagtccgcgcacccgtggggcgcgcgccgcctcgctgagcctcgtgccgccgcaatccgggcaggttttctcctcgaggaaccgcgccacgcgtttcagccccttctcgtccttggctttggcgagcgcgttctcgacggtgtacacggcgttgaaatacgtgaagtcgagttcggcgaagtcgtcgcctttcttcggcttgtacaggatgtgcttcttgacggccgggccattgaagacgatgtcgcgttctttgggggtgaggtccttgaacggcacgtcggtgcgcacgcccatcgcgccggcgacctgtttcatcaggtcccacatcaacgaaccccatggcagcaccgcgccctcgtcgatgcttttcgattcgtcgggtacgagcgccgcgcggttcgcctcgcgcacgatgccggtgccggcgcaggccgggcatgcgccggccgagttgaaggccaaggattcagcgccgggcgcgtgaaattccttgccgcaattcgcgcagacgatgggcaggccggcggccacgttgagagtcggttcgctgcgtgcgccgcaatgcgggcacacatgtgaggcgagacgtgagaacaacagacgcaggctgttgagcaattcggtcatcgtgccgaaggtggagcgtatgccgggcaccgcgggccgctggtgcagggccagcgcggcgggcacgtgcagtacttcgtccacctgcgcgcggctcgcttgggtgaggcggcggcgcgtgtacgtggacagcgcctccaaatagcgccgtgagccttcggcatacagcacgccgagtgcgagcgagctcttgcccgaaccggagacgccggccacaccgaccagttcgcccagaggcacgtcgacgtcgacattcttgaggttatgcacgcgcgcgccgcgcacctcgatcgactccgggcgcgcatcgtcccgtatccgctgcatattgggcacccccctcactcaagtctcctacgacgcgtcacgtcatcgcccattgtagggacgcaactggccaacaagggacatattcggaccgttgcaagcatctatcttcgttgcaagaggtacattcgacctcctgcagaatgctaactgtcttcagagaggtaccgaatgggaaccctcgagtacaaacgccgtcattgcaacgttgatactcgggttctcatgtttcaggcacctcattgaacgcagatagctctccgcaacaagacaaatgtacctcttccaaaggagaaacatctacgaggcataggcgtacgcctcataggaagcgtacttgggcagaccatagatctggatggagaacgcgcgggattcgcctttggccggtttacgcacatactcactacgccagaacacgaagttccccttctcgtcgcgcaggatgagcgaaatggcgatgcgcgccgcctcgccagccgcagcggcatcttcttgcgcacgaacggccaggctccatcgaggctcaccatttcggtgacgccgtatgcgccgtccgccagcacccgttcgacgcagtaggcgtcgccgagcatcatggcgtgcatggtctgccgttcgtccataatcgtcgtcgtcccccgagcgccgcggtcagtccgcgtcgagcagcgtcggctcgttcatgcggtacagctcgtcatccgtggcgacgcggtcacgaccctgtcgcaggcaccaaatgatgatcgcgtcgcgccgctgcctgcagtacagttcgggcactccggcgagacgcagcagccgttgcgtttcgatgtcgtcgctggcgagcagacgttccagcagttcctcggtcagatgcgccggatcgttgacgttcatgcctcgccttcccttggtatgtcttcacatgccggaccgccgggagatctcccgtcgggagcgtcaatcgactggcccgttcgtttcactgtgaccagactacatggcgcggcggcgtgtgacacggctccggtgccggaatcatccatgcggaaaaacttgccgaaattcagttggcaactgatgacgggccgccgcatcgcccatgacaatggacgatgtcaccagtgtccgcgcataaacgcgcgattgaagagaaagagcagaccatgacgaacccatccgatttcacgccacagccaccccaaggatcagggccgcaacccgtccagcccaatcagcccatgccggtccagcccgcggggaacaccgtgccgccgcagacgccgggcgtcatccccatcgtccccggcactcctaacaatcccaatacacccgacgcacccaatgtccgcaacaagaagacctccaagctggcggtgttcgcgatcatcgtcgccgcggtgttcctgctgatcgccttcatcggtgtgaacagctggagtctgttggcgttcttcgcgctgttgccggtattgttgtccggattcgccgtctacacaacccgcaaggacggcaaggcgcaggggcgcgtgctcgcctgggtcgcggtcggtatcaccgtggtggcgctgatcgtcggcggcgtggatgtcgtacgcaacggcctcgaggccaaggcctctcatgacgccgcggaacaggccgcgaaggaagccgcgaaggccaaatgcgacgcctactcatggccgacgaccgatctggccagtcagctgcccaagccggaatccgccaagggtaagatcgagagggatagctcgagcacgttctacatcaaggtgtgcggcaccgatgccaccgcgtacgacaactatgtcaaggctctgcaggagaagggattcaccgtcgactacttcaggagctcctccgtgttcaacgcgaagaacgccgccggctactcggtcaatatcagatacgattccaagggcgactccatcatggccatttacgtcttcgccccggacgactcctcgacttccggcacatccgggaacggcgctacgcaaaacaacggtgattcgggttccggcgacgcttccaccggatccagctccgacgccgatttcaaggccgcgatggacagctacgagtcgttgatgaacgagtacgccgacttcatggagaagtacaacgccggcgggcacccggcgagcatggcggccgactacgcgaagataatggtcaagtacaacgatgccatgaagaagctcgacgccatcgacgagaattcgctgacccccgaagagcagcagtactatatcgaggttcagacccgcgtgaatcagcgactcgcttcggtgggcgcctcgacggcgcagtagacgcgcgccgggttttcagagaacggttctcaataagaaaagtgcgagccggcgctgaggccaaaacgaacaaggggatgccaggaacgttgcaattccgggcatccccttgatgttcgattgtgctgttttgtgaggaatcctcgcacgtttcttattgagaacgattcgctgatacaaccgcctcgcctagaggcgaatcagcgccttgatgaccttgcgctggtccatcgcctcgtaggcgtcctggatatggtcgaggtcgtactcggcggtgaacacgcgaccggggttgatttcgcccttgagcaccgcatccagcagaccgtcatcgaggtcatagtggcgcacgggagccgggccgcccttgatgccgatgttgccgtagaacgtgccttcggcgctgatctccacgtcgtgcggcaggcccacacgaccaatcacgccaccgcggcgaatcaggccaatcgccgtgtcgaaggactgcttggagcccacgcattcgagcacagcgtcggcgccatagccgccggtcatccccagcaccttgtcgacggcggcctgatcgcgctcgggcacgatatcagtcgcaccgaattcgcgggcgagcgccgcgcgatcctcgtgacggctcatggcaataatgcgcgtggcaccgcgcatcttggcggcaatcacaccgcacaggccaactgcgccatcgcccatgaccacggcggtgtcaccgggcttgacctcggcagaaaccgccgcgtgataaccggtggacatcacatcggaaacggtcagcagcgaagcaagcgtcgcgtcatcgtagtcttccgacgaaccgggcaccttgaccacggtgccgtccgcctccggtacgcgcaggtattcggcctgacaggcggagaagtagccgccgtgagggcatacggattcgaagccagccttgcacaccgggcatttaccgcagctgtacgggaatggcacaaccacgaaatcgccgggcttgacggattcgaccgccgcgccaacctcttcgaccacaccgatggactcgtgacccacctggctgtgtgcggcctgtccgctcagcccacggaagaaccacaaatcagagccacacacgcacgtgcgcaccacgcggatcacgatgtcatcatcctgttcaagcgtcgccttcggcacttcttccacggccatcttgccaggctccacgaaaatcgcggctttcatcatttcggtcatgtcaatcactcctttgttgggaatatctgtctattgtcgtttattgtttgacgtcggtttgcaggcgcttcacctgttcgatgatgttccggttttcttcgatgagctgctgcgcctcctcgtcgcgcccctcagccttagcccgccagtacagtgtcttgaacgatacgtacgcctgctgcattcgaatggattcggctttggcagcgagacgcagggcctgcgcgtcgagcagttccagctggcggcgtgcaccttctcgcccgccctgcgagttggcgaggtatgtgcgcatcgattcgagcggcatgcccgtggctgcgagacaggatactgtggtcagccgttcgagatcggcgtccgaataggcgcgatgccccgaactcgggtcgcgagtgatgggagcgataatgccgatctgctcgtagtagcgcagcgtggactccggaagcccggaaatcatcgacgcctcgcgaatcgtatgccatgtggtcgttgtgctcatatcgtcaactctaaaaacctcaagtacttgaagtaaaacggcgacacgcccataagaaaacgggctacggcaaatgcaatgccgcagcccgtcagcgccggatacgaatcaggcgccgtagcgttcgagatagtcgtcggccgcgctcttgatggcgtcggtcacgtacggctggccgtcggacgtgacgatgttgcgcccggcctcgaagatctcgcgcacattggcgatggcgagcacggggaatccgaattccttctcgaccgcggccaccgcggacaggtcggagtccttcgtcttctccatacggtcgacactcaacaccagaccgacgatgtcgacgtcggcctcggccttgagcttggggatgacctcgcgcaccgcggttcctgcggtcatcacgtcgtcgacgagcagcaccttcatgccgtcggccagctgcgtgccgaccatcatgccaccgtcgccgtggtcctttttctccttgcggtcgaacgtgtagccgacctgcatgccgtggccagaggtcagcgcgatcgcggtggatacggccagcggaatgcccttataagccgggccgaacaccgtgtcgatgtcgtgcggaagacgcccggccttgatctcctcggcgatcttctcggcgtagaacgcacccagcgtggcgatcttgcgaccgtcattgaacgcgccggcgttgatgaaatacggcgattgacgccctgatttcagggtgaagtcgccgaacttcagcgcgttcgattccagcaggaattcggtgaagcgatggtcaagagtcgcgatggtcacaataccctcctcaattgatggttatctccaagtttcccccgctgcgagcttcgccgcaagttcgggccttgaatccaacaggtcgtcgagctcgcgggccacgcgcagtggcgccgtcggatcgtacagggcagccgcgccgacctcgacggcgttcgcgcccgcatacaggtattccagtgccttctcccccgagtcgatgccgccgatgccgatgatcggaatgtcgggcagcgcctgacgcacgcgccacacgtagctcagcgcgatcgggaagatcgccgggccggacacgccgcccgtgcggttcgagaggatcggttcgccggtgcggatgtcgatgcgcatgccgaccagcgtgttgatgaggctcagcgcgtcggcgccggcatccaccgcggctcgtgcgatcgtcgtgatgtcggtgacgttgggcgacagtttcacgatcatcggctttgaggtgatcttgcgcaggcggtcgatcaggcggtgcagcgtctccggatcggttccgacgctcatgccgccgtgattgacgttggggcagctgacgttgatctccagcatgtcagcgcgcgagtcggccagtttcgccacgacttcggcgtactcgtcgtcgctatgcccggcgacattggtgatgaccgtggctccgaggtccttgagcttgggcagctcgtccaccagataatgatccacgccgggattctgcaaccccacggaattcaccatgccggcgggggtctccgccgtgcgcgggccgggattgccctgccatggctctggggacacgcccttggtgcagatggcgcccatctggctcacgtcatagaaccaacggcatgccgcgagctggaacgtcccggacgcggtgccgacggggttcttccattcgacgccggcgacgatggtcgaatgcttccactggtgcggctcatatacgttcgtgtcggtgacggcatccatggtcacgcctcccatccgagctgctgggcggtgaacaccggtccgtcagagcacaccttgctgcgcccggcgaccgtatcgaccacgcaggtcacgcatgtgccgtatccgcatcccatgcgctgctccatgctgagctggcattcgatgccccgcgcggtcgtccacagggccaccgccttcatcatcggcagcgggccgcacgacagcacgaccggctccaggccgccggccgccagttctccttgtgattccatgcggtcaagcaacgtgatgacgttgccttccgactcgtcgatgctcagcgtgcggtgtgcgtaagagctcacgatctcatcggcgaaatgcacgttcctgtagccgaacaccgcggtcgagtgtgactttcccgacgcctgcaaccgttgcgcggcatagatcagcggcggcacacccaggcctccgccgaccagcagatagtgtgcgtcgcgtttcgtgttgaacgggcggccgagcgggccgagcacgtcgatccggtccccggcatgaagacgcgagaactcctgcgtccccttgccgacgacggcgaagatgacgctgaccagatcgtcgcgcacctcactcaccccgaacggacgcggcatcagcatcatgctgtcatggctgaacaggttgacgaactgcgccgccttggcgtgggcggcgatgtatccgtcgcggaacgtcaggcggaatacgccgtccgacagcctgcgcacatcggtgacgtcgacggcatgtcgtccggggaagaaaccggcggaagtcgcttggcttacgacatcatcgaccggcgtgaaggtggctgctggcatacactcctccatccatgtgaccatcagttcaagattacggcatgacgatgccgtgacgcgctcgtggcgcaacgaaatgcggtgattcggcggcgtctcccgaagccgaatcaccgcatgcggttcaccgcctcagcggtacacgttgacgcgcaggtcgtcgcgcatgtcctgcgcggccttgcgggcgcagcgcgccaccaggtcgagcgcgtcgtcggcgctcatgtcctcgcggtattcctcgctcttgcgccatgcgccgatgatgccgcgtgaggagttcacgatggcaccggagccgtcggcgtcgaacatcccggcgacgtcgcccgccttgcctccctgcgcgccgtaccccggcacgaggaagaaagtgtggggcatccgggccctaagcgccttgccctcctgcggatgggtcgcgccgacgaccgcgccgacgtgcgaatacccgtggcgtccgatggtgtcggcgccccagccctccaccaggtccgctgtacgttcgtacagcttctcgccgccggcaagctccagctcctgcaattcggagctggaagggttggacgtccgtacaagaacgaagatgtccttgtcgtgcgccgtggctgcctcgacgaacggcgtgatgccatccgtgccgagataagggttgacggtgacggcatcttcgtgccaggggtcatacaggccgtcgccgtcggtgactccggacagatgaccggcgtatgcggcggccgtggatccgatatcgccgcgcttgatgtcgccgagcacgtacaggccctgctgctgggcgtattcgcaggtcatcgtgtatgtgtcaaccccggccgggccgatcgcctcatacatggcgatctgcggcttgaccgcgggcacgatgtcggcgaccgcatcgatgatcgcccggttgaattcgaaatacgctacggccagacgtgccgcgggcaattcggactcatcctcgatggattcccgcacctcgtcggtgaacgaatccacgacctgcggcgggaccagcgcaggcgtcggatcgagtccgacgacgctggggttctgtgcctcctcaatggcttcgatcaaacgatccatgcgtggtgcttcctttcatgtgtctgtcccgccgctgacggcgggtttgcgggccggttcgaatctgccgtcagtgaatgcggctgaataccagcgtggagccgatgacggtcgccagcggacgcccggtgacatgccatccgccgaagggcgtgttgcgggccttggacaggaacttctcggggtcgacggtccatgcctcggacgtgttgaggatggcgaggtcgacgttctccgggtgctccacggcggacaggtccagagtgcgcttggacgcgcagggggcggtgacgttgagcagcgcggcgacgtcggtcggccggtggcccatcaggcgcgagggcgcgacgctcatcagctcgatgagccgctggtcggagatgtaacccccgtcgaccagcaccttgtggcacacgccgtacgcgcattccagcccgatgatgccattgggcgcctccaggaagccgcgttccttctcctccagcgtgtggggcgcatgatcggtggccagcaggtcgaccgtgccatccgcgatcgcggcaatcgttgcctgacgatccgcggccgatcgcagaggcgggttcatcttcgccagcgtgccgtattcgagcaggtcctcgtcgcacagcgccagatagtgcggcgcggtctcacaggtgattggcagcccttccgccttggccttgcggatcgcgtcgaaggagatggccgtactgacatgctggaagtggatgtgcacgccggtctcgcgcgccttctcgatgtcgcgcgcgacgatcttcagttcggtgtcctccgggattcccggcacgccgagcttgcgggaaaccgggccgtcgttgaccgcaccggtgtcgtgatgctcgcaatgctcgatgagatacaggccgctctccttgacgttggcgagcacctggtcgaggaggccgggcgtcaccgcggccccgtcgtcgctgatggcggtgaccgggtgggccagttgccacgcgtccttgccatccatgtcatggccgtcgagatggcgcagccagtcggccgggtcgctcgcctcgacgccggcgcggtccttggaggcgcatacgcacaggtcgtagcgcaccggcagcgacacgtcgtgcacccgctcgtaatgctgcaggtagtcgatgacgtcgctgcagcctgcgtccagcacctccgcggcaccggatgcgccggccttcaccgcacgcccgtccatggcggggacagtgttcggcatgatgagtacgttcgtgtagccgcccgacgcagccgccctgcagccggacaccatggattccttataggtctggccgggatcgcggaaatgcacgtgcggatcggcgaagccgggggcgaccgtcagcccggtggcgtcgaagtcaccttcgatgacgccgccgtcctccggctgattgcgtgcgtcggccgagggaatcaccatgtcgatgatctcgccggtgtcccagacgcgaatgttgcgtaaggtcagcatatgcatctccttgtggggttggctctgatgaagacggttgcacccgctggaccgcggtttcggtcgccagggcttgacgtccgaaaccgcgaaacgacgggcgtgaggtcagaacttggcttcctcgtcgcagtagtcgcagcggtactcctgacgctgcgaatgcacgagatggaacatctggtcgatgccacgctcggtggtggtcacgcaacggggattcacgcaggtgatgatgttcaccacgtgttccggcagcgtgggcttgagcttgcggacgatcttgccgccgcgcacgatgccgacggtggcctgacgggcgaccaggccgagcacgtcgagatcgacgttttcctcatcctcgatcttgatgatgtccttcgtgccgtacaggtggctgtcggcgttcatgatgagcgccagccgcgtcttggacggatcgatcttcaggtactccagcaccttgagcgcggtgccggcgggcacatggtcgatgatgatgccgttttgaatgctggtgacttccatcaggcctgaacctccttggggtcgagcggctcatatcccggcagctggtctccgaccaacgagctttccaatgccatacgcatgagcatgccgttcttgacctgctcgaagtaggcggcgcgcgggtcagcgtcgacctcgacggcgatctcgttgatgcgcggcagcgggtgcagcacggccatgctcggcttggccttggagagcttgtcctcgtcgaggatgtacgtgtcgcgcagacgcaggtagtcatcctcgttgaagaagcgctcttgctgcacgcgggtcatgtacagcacgtcgaggtcgccgatcacggagacgaggtccttgacctccacgtaggagcaggacggcgtcgccttgatgcggtcgatcacatagcgcggggtcttgagctcgtcggggctgatcagcacgaaacgcacgttgccgaagcggcacagcgtctcgatcagcgaatgcacggtgcggccgaacgtcagatcgccgcacaggccgatggtcaggtcggtgacacgaccgaagcgcgattgcagcgtcgccaagtcggcgagcgtctgcgtggggtgcatgtggccgccgtcgcccgcgttgatcacgggcacggacgcggcgcgcgaggcgaccagcgccgctccctccttcggatggcggatggcgaccacgtccacgtagttggacacggtcttgagcgtgtcggcgatggactcgcccttggacaccgaggcgagctgcgcgccggcgaacccgatgacctggccgccgagacgcagcatggcggtctcgaagctcaggcgagtgcgcgtgctgggctcataaaaaagcgtggccaacaccctgccgtcgcaggtatgcgccacgcgtttgcggttcgcatcgatgtatgccgccttgtgcagcaaatctcgaatctgggaaatggaaagcgtatccagcgtgatgacgctttgaccgaccaacggcgtctccgccggctcctctgtgactgacacagctcacctttcatgcgtgaagcggataaggtggccactgaagtgacctatccgactataatgcagatttctgatttttcacaggcgacacacacgaccgtctcatatcagcgtccataaaacagatgctctgccacgtcgcgggccttgcgcatcgttcccatcaggtcgttttcgaaatgctgcccgcggtgggcatcgtatcccagatacacggcgatgccgcccagcgaatacatgtcgtcgggcaggatgtcggcctgcgagacgcgtccgttccacaggtagttgccgttgcgggccgccgtgcacatgcgccacgccttgcgcagcaccgccgcgtccccgcggtcgatgaacctgcggcgttccagctcgtccagcgtcgcgagtgtcgaattcagccgcagcgaggcgttgtcgccggcatgctgcagttgcaggagctgcacggtccattcgacgtccgacaggccgcccttgccgagtttgagatgcctgtcgcgcctcacgccgcgcggcaggcgttcggcttccatgcgcgccttgagcttgcggatctcgccgagctgtgcatcggtgagcgggcttatcgggtatcgcagcgggtccgcgatgtcgtggaggaaatcctcgccgagcgcccggtccccggcgacgaaccgggcgcgcagcagcgcctgatgttcccacgtgttcgcccatgacgagtagtactcccggcaggaggcgtacgagcgaatcagcgggccgttcttgccttcggggcgaaggtccaggtcgatctcgatcttcggctcaagcgtggtcggcccctgcagcacctgccgcagcgcgtcgaccaccttgcgggcgaactggttggcgacctgctcgtcggcgccgtccgcgggcctatacagcaggatcatgtcggcgtcggagctgaaattgacctcctggccgccgtagcgtcccatgccgatcgccgcgatcgcggcaggcggctcgccgagccccatcgccgatgtctgatagcggatcgcccatgtcaaggccgcatcgatgatggcgtcgtacacgtcggtcatgccggtcaggcacgccgtctcgtccatcacgccgctgagccgggccagaccgatgcgctcgatctcgtggcgcctcatggctcgcatcgatgtcgcgaaatcgttgatgccgtcggcgttgcggctcagagaggaccggcattgcacgtccaggctctcgcgcgagcgtgcgatcagcgcgtcatcgtcgccaagccaggtgaccgactccacggacttgttcagcgcgtcgccgaggaaacgggagttcgacaggacgtggcacagccgttgcgcggccgaattggagtcgcgcaggaagcccaggtactcgctgtccgtgccgaaacgctcctcaagcttgcgccagttcagcaaccccatgtcggggttctgcccctgccccagccattgcagaacagccggcaacagtatgcggttgatcttggaggctcgggacacgcctgcggtgagcacggccacatgccgcatggcggcctccgggtcggcgaatccgatggatgcgaaccgttcgtaggccacctgcggggcgagcgagaaatcctcgccgttcaacgccgcgatcggcagcatcgggcggtagtagatgtccatgtgcagccggcgcacctcgcgccgcgtctcgtcgtatttcgcgaccagctcctcggcgtgcagaccaaacgcgcgggcgagcctgcgcagctcggggttctggctgagcttttcgacgttgacgtcgcgcttcttctcaagtccgccgacgctgccgtcgccgaggtcggggaacaggtgcgtgcgtttgagcgcccacatctgctgacgatgctccatcacccgttcgaagctgtaatcccgggcgagtttcgcggcctgcttgcgcgacacgtagccgccctcggacagcctgcgcagcgattccagcgtggcgctggcgcgcagcgtctcatcggtgcggccatgcacgagctgcagcatctgcacggtgaattccacatcgcgcaggccgccgcggccaagtttgatctcgcggtccttgagcgcgggcgcgatgaggtcctcgacgcgcttgcgcatctgctgacagtcgtagacgaagttcttgcgcttcgacgcgctccacaccataggcctggtcatgctcatgtatgcgtcgccgatctgcgggtcccccgcgaccgggcgcgccttaaggagcgcctggaactcccagttctgcgcccatttctcgtagtatgcctgatgtgattccagtgtgcgcacgagggagccgtccttgccttccggccgcagtcccccgtcgatctgccacagtgccggttcggcgactcccataatcaccgactggcacacgcgctgcaacatcgtgcccatcttcgtgccgatgcggtacagctgctgctggctggtgtccgcgtcggcggccttcaccacgtagatcaggtcgacgtcggacacgtagttgagttcgcgcgcgccgagcttgcccatgccgatgatggcgaaacggcagtgctcgctgccggtgatctcatgccgggctatggcgagggcgccttcaagggccgcatcggcgaggtcggacagctcactgctgatgcgcggctgcagggcgatggggtcgtcgctcatggtgtcctgcgcgatgatggcggccaactggttgcggtacgtcctgcgcagggcggtggcggcgtcggcaaggtccatcgtggctgtcggggacatgcggtcgttcgggtcggctccgacggattcgagcacgtgcgcccggcgctggtcatggttgtagaggtgactgttgcagtggtcggtcgccgcggcctgaaccaggtcggggcggaaccgcatcagcttgcccatcgcgtcggagacgccgagcacggcgaccagctgtcggaacgccgtgtcgtcgggcatgatgtcgtccagcgcgcggccctggctcacctgcgcgttgacgatgtcgacgaggttgcgcagcgcgacatcgggatcacagacatgctgaagcgcgtcaagcagcaggccgcagcgtgccgcatcgaatccgctggcggagagctggcggaacagtgaacgggcttcgtcgagattctgcaggcctgcgtggatgagttcgcgcgcgctggtgtcaaaggttcccggaacagtcataacctacaattttacaagaaaccgtgcttcctcggccgcgatgacacggccgtgtcgtggccggatggacataatggcggtatgcaactgtcatccgcagaactgatcgtaaccatcgtctccgccatcgtcggcttgctgatgggctttgtttccggtgccatgccgctgcagccgcagaggatgacgcctgtgcaggcgaccgtgcagaaggtgctcggcttcgccatcgtcgcggtcgtcgtcgtgcttgccctggcctccatgaacgtcgccatgtggacgacgctcatcgccgtggctctgggcatcgctatcgccaacgttccggtgattcgccgggccgtgaccacgcggatcgcgtggttcgcgcccaaacccgacttcaggcgcagcaagcgtcgccgtcgctgacggcagatacgcggcgtgctgttgccggccgcgcattctcatatggttggggccagacagccgcatgactgtctggccccaacgattttgccgtaatcggctgtttgccgggagtgtcattccacggtgaacagcggctccacgttgcgccatatgcggcgtgtggtggcgggatgattcatcgaatacaggtgcacgccgtcgacgccgtgggccacgaggtccgcgatctggtcggaggcgtagatgatgccggccgcgcgcaggttctggatgtcgtctccccagcggtcgagcagcgcttcgagcttagccggtatgcgcgaggcattgaccttcgccatgcgccgcaccgacttgccgccgcgcacgggcatgatgcccgcctcgatcggcacgtcgatgccggccgcatgagccttgtcgaggaaacggtagaagtcgtcgttgtcgtagaacagctgggagatcagatgcgtgacgccggcgtccaccttgattttcaggttcccgatgtcctcgtcgagcgaggcggccgaatagtggccttcaggatagcaggcgccgaacaccttgaggtcgggcttgcggtcgtggatgtaggccgcgaggtcgctggcgtggttgaagcggccgaccggctcctcgccgtcgatgtagtcgccgcgcagggcgagcacagcggagacgcctgccgcctcgaacatgtcgagcgcctcgtcgatcttcgcctcgtccgagtacagggcggtcagatgcgccacggctgggatgccgtattccccgtggatcgtgttggcgatgcgcgcggtggcggtgcggtccgaatgcgtgccgtgcccgtaggtgaccgagatgaagtcggggttcaggccttcgagcccgtcaagcgtgtcgtagatggtcccgacgggggcgtcccgcttgggagggaacacctccagcgaaaacatgggtgtgtgcatatcaggttccttactacaagtatgaagttgcccccgccggcggggctgtccggccgatgccggactgggggtggtcgggtcatgctccaccacccccagtcgcctacggcgacagcccccgccagcaggggcctatagggtcctacttcgtgatcttggcgcgaaccgccttggcggcggcgaccatgtgctcaaggctcggccaggtctcggcgttgccacgggtcttcagaccgcagtcggggttgatccacaccttctcgatgtccatcttcttgagaatctcgtagatgcggtcctcaatctcctgctcgccggggatgcgcggcgagtggatgtcgtagacgcccgggccagcctcggtctcgaagtgcgcgtcatggatcgcgtcaagcacgaccagatcgccacgggacgcctcgaaggagattacgtcggcgtccatcgcgtcgatgtcgcggatgatgtcgttgaactccgagtagcacatgtgcgtgtggatctgcgtggtcggcttgactgcggagtgcacgagacggaacgccgggatggcccagtcaaggtacttggcgtgccagtcggtcttgcgcagcggcagcttctcgcgcagcgcggcctcgtcgatctggatgaccttgatgccggcggcctccaggtcgagcacctcgtcgcggatggcgagagccagctgctgggtctgctgctcgtgcgtgatgtcctcgcgcggccaggaccagttgaggatggtcaccgggccggtgagcatgcccttcatcacatggttggtgcgggactgcgcgtaggcggaccattccaccgtgatcgggttggcgcgggagacgtcgccccacacgatcggaggcttgacgcagcgcgtgccgtaggactgcacccaggcgttcttggtgaacaggaagccgttgaggttctggccgaagtactcgaccatgtcgttgcgctcgaactcgccgtgaaccagcacatcgaggccgatctgctcctggtgcctgatgcaggcgtcgatctgggccttcatgaactcgtcgtattcggccttggtgatctcgcccttacgcagcttggcgcgttcggcgcgaatctccttggtctgcgggaaggagccgatggtggtggtgggcagcagcggcaggccaagggcgacacgctgctccttctgacgctcggcgcgggccggctggcgcacgaagtcggcgtcggtgagcttggcgatgcgctcggcgaccgccggatcggcggcaacgcgggtgccgtcgaacagcgcctggttggcggccagatcggcggatgccttcttggcgtcctcatcggagtcggcgaggacggcgatctccttgagctcggtcagcttctcgacagcgaacgcgaagtgcttgagcacggccgggtcaagggcggtctcaccctcggtgctgaacggcacgtgcagcagggagctggcggtggataccgccacgttgtcggtcttctggcgaagcgcgtcgatcaggccgaggctgacggcgtagttgttgcgccagatgttgcggccgttgaccacgcccgcgaacagggtggtgttctcggcgacgccgtacttctcgaccgcggcgaggttctcgtccttgccttcgttgaggtcgaggccgatgccgtcgaagcccagcaggttcacggtctcgtacacgtcggcgatgtggccgaagtacgtgttgagcagcaccttgatcttgtcttcgcgagcgggcaggatcttcgcgtacaggctcttgaagagggagacgtcgccgtcctccttgtcgagcacgaggtacggctcgtcgagctgcagccactgggcgccgagtgcggcgaagcgcttgatcacttccgcgtagacggcggcgaccgcgttcaccaggcccttgtcgtaggtgagctcctcggcctgcgcgttgcgggcgagcttgaggaaggtgtaggggccgatcagcaccggtttggtgaggatgccccgggcctttgcctcgttgaactcgtcgaacggcttggtgccgttgaggcggatctcggtgctctcctcgatttcaggaacgatgtagtggtagttggtggtgaaccacttcttcatcggcagggcggtcacgtcgcccttgtcgccctgatagccgcggcccatggcgaacagcgtctcctcggggttcgtgaaggcgagtcgcttgtaacgctgcgggatgacgttgagcaggatcgcggtgtccagcatctggtcatagtagctgaagtcgttgctggggatgagatcgacgccggcctgtgcctgcagcttccagtgcttcgcgcgaagttccttggcggtgccgcgcacctcgtcgagtgaggcggcgcccttccagtaggcttcgatgatcttcttcagttcacgattctgtccgatgcgcgggaatcccgagacggatgtaagtgcaggcatgaatcctccgttatgtacgactatgacccgcctagattaccaaaacccgccgattgcgaggccatcagaagcattaaggtgtcgttataaacggtggttataacacaagccggccgtcaccgttcgcgagagaggccggccggcaaaaaggcgtcatccctagtcgaaatccttgggactgagcacggcgagcagctcggcgtcgtgtacctgccagcggctgaacggctgatcggagccgaacaccaccacggaggcggtggacatgcccaggttaagcagatccagcttgaccatgtccgaatccgaggaggcgagccactggcagctcaccgaaacggtcggctcatggccgaggaccatcaggacccgggtcttgtccttggcgttggcgagctcgtcgaacacggcctgcatgccgccgtcgtacagggcctggcggtattcgaccttgggatggtcgccgaataccttgagcattctctccagcgtctgccgggcgcggaccgcgccggagcacgcgacgcggtcgggcagcagtttcatgccgacgagccccttggcgacgatcttcgcctgcttctcgcccttgtcggttatctcgcggtcatggtcgcccttgtcgttgaacggttccgccttcgcgtgccgcatgaccagcagcacgtgggaatagttcttcgcctttttctcgaccttgctgagattcacgcccattcttcaggacctttccgtacgacgtcactgcctccattgtggcagacgaggggcgctcgacttcccgtcatcaccaaatcattgcctgccgttaagattcgccgcgcctgattgggctgtcagatcgccgtcgcctccccttgctcgcaggcctggtcgtcctgcgacagtcgggacgtctgcaggtcgaggtcacgcagcaccttgcgcagcttgtggtccgaaatgtcgcgcagctccagatcgtccagctgggcctcgcgctgttcgggggtgagcgaatcgatgtcagtggtcgtatccttggtggcgcggtcgcgtttgcgcagggccgcgaacccctcctccatcgcgcgggagaccacaaggaagccggtgtggccgatcatcgcatggtccggccgcacggcgagcccctgcgccttccacgtgcgttccagcgtctcctggatggcgggctcggtccaatggccggcttcgcgcagagcctcaacgagtcggctcatctgcgtggtggtggtgatgtaggcgatgaggacgccgccgggcgcgatgacccggtacgcctgtttgagcctgttccacgggtcgagcatgtcgagcacgatgcggtcgaaggagtgctccggcaggccggccgcgaccgagtcgaagtcgccggtcttgaggtcccaccaccgcgggcgttcgccgtaatacagcgtggcgttcgcgtcggccacacgggcgaattcgggtcgcagctcgatggtggtcaggtggccggactcccccaccgcatccagcaggttgacgctcatcgcgcccgatccggcaccagattcgagcacgttgaggccgcttcggatgtcgccgagctggatgacctgcgcgatgtccttcgggtacatgatctgggcgccgcgcggcatggagagcacgtagtcggcgagacgggggcgcatgaccgcatactgccagccgccgatcgcacgggtcgccttccacggcttgttccggtcgcgttcgggatggtccgcattgacctgagcctcgcgcttggcggtgacggtggtgacgaccacgccctcggtgcggcctatcacgtcgtcgtgcagaatgatcccgtgctcggtctgggtgacgccaccggcggtcagctggtcggtgatcttcttgcccttgcggtcggtgaattggatcttctcgcctgcgacgatcggcccgcgtctcgggttcatggcatctccttggggtgagtttctgagctgtacacagtttagcgtacccgcgcgctgcgttccggatgtagcagcgaatcgttctcaataagaaaagtgcgaggattccgaacatttccgcacaatcgaacatttcagagaccggcaaaataccgggcttatgaagtaatccgtgttcgtttcctcacataacggactcgcacctttcttattgagaaccattcgctgtaacattgcctcatgccgaatatcacgccgtcagaagaccgaaccgtcgaaaccgttcacgtaccgaataatcccacgctcaccggcctggcccggctcacccgcaacgtggcgtatcgcaccggggccgatgatctggtgatggacatcatcgcgccgcaatccaccggcgacgatgatgaccgccgctaccccaccgtggtgttcgtgcagggcagcgcgtggaccacaccggaccgtgattacgagatcccgcagctatccgaactggcgcgagagggattcgtggtggcgacggtgaaccatcgcaacgcctcgcgtgacgccagtgccgtgttccctgcctatctgaaggatgtcaaggcggcgatccggtacctgcgggcgaacgcgcggcgctggcacgtcgaccctgagcggctgggcatctggggcacgtcgtccggcggcaacacgtctctgctggtggggctcactgccgacgacccgcggtatgaagacggcagttatgccaccgaaagcgacgcggtgagcttcgtggtcagctgcttcccgcccaccgacatgatggaggcgatcgacgcgttcggcaacgaggatgacccgttccggctgtactatttcggcccgttcgccgcagtggtcggggcgacccatgaaaccggattgagcgacgacgtgcgccgccgggcggccgacatgagcccgtacctgcaggtgcgtgacggggtggcctatccgcctacgatgctgctgcacggcaccgccgacaccgtggtcccctaccggcagtcggtcaagatgcacaagaggcttctcgaacacggcgtggactcgcggctggtgctggtcgacggcgcagaacacgagcacgacttctggagcccgcaggtgttcgatatgatcttcgatttcattcgggagcggtgctgagataatcggaccgtattgggtcggggataacttgtattcgattcccggaaaagcttctaacaaatgccgtgtgagcacacgcacggcagtgacacatcaggcactatggtggcgggtatgacttcggttcgtgctgtcgagcagacgcggatggggattgccgcgccgctcgtttccaatatcggctggggcgtgctgccgctctactggcacgcgctgtccggcatgaatgccatcagcgtgctggcgtatcggctgatcgccacgctggtggtcatgattgcgctgctgatggcgttccgccgctatcgcgcatatcatcgcgcgatcgtcgcgctttgacgcgcacagcggagcaaaaggctgttcgcactggaactcgccgccaccacggctatcagcgtgaattggttgctgtacatatatctggtggtcaacggccaggcgctgcagacctcaatcgcgtacctgactacgcctctgctcaacgtggcgctgggcgtgggcatgttcactgcgcagtcaccgacgttcccgtggatggcgatcgtgctcgccaccagtttctccgtctacggtctgctcaaacgctgcgtgccgttggacgccattgcacaggccgagaacgacaaggacatgcggcaatgggaaccactgaacagcatgctgttgatttccagcacgctcgctttcgctcgatatgatgacaaacgcatgtgggcctatgacgtgatcgagaatgcgatgacgcgcaatctgggatactcgttcagcgaagaatacgacgaaagtgccgaggataacgaggatacgaacgaagtcggtggacagcccggcccgcgtctgaactacggtccgacctactacgccgccttcgtgcacgatccggaaggcaacaacatcgaggccatgctcgtctgagcgctgccagctaagcaataacggaaaagacagatcccgccatacgtaatgttctcatggcgggacctgtcatattcccagagaatcaaacatctcagcagccgtatggaaacgcgggccgttctccgctgaatattcatggacttcccgcaaggcagaaaacgtatcagtaggaacggcgctctgttgaggaaggtctaatgaaagtcggaactcgtacgtatctggattggaacacatgtgatttccccctttagccccggttacttgaacaggtcgaacagactgaacgtggtcttcttgtagatggtgttgtacagcttgcgcttggggtgcagccagcccatgcccttcttgccgtagccggagatcaacgctttcttgaccgcgcgggtggcgcggcccttcgtacgcgcagacaggcttttcttccagctgggtttcctcatcccgtatttcatggcggcctcttttcggatggttatgctcattctatacagtgctgaacacgtagcagatcgagcaatcagacaagcagatcgtacacgctgcgcatggcgagcaacccgtccgtcatccattggtaggcttccgtcataccgccggagaaatccacatcatgccgtaccaaaaggtggcggttcttcttgtcggcttccggctcgtcccaagccgcctcgcccaaagcagacagcatccgttcaacggaatccttcatgccgtaaagtttcgtgtactggaacgtgtcgatgaaatacaggtcgaccgtaatgtagccgtctcgaatattcaacgctccatccgggtggcagaaccccgagcctacgccgaagctgatccatgtgtcgctgttcgtcttgcgaccggatgggtcgccgtatacagcaacaaagtcgggccgcgttgcagcatatctatacaggccattccagaagctgcgccgcagtgagatattgttgctgacttgccgcagttcgtccaaggttctgccgtccgcgactttccacactgtccaaccgttgttgatctgcttgttctcgccggtttcgagcattctggcgcggcggaacgcgccggatgggctatcgaatatctcgccgttggacaggcgaatgcgatggtcttcggttacggttgccgtggcggttacgccggcataccgactttccaacatgtcaccggctgtaaggatccctctcttgcataagtcggcgaaatcgacggcattctgttcgcgctctccttggctcaagttcctgctgcggagagtctgcatagcctgttcccccgctgtggggcttgtccacacctgcaatgcaagatcggcaagtcgcacgccgcgccgcgcgatcgcctgttcatcccattgcgtagcgtcgtgcagttcggcggaaatggacaggtattcactactatacccgccgatcgcacggttcttcttctgttcgaatgttccgtcggaaagttccgagttgtatgcggtcaatgtcagattgcccagactgttcaccagcagcgggaatcgtccggggtcggagagcatatcgcgccattcggcatgcgccatggcgttctgtggcatgatgtgttcgacggtgtattcgtcgaaggaccgcgggtccttgggatggttgtggttttccaatccggcgagcagatatttgcagcgcgaggcagggcggtacagattctcgccgagcagtgcctgcctgaattccttatccgtgggcatgcgcgtggctttggcggtttcggtgaggagcagcgcggcgaaggtttcggccggatcgtcttccgctgattcgagcttggcgatcaacgacgggacgagcttgttcagtccgttgctggataccgagcagatcattcggcggaacagatacgattcgagatccgcgagcatgcgccgcagcccgtcccgggttatgcgttcatgcttccatgccgcgaacatgtacaggagcatcggatccataacagtgctgtccagggtttggatcgaggcgagacggcggtccacgttcgcgtcgccgctgccggcagacgcgatgcctttgatggcggcataatacccggcatattccagcatgttctcgagaagattgtgtgtgcgttccatgcgcggcatggagctatcggctgcaaaacgcttgaattccgtatacatggcgcggcctttggttacgggctttttcaatgtaacgaccatccagtcgtgcaggaacgcatcgaatgagaggttgccgagaacacgttccatgggcagccagtagtcgacgtatagggtgttctgctcggtcatggggcaccccatgagcatgtagttgcgtaccagatcggaagtctccagatcaagcccggtggaattcatcgactcgaataccagttgcggttcatcgcgtccctggtccagggtgatggacacgacttcaaggcgttgcagtccgttccacaccgtgttcacgtcatcgattgcggcgaccagggaacggaacagatcgaggttcgcttccagctgggacgttgttccggcctggttcccatgattcggccggtcaagggcaagcacatggtcgcacatgccgcgcagcacgtcccggtcgtcgccggaaagcgtcagtttgcagcggccttcgccagtcgcatacttgtcgacaagataaccgcggtcgatgatcatgtctgtggagaagcgcaggttctccgggtgttcgtgggcgtattctgccaaggcgatgagcagcagggtcaccgaggtgagccgctgctgaccgtcgatgagcagacaacggctgacgccgtccgggctgatgccgccctcctgcatccatacgaccgacccggtgaaatgcgttcgatccgggcgtctgccggcggctatgatgtcggcccacaattgacggcactgcgcctcgccccatgagtatctgcgctgatacaccggcacgacgaaccgaagcgaaccggtgaataagtccaacaggattttcttgccggcgtccatggtgatttcacttcctatcgcctttgaatagcagttcaattattgtgcagataataattctgttactttcaatcagcctacctcagatgttctttgtgcgtctttcttcaagacaatcacaccatgttcacaaccaatacatttataacgaattcccgtacaaccctgcgaatcgaaaatatagaattctgcatccatgcaatctgaaagattgattatctccggcacaaaaacacttaaattactctcatctttgagtaagactcgactgatcttattggttatgcatacaattttttgatcaaatttttcatcagagataaaataaatattcctctcctcgccattactaatggtgttttccaaataattatctaaagattgtctatattctggaatacgcacaccatctctaaaagatgcccatctatttgagacgttgcaatatttcagcaacatctctcgcgctttcttagaagattctttctgaatatattcacacagtactcttttccaattgtcattttcttccgatgaaagaaaacccaaatagtcttcaaagagttctctgacctctctttcatctgtacatcttctttttatatagtcctttttatttagaataaattgaacagcccttaagctgtaacgagaaagaagatccaacgtatcagctgtatttttaaacttcttcccttgtttgtaactatcaaattcgttaattttatatgtaatcaataaagtatgctcacataatttaaagtcctcaatagccagccaattagaataactttcatcaagatagggattaaagaaagcgttctttgtaggattaaatgatcctttttttgaattgcatgtaggacaacatggaatcaaattgaacggagtagtactcaacgatgcatatatcgttttaggtaagaaatgatcaaatgttctagaaggctcaattccacaataaggacaaagcagtctttctggatcaaatttataatatttcaaaagttgttttctgtcatagaggaactcccaattatttttatcttctgtagctcttgcctcctcaacataatcttcccatcctaaatcaagcaatcgagcattctctttgaaggcactacgaattgcggtaggggggtgcggatgtttttttggacggttagacggccagtccaaggtgtttgcggtattgcacggggctcagccagcccagtgactttttgattctggtctcattgtagtgggtcaggtaggcggacaatcgctcgcggaactcctcgtagcccacgcccttccagtcccgcccgtaatagaactcgttcttgagcctgccgaagaccccctcggcggcggcattgtccgggctgcagcccttggcgctcatcgagcgggtcaggccgtgctcctcgcagatgcgaatccattcgtcccaccggtagtggcagccgcggtcggaatggatgatcggatgctcgggctggctgagccccgtgcaataccgcaaacaccttggactggccgtctaaccgtccaaaaaaacatccgcacccccttatccgaattgcaataagtttcttttcataatcttttacattttccgttgtcttcttattctttaatatagtaaataaaatagaatagacgtcttttaaatactgagaaatactttctttatccttacgctttcgacaaggtacatcagggaaaatattgctaaacatatccttaatgtttttcattgctgccctttcggccatgcttcacctacgatgtatggaagcaatgctctcgcttccataccaagcttttctccaaattcatccatgcaatagcttgaaagactctccttagaaaaaggcttattatattttttctcgaccttttcttttggaattttcttaactgtgtctttcaaaaaactgaagtagccacttttgtctgcattcacgccgaatacttcattaagcaatacgccaagattttctccaaatgtttcaatattaggatgagagacgtagcgaagtccatctcttgatcgaagtacatacacgcattttcgtggaatctcacgtaaaacgacaggagaatgagttgcaaaaattgccattgcacctgttctttcattgcttaagaaagagcgaatctcgtttatataagcacttaaaagcggagcgtgcaaataattttccggttcatcaataatgagcaacgatctagacgtattgaatttataaatcataaaagcaaatacaaataggacttctttttgaccagcactgcattgatctacattagattcatctgcaatccatttacgaaattcgttagaattattttcctcaagataaaaatcaattttcgaaatgaaatccaacccatagaattttacattctgcgcaattcttctcaaactattcattagtttttctgaaagtctattagacctagaaatgtcgactaaaagtttttttaaagcgtcagaagaaaagatatccatggatcccgcctgattcacatcggcatctaacctattagtcgagatataaatgatatgattcacgtcttcattgattccagaatacttttccgcaattcctttaaggaaagtcgttttcccaacaccattttctccaattaacacatgaatgttttcaggaggaaaaacttttgaatctgcttcaaaaacaattttccgtattagatactcattttcttctctattttcagcttcactattgaacacatactctagatggaatagccccacctcagcaagtcctttgtcgacaatatctcgcactgtggaaatatatttctctgctccttctttatcagactcatattttctcattaacgaaacttgataaaatccagaagaacttacataatctattttcttacttaaaattagatcattcaaagatataagtacatcatgcaacttatttttatttatatttatataatatttatcgtcaatacctaaggaacaaaaattttcctctaggcgactaaaactattttcaagcaaatctcttgtaattttttcagatttatgagcgatttttactggaccaatctcatgaaatttgttatcttcatctgtccaataaagctcaaataacgtctcatatccataatcattccacccatccgattccagataaaagacccttttccccttcttacgctctgccgattccttaagggcaagctcttttttcgtataaaacatagagacattactagccatttcgttattcctttcatccaacctgtgccgagacgccagtcagcagcacaccctttttagcacgtgtcatggctacgtaaatgaggcttcgttcctccctgtagatttcgttcaacgcagccgaatcggcaccagcagattgcaacacgggcttcggtgggcataccccatcgttcacgtcgactaccaccacatagtcgaattccagtcctttgactcgatgcatggtggcgacgcgaattccttgcctttgcctgttttctgcatccctaccaagctggtacacgccatacggcaagccattattcagagcttcacgccaatggtcgatgcagtagcgactcctcgccaccacgcacacattacgcggatccacacgctcaccgtcgaactcatcgccggccatattttccgccgtgccgcacaatccataaatccattccctaacggcatccatctcatccgactgggatgcaaaccgccgcgtttcgggaacgggaccgctcatcaacgatctgctatcgccggtcgagctctcccctccgtccaggtcatcgaacgtcgtggccggcgaagcatctccgataccacgaacatccgcaaacaccgaatccgcgacatcggcaccggaactacggaaaatggagtcggcggcgctacgaatctgttcggtggtgcgatagttgatccgtaatttgcgggcacgcccctggatacggatgccgcatttcgatagcaccgcggtatgcccgtagatgcgttgctgtgcatcgccgacaatgaagatgtcgttatcaccctcgtccaccagagcgcgaatcacacgatatgccggcgcggagaagtcctgtccctcatcaaccaccacatgcgcgtatttcctcggcgcatcgccctgcgtgagcagagacacggcattctgcatggccgtgtccacatcgtacgcgtcgttcgactgcatgatgcgccgatatgtttccacaacctgccatacggcaagtttctgggctcgattcaatctcgtgccacgccccttacgcagcacgcgcatgtagtcgaccgcgttccgtacctgttgcggcacaatcacctggctgagctcgcttttgaagaaggagaccgtgagtttcggatcgttcacgccgatggaggcgatggccttgcgccacgcgtcgtcaagatcgttaccgtgatcgaaactgccgtcataccagatttcgccggaataaccatggctcgtcagtaggtctttcacgagtttgtcgagattgaccacgtcgatggcattgaattcgtccgccgtgcagatgagtttcaggttcgaagcaatatcggtggcaagattacgcgagtatgcggtgaacagcactttctgatgactgccgtttctcagcaatctcgcggcgagacgcttcgcgcgatgcatggccaccacggtcttccctgtgccggcgccaccgagcagacggaacggaccatggtagtcgtgttccacataaagccgttgcgacggatgcaggaacacgcgccactgctccaatggtgcgtccagaatacgcttgagatccgcctctccctgcacgaccacgaaagactgctgcgaggcgtagcttgacaaggcggcacggaaatcctccggatcgacctcttcaccagagtcgatggacgaagtgggcagctgctgttccaatcccagcctgtcgctgatcttgccttcggtctcatcgaacaagccgaagacctcagatttggaaagcccttcggcaacaagggtgaggtacgtgaaaacatccttcgggagcattgacccccaccggtcgaattcctgccaggtctttctcgtgcacatgaccggcacgtacatatccggcacaccgaaccgacgcatatcattgtccgtcaatgcccggtaagtgtcgggaagcggaccggtatgaggttcgggagcttgccgtggtgcctgcggcttcttggccgccacggctgaagttgcactagctgaagctgttccgtgattcgtgccgtcatggtcttccatgggaggagaaacggattccggtatagtggaattcggttggggcacgtttgcggcaacgctcccccatccaacttcgctctgggaatcttcacgcattgccgtgtcgatttcctcttgagaaaccatatcgtacagctggatggcccttgtgttcgggttgacgtcgagtttctttgtttccgcccatttgtaggcgtcatcgtggtcgccaacgtacagcaggacgtacacattgctgcttttctggaaagcgatgatggcgcgataccgttggtcgatgcgcgcggaatacagtttttcgtccgccgcattggcgattcgttccagattgattcctgatgatcggggattcgtctggaattttgtcagaaacgtcgtggcatgtttctgcgctttctttggcaaatcgaacaagctgcccataagatcacggccaagcgcgaccacgggtttgttcatcgtacgtatatctgccatcaacgttcctcaccttccgtcagtgaagcgaacaccttgtcaaggtcatcgttgttttctgtaatgatagtccagccgcgcttgacgaattcgtcgacgttctctcggtcggattgcaagtcgtaggacgggaaaaacacgatcttcccatcctcccatgcgagctccgcctgcgcaatgatttcctcgttctcgtccagcagctcatatccgagtacatccggtgccggtatgtcagactcgataaaccgtttgacggcttccttggtctcatccgcacaatacacataggtcggatccgccaggacatcgttccacgcggaatcattgctttcctgcacgtcaggaatattccgcaaaccgttgcgaagcggctcgtacatggtcgtgtcactcagcgcggcatcgccgatggcatggaagtattccgagaattgcatcacattcgcaaaatgccagaaggacgcccattgcgttttgaatgcttccgcctcgttctcgtccagagcgttcaacggattgtaatcatcgttcttcgccttcacggcatcgcgttggacgtccgagaacatcatgccgacgtgaggttcggtggtccgcatatcctctccgatacgcagaccggattggaatttcagtcttgtacagttcgaaggactccaggacgagcaaatcatgaatgccgattcgttctcgccgtgcagtgcctcgatccgatgcagcatatccacggcctgaggttcgacactcttgttccgcgggttcagggcatagctcatcgccagcgcctgggtggcgaatatccgttcggcatccggttccccaagataatattccagcagggccattgccggaacctcgccggggtcgaattcgtccgccctcttgccaatcgtgcccttgtaggccgccggagacggcatggacttgggcgtcaacatcggatcagcgagctgcaccacatccttaccctgcacatagccaatcacatcgtcataatccaaagaccatacgcggtaacctgcctgacgaagcgcttccctcttcagagaatcctgggcgacgatgcctgcatgatattgcagaccgtcggtgaagacggcaattggcttccttccatcatgctcgaccacatcgccggattcgtcaatattgctgaccgtcaatacgaaatcgggcttgcagggaatcacaactccatcggccggccccagagagacttgtggttcgacgttccatacgctcccgttcacggtgacggaatatccgggtttgctattgatgaattcgtccttgacgatggcacggcaccccttggcatcgtcggattccgcgaagggatgggcatgcatgcaccggagagcttcgacgaactgctgttcgagtccgctgtcgaacagtttgttcgtgttgatcttcgaaacggtcttcacacgactgcgtttgttggacgggtcgaggatgcccgtgagcattgccaacgctgtcttacgggaaataaatttcaggtcctggctttgtctgtatgcatacaggcatctgtagcacccgtcgccgccgttttttgcacattcacaatgctccatgacttcctttgccctggaaagcacctcgaacatcgtatccgggtcggacagttgcttaagatagccggttcctccgggtactgtgtcgtatagcgcaagataggttttgcgcagtccgggattgtccggcaacggctcgttcatgagcgtcgcctgcagatggtccacattgccgaagcgttcacgcaggccgagcatcactgcggcagtcagcgactccgcggcaccatcggcaccttggatgtcggcaagtcccggcacgagcatacgcagcacttccgatttgacctcacggtataggaacaggcacgtgctgttctgctccgtttgctccaactgctgttcctgtgccttcttgcgttccgggcagaagtaggcgtgcctcgatccatgttcgccgagcaatgcaccacatttcagacacacgttgaaaccgttgcgtatctctttactgccggcgatttccaccgaagctcccttgtcggagacctgcccgaagttgatttcccggattatgccccggggtgtgtagtcgaatccaaagttcgtggttcctttgaactgccatcctgattgaatgtctgccggatcgatgtccaccattgtgtccttcaggaactgggtcttaggtctgctgtcggaggtgtcttcgaccagactttcgctgtaggtctcatcggatatgacggtgtcgatgcgcagcattggccttttctggccgctatcggcccattgcattgatccgcaggatggacaactggcgaggttctcagtgctggaagcaggctccgcatgcgagcagttcgggcataggcgccacattgccagctcgtcgtcggtgccgcctttcgcacacagcacacggctgatcttgtatttgcgcccgcctgcgaagaacgtgtttcccggcgccagttccgtgatggccgtggccgccgggcgcacgaaatcacgcgtggccttccccctgcgtttcgtcttgtcctgcgcggcaggctcgattccgtgtgccgcatcggacggttccttgtcctctttgaggatggtgtggagggtcacaccggtttccgggaacgcataattgggcaggatgccttcgtcggaaaggtagttgaacgtgttggtgttgagaatgcttgtgacgatgcggccaagattgtgaatctcatcttcgcattcgcgctgctgctcttcgaacgatgagtcggagggcttcttcttgagctcgtcgagcaggtgcttcgcatcgctcctctgcgcttcaagcgtcatgacggcatcgttggtcttttggaacacatcgtagacgcgcctggccatggtgctgctgtctttcgtaccacgcacgaatccgtcgagttgcgtccgaagttcctcggagaacgagaacattcgtccgaatccgtcgagcaactcaccggaatgttggcctgtccagttcaggaagttcaccgggaatccgctggaaccgctgccgttgacattatccaggcagtttttcaatttatcaggcactacatcggccggctcattgccggcatccagcatggcatgcacccaacgatccaatgcgtaggcggtgagctgacgttccaataccgcggtcgcatcgaggaagatgtgcgacgggttcaccgcacctccaagcatgtccttcggccgctgatagaaatacgtatcgtgttccttggtattggccaccgccagcaccaaggagttgccgtcacgtcgccctgcacgaccggcacgttggatgtactgggcttgggtaggcggaatcgacgagagaatcaccgtggagaggtctccaatatcgatgcccatctccaaggtcggcgtacaggcgagcacgttcacgtcgccgggcttgcggttcttgcgtttgaactcctcttcgaccttggcacggtcatcgccattgagcagccccgtgtgttcggcagcgtggatgcgatcggctggctctccgcagtacagcttgccatagtagcgcaattccagggcttcggcttcaggagtgccggataccagtctgcccgaacatttgcggatacggcaacgtgctccgttccacgcgtcaaggttctgcgtagcgcacgaatagctccgtccacacgtgtcgcagatcaactgcgttaccttgccgctgaccgtgcagccggactcgttgagcccgtacacggtgcgctccattttcatgcttggataacgttgctgcgtgatgaatcctactgctatgcactcttcgagcacgattcccaacagttcatgatgaatatcaccttcaagggcaccgtcggtgaggtaccggtcgacgattcgacggtatgccggcgaatccaaggtatcgaaaacgcctttgcgcactggctccttgtccgacaggaagtagggcatgccatccgcgtacatgccgggcatccatttgatgttcgcgttggagagcaggaacttgttgccatcattctgcaggaactggtcataggtcacgtcgaagaacgcgcctttcatacgcaactggtcgaggaacgccatgatcagtcggagccagtcggccttcatgatggaattctcgtgcagtccgatctcgttatggcaacgttccgcaacggcctgtgccacacgtttcaggagactctggtcgaatgctattgcggcgcaaccggatttctccaacgtgcgcccggtacgggagcgcatgccgaactccagcagcgattccaatcggagtctgcgcttgatccaatcgagcagctgacggcgaccgggcccggcaggattgccctgcaatacggtttcgtattcgcgcatccatgtcatgttcggtgcgatgaaccgcacaatgtattcgttttcgtccggatagcggcgatggtagtagctgttctggttattgagatactcagcgagagaggcaccgtctttgcgttcctcgcgcatgtagtccatggcggagttacgcagagcgaatcgccaagtgcgggagttgaacacgctggctcggtaggaggcatcctgcacgctgtcggagaacacaatggccttgctgtcgtcgttgaaggagtctccggaaagttgggtaagcatcacactgacctgcgtagtggttctcacaccgaccatggcgatgtcctgttcgctgccgcagaacggacactgatagtgtttgcggttgccggatacgagcttcatgcccctagcgaccatgggtatacgctgctctccacaggccgggcattcacgttccgtggattcaaaacgttctacggtctgttccttcatgcacgcattgcagaaccagaccatggctccgttgtcggcatgtgggtcaagaacataatccatggtgcagggttgcaaggtcaccaacgcattgtcggcatggtaggcgaaatactcgttgtagaacgttcgtgggtcacccatgctgatgccgccgtctttgccggcaagtccaatccatgcggttcctccgcaatcacggcagttaatcaccggcatgcgggtcttgaggtcgtctttggacagttcgacgaccggacggtagtcgatgctctcttcctgcggggtgatgttggcgactacgcggccgagttccttgacccatagttgtacctgtacgttcaggaacggacgtgtgtgcccctccgaaccgttgcgagcgcgggagacgagcgctatcagcgcatttacacaggccttctgctggcgtgggtgcaaggcgttgaacctcgcgtccataatggcaagcctatccaacagtttgcgatcgatttgctggggttcgtcacagataagcgcggacaggctggccaggaaccttgaatggcgcagggattcggcgagccggatgcgggccttgtctgcggagaccggctctgtgggggcgtcgtcaagccacgtttgggccgcataggcaaggtatttatcggggtcgacgtcctcttcgagttcgatgagccgatcggcctgcgcggcagtaggcatggtgtcgtcatagtcgctggtgacgaagaattcgtcgacgcgaagacgatcctcagtcaccacggattccggcgtgaacgtggtgttgaagatttggctggcatactcacagacgtcacgtaccgtctcttcagtgcccatggtggccgacgtgccgacgaagcacatgtcatcgctggtagtattcagcctgtcggtgagcctgcgcagcaggcaggccaggtcggtgccctgcgcgccgtcgaaagtgtgcaattcgtccacgacgaaatatttgagcgtatccggatcgttgctgtcccaaatccgggagtctttgggacgtaccagcaggtagtcgagcatcttgtagttggtgagcaggatgtccggcgggttcttgagcagctcatcatgactggtcacgatgttggtggcggtcatggcgtggttgtccttgtcgctgccgccttggctcatctggcccacatacatgcccgcggtcacattgttgcgcagttccggactgttgtggatgagttcggccagtcgcttcgcctgatcggtggcgagtgcattcatcggatagacgagaacggccttgatgcccttgcgcccaagcctgcgctgccggtaacagtagtcgaggattgggtacaggaaacattcggtcttgcctgaaccggtgccggtggccaccagtgtggattcaccggcggagatgcgttcgaatgcgcgcatctggtgcgcatatggccggtacgtggggtgcaggcaggggaatgggaattccgcatgtttgccgaccacacggaacggcagtttgaccgatacgaacggctcctgggaaagcatgccctcttggtgggcgagtttgcggatggagccgcggaacggcttgttagtcatggggaacgtggtctccacgtaatcggcgagtccggactggatgtgccgtgcaagcaccatgggaatcatttgttatctccatacttctgtgtgaagaacttccatgcggtcttgtaatcctctacgcgatcgcatttgtcgaacggcgccacatattcgatggtccgctcacgtggtccacccggctgggtgtcgtccatgatggtgcgggtgaacacctcgcccgcaggcgcgttcttgattttctcgaaatcaggacgtttgaaagtcaaatcaccgtaattcttcttagagaacacgatacgaccattcgcgtcgtaccaagtgtcgtcctcgtagccgctcagcacggtgaaggtcagacggtagatgtcgatgagctcatccaaggtgatgccgagcgccatggatgccagtacgtccagctccaccaacgcctgccggcgttcatagtccgtgcgcaatggcgtatgccagttccactcattcatcaatgaggtgaacgtatcggcggtaagtcgaggatcatccttcgcccagctcatggacgtatacgactcgtcccagcaggattgccacaggtctgcatatggcttggtcagacagttgagcaacagaccgcggagacgaatttcgggagccagaattgtttctggaactggaaaaagctgcagcgtggagctatgaatatccattcatagccaatggagcgcacgagaaaatcatatggcagagcggcctcgaggccgctcatgagcgcgagcaacgcgtagcgctctgggtgcacaccataacctgttatggtgtgcacccaggctgcgcctgggtgaacacaggacgcttgcagcgtcctttcactaactaaattaaccatacgacggcatgcgaggcgataaacagcatcgaaattgcttccgtcagacattttcgggagtctttgctggtactcaaaatcggtacaagcttgtctgtatttcgttctcggctcaaacgaatcatttatctccatcaaatcaagcaaatcatagtcattcctcgtcttccaatttcttttcgcaccttgcataagggggttggcgacgccaaggaatggactggaataaattattttttcatcgacactgggaaaatgaacttcgtcgcatatcgtaccgtctttacgtgcgttagtttcattccacatgctcgaataagttatgtcttccccataatcacgtaagcaacgagatacacttgccattttacaaattgcatcaaaaagctcttgcgcatgcacagcaacaagcggggtgtttctccacgaacttgtcccctgttcacttagcaacaatgcaaaagttttaagctcggattcctcaatgtggataatacgattcttgtggccttttacctcccaattccaattatcatctttagttcccggcacgtccccactaccatcagatgcatagcattcatcgatagtggacggcgcatacaaattccaaatcgaatcaaatgaaatgcttgaattaattttatttctatagatattgagactgaactgtgcattgctgtccacgcccgcaaacaaattaagtctattctgaaaatggaaatggctacatatcctacgatacatttctcttctaagaagtggagccttcgtgtccgcataaacctcatctggatggacaaatgcgcttacgccattctgcgcacgcgtatagctccaggcattcggcaggaaacagcggaacaaattggttcgtccctgtagtagtgggtaattccccactgaaccatagaatgccaaagcaccggcaatattcacatactcccgaagatacataattcgtatacgtgcgttctttagaagttcacccatacgcttactcagatcggaagccgtaagcttatgaatcgcaaaataaggattcgcatcggaaacggcatccgtctcactccactgcacattcacccacggcgggttgccgaccatgaagtcgaagccgccgtctttgaacacgtcggcgaattcgagctcccagtggaagaaacgctgcttcttggcgatttccttcaccaagcgaagcctttgcgctggttccccatcacctttgcaaagctcatcgagatccacagtgtggtcatacatgtagtcgcgttcatgactatcgtccatggtgtccataagcgtgggctgattgttatccatcgacatcagagtgaatccctcttcctgtggaatctcgccggtgaggatcagcgacatttccgtgagatactgcgatcttgtggggagcagacccgcctgatcgataggccagaaccacagcgagcaccagtagtccatggcaagtttcaaacgagcgtattcgctggcgttctcagccttttccgaatggtaggcaatgcgaagcatctcatctttctcgcgaatggtgaggttgttgccacggaagtattcattttcgatgccaagcaacccctgcccatgcttctgctggttttccaaagccttcgcggtctttttggaaacgttcgcgtcaaaaccgtagataatcaaatcgtcttgagtcgccttttccaattgccgacgcgctttgatctggccgcgccatagttcgtcgatggtctttgacaacgacctcatcagaccaatctccgtctgggaataaggcttcttggcgaattccttcttccagaccttgatggtttccaaatgttcggattctatgcttttgacggtcttgtcgtcatacctgcacatctccggatctccggtcaggaactggtagatacgcttgatggatgacgaactctggttgaacccgatatgcgtgggttcgacctcataccagtggcggtttttggtagcgctagccagattcgattccgaatatccgacgcgacggccgccaatcagcgaattgccacattgcagctgggtgccgaaccatggtacgaaggatccttcgcaaatggtgttgagccatagggacacctctccaagttccactgccacggggttcaagtcgatgccgtagatgttgtggtcggcgatgtacatcttgaccttctgcagttcagcttgcctgcgttccgcgggaatggccgccttctgtccttcctcggcgacccgctccttctccctgcggttcagatacatggtggccagctggttgatggtctcgttcaggaaggtcgcggagcccatagccggctcgcagatcttcaggctcagaatatcggtggcttggtggatacgtggctcaatctccttgagcgcatacttcaccagacattgcgcaagactgtccggcgtatagaaggaggccgacgtttcacgttcccggcctgcaagccggtaaatgaacgtgccgggctcgtaggtgcgcagctcgccagcatgcggggttttgtccgggtagcggacgcgttcgctctccgaatagttgtcgagttcgcgttccggcacgaagtagccgactttcaaagggtcgtaggaatccttggcacgtttgacctcgtagagcttctccttggcgataaaaccacggtaggacagcaatgcctcatacacggcacccatctggctgatgcccagggccgcataggagatgcgctgcctgcgtttgactcccttacccgtcttggtgacgctcatcaggtcgatgatgcgcagcatcacgctgtcgcggagtgcggcatgttcaatcagcgcggtccgctccggatcgaaaatgtgcgccttgagcggcggaaccatgaacaccgcattgatggcttcctcgccaaccaaccccttgaaatcctcatccgccttcgggtaaccgttgaacaccagatcgtcgagtcggcgcaatgtgtccgctagataggtggaatcgccagcctcatccatgcgaccacgcatctgttccgcaatatctcgcaagctgtccagcgaatagccggtacggtagatgtcggatttcatcggcgcatagccgagcgacggcttcgcctcgatgaacaggaggaacagcagacggtacatgtagcgtaacgcctgcacagtcaagtcgcccgcgtcgatttcatcgatgctccgccccttattacaagtccagtcgtggatgacctcgttgccaaggatctccacacattcacgtaacgcggaacgcagattatcagacacctcaaccgcgttcttcgcagacgtgtcatcaaacgtgtcaagcagactgtcacctttgttcgggcagagactatcgcgacgcaacagcacagccatcgccgtatacacatgatcctgatggcggctgaagatctcgtccagatcgaacagcatgcatttcttgtcattccatttacggcggtcgatcaacgctatctgatgcaaccccatgagaagaatccaccgtgccggctcgtcgaaatcggcgagcagcatacgtgcatattcctcacaggaggtgccgtcctttccagagccatcttcgatggggctttccagaacacctgcctcagcactatcggacaggctcaccagaacttgcaagcgcggagccccatcggaatcattgacctgatagtagacaggaacagacttccctgaaatccggtcagacaatccctcgtctttggtttgattcccctcctgcgtatagccgagtgcggcgagcatgccgtcgatgaaattccgtacccgttcagctggaaacagatcgttctcgttgttgttgatgacttcggtgaacgactggcgcatgtccttcagcagtcgcgctgggcgttcctcgggaggaagctgtttccaaggtgtggaggcattcttcacttcatccggaaaatattccttcatatagtacggcgtgtagaagtcgttgaccgcctcgatgcctgggaatgtctcgttcagttccttcgccatggtctccccctctattccttacctacgaatgcggccgcaatgcggattactggttcgccggaggcgtccaatgtgtcctgaacccagtcggcatagtgttcgagcatccgatcaacctgttttgtgttttccttggtgtttttgccttgggattgcaacagtgccttgcgtgcatgggaccaacgctcgatgcggtccatttgccgagtcacttcttcatctgcctgcgcacgatattgttcaccgcaatcgctgagcatgctcttgccgcgcgataccgcatcctccaacagcagttgtgccgcatctatctgttcggagctggccgcggaatcctctcgattcacataacgacgttcagtggttcccggaatcaagttcccacgatatccggtgatacgccacacttcctcaagtggcagcatgcccatgcattcgccatcgagataccgtacaccgaaccattcatcgatcaccggggatgcgtgcctgttggcgaccatgccgttcatcagcataatcgtctcatccgcatgcaggtttccgttggtcacgccaataatcggggcctcgtcacgttggtacagcagtgaggaagccttcaacccgacccattccgtgatcggattcaattcccacaggtattggacccgactccatgactcgtcgttgatacgtgccagcagaccattggcttggtcttcgcagtatttcgcgtcatcactccattcggcgatgttgtcttgcaacacccgcgtgttcggcacacgtctgcgcagccacgcgcgcaacgggctatccccttggaactccaccgcgaatccatgagcatcacgcaactgacgtttcgagctaagaccagccgactgccggaactcctcgcaggagagcccctcatccacatactcgtaatccgacatcagcgtagaggaatcgactatgccgccatcgtcggcactcccagtcacgctctcccctgcgggctcgttttcctcagtgctcgtagtatcggaaccatccagcgtagtgaggttgaaaaagctcaatgggtcgaaaacatcgtcatccggcacagtttcgacatcttcggagcgctcgtccgaatgatcgatgtcctcgtcaggaatacgaagcctagcggcaaaatcttccgccgattcgccggactcaatcgcttcgcgggtgaactcttcctcctgatcgacatcgaatttgcccataagcagagacggatcgccgatatccttacgcgcttggtcttccttctgctgcagaatctcaaggatatgcgtgtcaccctgaatctttgcattacgcgagcaaatcatcatgaaacggatatcaggctgtttgcgctgcccgtaacgatcaatgcgtccgttacgctgctggaacaccatcagcgaccacggggtgtcgaaatggatgagcctgtggctcagatagtgcaggttcaagccttcggaagccacgtcggaggccacgagaatacgtatagacgatgacttcgtgccgaaatcctcgacgattttctgctgttccacatcactcatgcctccatccatggagacgatagccttcttcggtagtttgagatcctgccgcaagtgctcctcgagatagttcttcgtctcgatgcgttccgtgaagatcacgatacggtcgtcagcatcctcgccgttatgccaaccataatcggcactgcgcaggagctgcagcagtctctggtatcgggagaactgcatcggaccgattttctctaaagcggccttgagtccttcaagcctgtcgatgtctccggtctgatcggacacatcttttttggcaagccgctttactctctcgtcgatggtcttgatgcatgcagccggcgacgaaaacagacttttctcaagcatcgtcttgaacaagaaggaattgcttctcttctgatgcatgtccatgacgagtttcatatcggtcagataatcgaatgcctcttcctcggctgcggtggccttgcatttctcctgcgtcaccttgcgttccgggaagctgcccgacacctcggccatcacgtccttcttgaaacggcggacgtacaggtgctcgacgtctttcttgtcgtaacgctccggatccggcagagtggttgggtcgagcatgttcatcaacgaagcaaaactgcgagcgcggccgtcatgcggcgtggcggacagcatgatcaacgtgtcggaacgggaggcaaggcgtttggcgagtttggcgcgctgcgcgctgcggccgttggcggcacggtcggcgacattctgtgcctcgtcgatcacgatgatgtcccaatacgaggcatcgagtgccgcgccatattggatgtccctcttcaacgtgtcgatggagatgatcaccttgtcgtaataggagaacgggttggcgttcgcggggatctcggaacgaatctgctggatgcgtgaggagtccagactaatcagcgggatggtgaaccgttcccacatctccttctggaactggaccatcatgcttttcgccgtcaccacgagaatacggcggcccttgcggcgcttgatgagttccgacatcagaatgccggcttccaaggtcttgccaaggccgacggcgtcagcgatgagaatgcgctggcgaggttgggcgagcgctttcttcgccggaacgagctggtacggcagggagtccatggctgccttgttgccgacatgaatcctcgcatcggtcggcgcagtggcacgtaacagactctcgatgaacagatgcgacttcgcagctcttgccgaggtgtcgggaatgaagcgggtcttcaccggatcgacaggcgtgattgtgtccaaatcatcaaggaacgtggccgtcatgtcccgcaccagagcggagataccggtgcatgaaacggcatggttgccaagactgttcggctcgactttatcgacaagccactcctggccgcggatcagcactctcatgccgggagaaagcagttctcgttccgaatgtgcgccatgcctcattgccgtgtgctccccatatgctctcaatcccaatgttttcgcatatattgtatgtcattaggggtacgcttcatcaatttgccgcatgaatgctagatacgcacacgcttttatgattgatactcataattatctatatctttcgattattactttgcttgaatcgtcagagcaagtgcaacaccgttgaatggtggacttcccagggtgtccggtatccatggcgtttgcgtggtctgtgatcgatggcatcgtacacggcccggacctcctgctcgccgacggcggtgaagccggcgcccttggggaaacactcacgaatcagcccgtcggtgttcccattgccgccacgccgccatggatggcggggcagggcgaagcagaacaccgcgccggtggcctgtacgaccttctcgaagtcagcgaaccccataccccggtccaaggtcacggtccggctctccggatgccttcggagcgcgccgatccccacatcggcaacgtcgcgtctggcatgcgcggcacagcgtcctccggagagcagaccgcttctgcggtccacgagcgtgacgaggcacgccccggcgcctttgccgacgacggcgtcgccttcccggccgccgagcccggaacgttcccccacgatctcgggacgctgcccgatgggacgggcgcccgggatctcgccacgccgttcctccgcccctcccgtgccggcgtttgcctttatgacgcagacgcgccctgattccacggcggatacgcgtcaggccgggtggatcaagccgccgctcgttgatcgcccggtggatcgcggacgcaaagaccatcagtcccggccgttcgaccgcgatcccgcccgcgatccgcccgggcgaccgatgctcccgcacgacaagacgccgcacaagccccgcccctcgctcgccgtcgaggaccccgggccgcacgcaggaaacccttcgggactcgcagccacgctgggcggccgatgcacgatggcaccgccccgagccaacggcgaacgagtttccggccatctccctgctgatggtcgctttgtccccgcccgtcgctccggccatcccgccgcagccccccgtgcctcagcaacacgatttcctcgcgctcggccaaggcaagacgggcgtaccggcccatgggacctcccgatacccggtcgtcgcaggcaaacaccatcgtaccgggaacccatgggcccacatcatccacaagcgttgcaccagcaatgaaaattcaaggcacaacgtcgcaacctgaaccgcacctccgatcatcgaatctgaatttcttcagtccaacaatcggggtgcggttcaggttgcgacgttgtgcacttttatgctgtccatatagtgcgatcactgcggaatcttcggaactggaatcttcgaactcgaaattcccggaatcaatcggcggtgatcagctcgctcgaatccatgtcgaagtcggacatggcaaacgagcggatcgccggatcctcatacgtgttcatgtaatacgtgttggttttcccggaatagccactggtgaacagcgtgcgctcgaactggccgttgcccatcttggacatgccgtcaaccatttgcacggaaaccagcgtgtggaacagacgagacacattagcagcttcgttgttctgctgcggatagtgcgtgttggtgtaggcgacgcgtacgaaacgcgacggcgaactcacgtcaccgggaatgccgtgcatgctcacaccggcaccccatgcgctcagttccgccttgccccaagtggtcggctccgccatctcgttgctcacacacatgtagttgcgcaggttttccatatgaaagtcgaaggtcggctggttggtaagcacgtccacatcgtcatgatgaacgtgcatgccgtcagccatctgctcgacgacgatgctgcgggtgccgtcaccaatgaaccagtgcaacagggattcctgctggccgggcacgacctgcgaaacgagcgtcacgttcttcaacgcctcttcgacttcgtcgacagtatcgaaattgcgcgttacccacagcgggaattcgaaggtagcgacgttttcggttccttcgaccggctcgtgcgcaaaggaggcgtacccagggaagttcagtccggcaatggccagaccatgctcgttggcgcagtcgaaatacatggggcggtcggtcatgaccacgcccacgccgatcaccgcattcggttcgcttttaccttcggccccatacacatagtcgtactggtagcctcgcggagtgaccagaatggtctcgccgtaggagaagctccagtcgagattacggccgaaatacatgtttccctcatcgtcggagaaacgaacaccagtgcacatatggactcctttccatgatttgccgtgattttcttgcttgcgtgttcatggtaagcgtcacttgctgggaaaatcttaagttttgcccgcggaagaatctgctttgactacctcatccatagtatcgtcctcctcaatcatgtatttcgtgtaaaatgtgcctgccgcaatccgtcacacatgtacgcccgcaggaacatgtcgagcgccttcgcatgatcagccgcacagcctctgccctcggccagcatgtctcccagcttgtagcagccctccgcgatccccgcttcggccgcatgacaaaagcactcgtatgccaaaacgtccgtatccggtttgggtggaacttcgccgaaattgttgtaatacgagcggaagtacctaccctcgcagcggtcgtacgcgtacacgtaccccaggcacagccatccgatcgcattgccgcggccggccgcgtgccggtaaaggatcccggcggctctgaaacagtcgacccgcttccgccgttccgatgcggcggtatagtgcatgccctcctcgtagtacatgccgccgaggcccagagcaatcgacccgtccggatcgctgatgtcggccgtggtgcattcgtcgtcctcatcgaagatatcgtcgtagtacggcacgcccgcttccgcctcgttcgcatgaccgatgccgaccgggctgattcgcgcgatctgcgcttccgacaagcgcgacacgcccggattgctcagcacaatcgtcaggggatcactgaagtacaacggtgcactttgacattcgtgcagcgcaatccgggcgtgtcgtgcgacgcgtgtggccgattcccgggccgcatgcgcgtcatacgggaaatttgtgtcaatcccgcaattgcgggtctgcgaagcgtcggttctccagaaccggcagcgtgcgtcgcgcggattcgagaacttctcggtgcagccgggcaatcagcattccagcctgtccgcccgcctcgccctgtccgtcacccgcctgcgcgatgacctcgcccagcgggtcaatgacacggctgcagccgatgttgcgcgcgctcacctcgctgcatgccagtacgtagcacgtgttttccagcgcacgcgcggcggtcatcagcttccaatgtcgctccttcaaacgcccgcgcgcccatgccgcactgacgatgatcacatcggcgccgcgcacggccagcgaccgcgcgacttcgggaaatctcacgtcatagcaggtcatgacgccgacatgccagccgtcaatctcgacgattggcagcagctcggtaccgggacgaaccgtatcggactcccgcgcggcgaatgcatcatagagatgcagcttccgataggtcacgataagagccccgtcacggatgacgacgaaaacgttggagacccgggaatccgttgcgcaagacgccggcttgtccggcaccgcatcagccgcgccgagcacagcatgaaccgtgcccatcaacgtaatatgacgctcttcgctgatccgtctcaggccggtgacgaacggcccgtccagtggttgcgcgtgtgcggccgcgaacatgtcatcatcgccgtcacgcgcgatcagcccttccggaagcaccagcaagcgagcaccggcatccgcggcctgccaggcatatccgtcgataatgtcaaggttccattccggctcccggcgaaccgtgaactgagctacggcgaccttcagctcttgcgtgccattcatggctaccgttatatcagatgcgcgggcatggttcctcatgaatcccgccagcgaccgatacgcctcggtctcacaccgcgaacgccgaccagcgcccgtgcgtgtgttgcacctcgatcggcatgccgaacagctccgacagtcgctcgtcggtcaggccggccttcagtggaccggtgtagacgatggtgccggcggacgggttgcccatcgcgtcaatgccgtcgttggtggcgtcctcggcggagaccggcttgcgtcccatgatggcgatgtggtcgaagcccgcgggaatctcctcaagtcgatgggtgaccagcaccacggcacgccgcgaatcctcttcgccgatacggctcagggtgcgcatcacctgctcgcggccgcccaggtcaaggccagtggtcggctcatccatgatgagcagttcggggtcgcccatcaacgcgcgggcgatgagcacgcgggtgcgctcgccctcggagagccgccacatctccttgccttcgagataggagacacggaagtcgcgcagcagctgtcgcgcccgcgcatactcctcgtcagtataggtgtcgcgccaccgtccggtcacggcgctcaggcccgtgacgacggcgtccagcggatcctcgaattcgggaaactgccggccgaggtcggccgaagccagaccgatgcgcgtacgcagtttgaatacgtcgtatttgccgagctgatggccgaggatgaatacgcgaccgtccgaggggaacgtgcgcgtggcgagcatgccgaccgcggtggatttgccgatgccgttcggcccgaacagcacccatcgctcccccgcgtggatgatgaggttcacgtctgtgatgatgacgcgccggttgcggcggaattcgacgttgtcgagcttgaggacttcgttgtcggcggtgtcggtcgtgggcatgttgtggttccttgtcgtggggaggtttgccggcagtgcgggtttggaatggttgcggtaattcgcgaagccatgccatccggccatgccgcgcattacggccccgcaggcgggggcatcattccttgcccccgcctgcgtcggatcgccgttacttgttctgctcgtcgaggacggactggtagacggccacggtcttgtcggcgatggactcccagctgaaatggtcgcgggcgcgctcgtagcccgcctggcccatcttcctggcgagttcggggtcggccatgatcttgtcgatggcggcggccatgtcatgcacgaacttgtcgggatcggtgggcgtgccggtaccgtcgcgcagctggtcgatcggcaccagatagccggtctcgccgtcgacgacgacctcgggaatgccgccggtggcggaggcgactacgggcaggccacaggccatggcttccagattcacgatgcccagcggctcatagatgctcgggcagatgaacgcgtcacagccatgctccagcgcgttgaactccggacgaggcagcatctcctcgatccagatgatgttgccgcgttcctcgtcgagcttggcgaacgcggtcttgacctcctcggcgatctccggggtgtccggggcgccggcgcacagcaccacctgaatgtccttggagatcaggtgcagcgccttgagcaggtatggcaggcccttctgacgggtgatgcggccgacgaacagcagcgtaggcttgctgcggtcgatgtggtaacggtcgaacacggcccagcccgggtcgtcgtcggccggcgtggcgaagtcgctcatggtgatgccgttatgcaccacgacgaccttgtcggggtcgaggttcgggtacgcggcgaggatgtcctcgcgcatgccgccggagacggcgatgacgcggtcggcgtgctcgtaggcgtccttttcggcccaggagctcagattataaccgccgccgagctgctcgcgcttccacgggcggaacggctccagcgaatgtgcggtgatgaccagcggcgtaccgtgcagcatcttggcgaggtatccggccaggcacgcataccaggtgtgcgcgtgggcgatgtcggcgtcgacgtcgttggctatctgcagatcaacgccgaaggtcttcagcgccggattcgcgtcggccagctcagagggcgttccgtagcccacgactttcaggctgcccttcgccgagccatctccggggatggcgggtgcatcggcttcggtgcgcggtccgtcgaacgcacggacggtcacgtcgacccgctcggccagcaccttcgagagctcttccgcgtgcacgcctgcgccaccatagacatacggcgggtattcgcgggtgaggatatcaactttcacgattaaggcctccttcgtcggtaaccttgtttgcggctactgccatatataactttagggcattgcacgtcgaaaaaacgcacaatgcccatgttcgtgttggcgaaaaatcacgccataataccagataactaccggataccagactctcacaccgcggtgccgttggcgtccaggttcgggttgttgcggtagttgccggccgtgaagaacaggctgagcacgccgacgacgaacacgacggacacggtcaggatcagccacagcggatgcgtgggcagccacatcaccacgaagaacgcgatgaccgacagcgcgatcagcgtccagctgccgacacggaaccactgccgcacggagtgcggtgccttgaacgccttgggatcctgatagttcgggttggcctcgaacaccgactccacttcctcatcgacctcggtgcgagcgctgggcttccacacgccgctgtcatccacgccctcctgaatacggcgggacttctcctgaagcgcgtactcgtcgagcatgccggatcgggcacggccacgggtctggtcgtactgcgacgggactccccgacgctgatcttttgctgctttgcggcgttcggcacggttaggcatcgttacttctcctgctcgtttgtggataacactcctatgtactgtactccaagccgtgccgtagcggcggttcgactcgcacgacgagacagatccgcaatcgttggcaatcacgacgtccgagccgtggccgcgacacgtaccaccccgcacatagccggcctcctttctgcggctcacccacacatgagcgggccattcctccggcgagaacccaccggcacacaacgggacgggactttcgccagaaatagggagcgcccgatatgcgactgggggccggaagtcccttgaagagacttcctgcccccagtagatgtcggtacggcgaaccgccggactgtcgaatcatcgcggcagcatcatcggacgctgggatgcggtgatcggcgcgggcagctcggtgacgccggtgaggtactcatcaacggcggccgcgcaggagcggccctccgaaatggcccacacgaccaggctctggccgcggcccgcgtcgccggcaacgaacacgccatcctgagaggtggcgaacttgtcgttgcgggccacgttgccgcgcttgtccaattcgacaggcagctggtcgagcagcgtggaggtgtccgggtgcaggaagccgaccgagatgagcaccagatccgcgggcagcacgcgttcggtaccgggctggcgggtgaacggcccgttctcccccggtgccacatccacgaccttcagaccggtgacgtggccgttctcgtcggccacgaatccttcggacgcggtggaatcctcaatgtgcacacgggcctgttcctcgtcggagccgacgaagttgacagaatcggtgctgtacacgtaagtgccgccctcctccatcgaggaggtcttctggtagagacgcgcgaacgtcggccacggctggttgtccgggcgctcgtccggctccttcggcatgatctgcagcacggtcacgtccttcgcgccttgacggatggaggtgccgaggcagtcggaaccggtgtcgccaccaccgatgatgatgacgtgcttgtccttggcggtgatgtcgtgcacgggctttacaccgtacacgcgtcgggtcgcgtcgggcaggaactccatcgcgaagtgaatgcccttgagctcgcggccgggaatcttcatgtcacgcggcacggtggagccgatagcgacgaccacggcgtcatagcggtcgcgcaaatcgtcccagctgatgtccttgccgatctccacgcccgtgcggaagcgggtgccttcggcctccatctgcttgatacgacggtcgatcagtcgcttgtcgagcttgaagttcgggatgccgtagcgcatcagaccgccgatggcgtcatcgcgctcatagacgacgaccgtgtggccggctcgggtgagctgctgggcgcatgccagaccggcggggccggatccgacgaccgccacggtctggtcggtcagacgctgcggaggcatgggcttgacgatatccagaccccatgcctggtcgatgatcgtctgctcgtcgagcttgatcatcgtcggcggctggtggatgccgagcacgcacgccttctcgcacagtgccgggcagatgcgtccggtcacttcggggaagttgttggtggtggacagacgattgtaggcgtcctcccacttctcctgatgaaccagatcgttgaactcggggatgatgttgccgagcgggcatccggtcatgcagaaaggagtgccgcaatccatgcagcgggcggcctgttcggtggtccacggctgcaagccggactcagcatggacgtcaagccagtccttgatgcgctcctcgacggggcgttccgccagttcgcgacgggtacggaccttcaggaatcctctgggatctcccatgtcagtgcgctccttccatcacctgctcgtacacctgttcccaggcgccgggcgtgttgaaatcgatattgtcttcctcggccttcgccatggcggcggtcatggccagatagtgttccggcaccacgtgcgtgaaccgggcgacggtgtgcttccaatccttgaggagtccggcggcgaatgcggaaccggtctcttcgacgtgacgcttcaccagatcgtggaccagtgcctgtgcttcgtcgtccagcggtaggaacagcagcgagccgtccttcgccgcggtcggattgacctggttcatgtccagatcgagcacgtacacgttgccgccggagaagccggcgccgaagttgcggcccatggagccgagcaccacgacggtgcctccggtcatgtactcgcagccgtggtcgcccacgccctcgaccacgaacgtggcgccggagttgcgcacgccgaaacgctcgcctgcacggccggccacgaacagctctccggaggtcgcgccgaaaccggtcacgttgcccgcgatgacattctcgtgcgggtcgaaggtgacgccgtcctcggggcgtacgatcaggcgtccgcccgacaggcccttgccggcgtagtcgttgacctcgccgtagacgcggatggtctcgccacgcgggatgaacgcgccgatcgactggccgccggcaccgtggaacgtcatgtcgatggtgtcgtccggcagtccttcggcaccgtagcggcgggtgatctcgtagccgaccatcgtgccgagcgtacggttgacgttgcggatcggcatctcgatgcgtaccggctccttgcgctccagcgcgggttcggccatctcgatgagcttgttgtcgagcgccttctccagttcgtggttctgctcgatggtctggtgcagaatcgttccgggaaccgggccgggctgcatgagcacgttgctcaggtcgatgccgtcggacttccagcgcttgatcgcctcgttctggtccaggcattcgacatggccgacggcctcctccagcgtacggaaaccgagctcggcaagcagttcgcgcacttcctcggcgatgtacatgaagaagttgatgaccgcttccggcttgcccttgaaccgggcgcgcagctcgggatcctgggtggcgatgccctgcgggcaggtgttcttctggcacgcgcgcatcatgacgcagccctcgaccataagcgccgtggtggcgaagccgaattcctcggcaccgagcagcgcggcgatgatcacgtcgcggccggtcttgagctcgccgtcgcactgaacgacgatgcgggagcgcagaccgttcagaatcagcgtctgctgggtttcggacaggccgatctcccacggggtgcccgcgtggcgaatcgcgttgagcggcgccgcaccggtgccgccgtcatagccggagatcagcaccacgtcggcatggcacttggccacaccggccgcgatggtgccgacgccgaactccgagacgagcttgacgtggatgcgtgccttcgggttggccatcttcgcatcgttgatcagctgcttgagatcctcgatggagtagatgtcgtggtgaggcggcggggagatgagctccacgccgggggtcgcgtgacggaccttggcgatccacggcgggaccttggcaccgggcaggtggccgccctcgccgggcttggcgccctgggcgagcttgatctgcaggtcggtggcgtgcaccaggtaatcgctggtgacgccgaagcgggcggatgcgatctgcttgatgcggctgtaacgcagcggatcctcgatgcggtcgtcggattcgccgccctcgccggagttggaacgcgcgtcgatcgtgttcatggcgatggcgagcgtctcgtgcgcctcttgtgagatggagccgtagctcattgcgccggtggagaaccgcttgacgatctcggaggccggctcgacctcggagatgtcgatcggcttgcggtcgtacttgaacttcatgagtccgcgcagcgtcataatgcggttcgacgtgtcgttgatgtggtgcgagtacttcttaaacatctggtagtcgccgcgagcggttgactgctgcagcaggaaaatcgcctcggggtcgttcagatgatcctcgccggtgcggcgccacttgtattcgccgccggtttcgaggttcatgtgcggggtggcggtccactggttcgggtaggccacgcggtggcgaatcgccacctcctcggccagctcgtcgagcccgatgccgccgacctgcgagaccgtgccggtgaagtacttgtcgacgatgtccttgctcaggccgaccgcctcgaacagctgcgctccgcggtagctcatgatggtggagacgcccatcttcgacatgatcttcagcacgccgatggacagcgccttggtcaggttcttcacggctgtgtgctcgtcgaccttcaggtagccggtgcgggccaggtcctcgacggattcgaacgccagatacgggttgacgcatgcggcaccgtatgcgatcagcagcgcgacatgatggatctcacgcacatcgccggcctcgacggccatcgagatctgcgtgcgggtgtgcttgcgcagcaggtggtgctgcacggcgctggtgagcagcagtgacgggatcgggccccacgtgtggttggaatcacggtcggacagcacgatgaagttgctgccgcccgcgatggcctcgtcgacttcggcaaagatctcctcaaggcgctcgcccagcgccttgccgccgccggcaacctgatacaggcccttgacgacgaacggacggtagtatccgccgagcaccttggccttgtcgagccgcttgagctgcgccatctcgtcggagttgatgacgggcagcgggatcaggatcttcttggcgtgcagctcggaatcctccagcaggttcggctcggggccgatggcggattcgagcgaggtgacgatctcctcgcgctcccagtccagcggcgggttggtgacctgcgcgaacttctggtggaagtagtcgaacagcatgcggctgcgcttggagagcaccggcagcgggttgtcgttgcccatcgagcccagcggctctttgccggtgttggccatcggcgtgagcagcatcttgaggtcttcctcggtgtagccgaacgcgcgctgacgacgctgcacggactggccggaatggctcacgtgctcgcgctgcggcaggtcgctcatctccacggagttgccttcgacccacttacggtacgggtgctgcgaggcaaggttcctcttgatctcctcgtcggggatgatgcggccctcgtcggtgtcgacaaggaacatctttccgggctccagacggcccttggagacgatatgcttgtcgtcgatctccggcagcacgccggcttcggaggcgagcacaaggtagccgtcatcggtgagctgccagcggccggggcggaagccgttgcggtcgagcagggcgcccacctgcgtgccgtcggtgaagatgatgtcggccgggccgtcccacggttcgatcagcgtgttgttgtactcgtagaacgcgcgcacgtcggggtcgagctggtcgttgttctcccatgccggcggcagcatcatcgagatggcgtgcggcagggagcggccggcgaggtgcagcagttcgaggcattcgtcgaacgtgccggaatccgaatagccgggcgtggtgatcggcagcaacggctcgaactcgccgagcagttcggagctcaggcggccttcgcgggctgacagccagttgcggttgccctggatcgtgttgatctcgccgttgtgggcgagcaggcggaacggctgcgcgagcggccagctcgggaacgtgttcgtggagaagcgcgagtgcacaatcgcgatcttcgccttcatgcgcgaatccgacaggtcggggaagaacggggtgagctgcatcgtggtgagcatgcccttgtaggtgatggtgcgggccgacagcgacgcgaagtagatgccgacctcatgctcgacgcgcttgcggatgcggaaggtcttgcggtcgagctcgatgcccgccagcttgccttcggcatcggcgatgaccagcgtcttgaagctgggcatcgaggcgagcgcctgcaggccgagcccgtccgggttggtcggcaccactcgccaggcgagtacttccagaccctcttcgcgcacgatgctcgcgatggcctgctcctgctggccggacgtggcgatgtcgcggtcgaggaacgcgacgcccgccgcgtaatggccggcctcgggcagttcgacgcccgtggtggcccgcatgaactcgtcgggcatgctcatcaggatgcccgcaccgtcaccggtgttctcctcggcgcccacggcgccacggtggttgagattgacgagcacttcgatggcgtcgtcgatgatcttacgttccggccgcttgttgagtgtggtgaccatacctacgccgcaagcgtcatgttctgagcttgggtcgtacagaccttgtgatttatgtatgctcaaatcgagcggggcgtggaaagtcaccgaaaccaccttcatatcgttttggcaggatcttgacaacctgcggttcttttgttaatgcgtaggaaagagtaccgctcggctatgtcaaacacgtttcgctgtccatataccgagtcgaggtgtttgtcaatacccaatttcaatgtttctcaagcgattcggaaaatctgcggcacccgtttcgcatgtcaatgagatgtctcttatgtgaatggcgtgttaagtgtgacgaatatcactgtcactgccgccgggcccctttgcccggcgaagacgtcactgcccggcgtcgtatgcgcgatccagatgcatgaaatccggcacccggtaccatttgaccgtgtaaccggcgccatgcgcgcagaacaccgaatcagggatgttttcgagatcgtctcccggatcgtatcccgcttgttcgatgacctcggccgcattgtggcatggccggtagccgtcgaacacgcaccccagatggcccgtgccgtgggtgtagacgttcacgtccatggcgtagtcgcgcatctcggataccgggcagactcccgccagcacggcgtactggccgtccatctcgggtgggtcgaacgtgcccgacatgcgttgtatgtcggacatggcccggccgagcatgtcctgcgggatgtcgagccggaagcggtaccacggttcgagcacccggcaccagccgggatcgcgggcggccgcggaggcgaaggcgctgccgtccgacggctccgattcgtccgtccgggctgttttggcatcggctgcggccgcgtcttcggcgacgtcctccgcggcgtcctcgtcgaacaggtcgtgccgggagaagtctccctcgaccagggcggtcatcagcccctgtcggatggcccggtaggtggcttggcggaaatcaccaccctccgtatgcttctcgtgcgcgcggccggtgagcagcgtgagcttcatgtcggtgatggggacgccaatgagcacgcccagatgctccttctcggcgaaatgcgtcaggatgagcctctgccagttgcgggccagcacgtcttcggaacaggatgtggcgaaggtcagtccgctgcccggctcgcccggctccagcagcacgtgcgcctcggcgtagtgtcgcagcggctcgaagtggccgatgccctccaccgcatgggcgatcgtctccttgtagaggatggatccggggccgaagccgacgttcaagttgaaacggtcccgcatgatctgctggatgatctccaattgaaccgcgcccatgagctgcacatggatctcctgcagcctctcctgccataccacatgcagcagagggtcctcatcatccagttctcgcagcgcggtcaggcaacggtgaggatcctccccctgcggcaacagcgtgtaggtgagcaccggctgcagcaccggggcgtcggcgtcgcactggtcgcccagcccctgaccggggcggctgtgcgtcaggccggtgacggcgcagaccgagccggcgggcagcgcatcgaccgtggtgaatttcgcgccggaatacaggcgcacctgatcggccttctcgtcgccgtcaagcaccatcttcgccttgatctctcccccggtgacgcgcagccacgtcagacggttgccatgctcgtcatgcgacaccttatatacacgtgccccgaaacgagcacccggttcgatctccttggtataccgttcaaagccggcgaggaagccatcgatgccctccatggcgagagcggacccgaagaacacggggaacagcgagcgcgcggatatcatggctttcagccgctcgtccgcgacggcgccggagtccaggaactcgttcatggccgattcgtcgagcatcgcgatgtcttccatcgaccgggtcggagcgccgttctcgaagtccacgcagccgtcggagaacctgtcacgcagctgggcgagcagtgcggcccggtcggcaccgggcgcgtccatcttgttgacgaatatgaaggtcggcacgttgtatcgccgcaacaggcgccacagcgtctcggtatgcccctggatgccgtcagccccggacaccaccagtatggcgtaatccagcaccgccagcacgcgctcggtctcggcggagaaatcgacgtgccccggcgtatcgatgagggtgatcgtcagatcgccggatcggatgatggcgggctcggcgaatatcgtgatgcctcgcgcccgctccatcgcgtcggtgtcgaggaacgcatcgccgtgatcgacgcggccgagcctgcgaatctgcccagaacggtagagcagcgcttcggacagcgtggtcttgcccgcgtccacatgagccagaatgcccgcgacgatgtgctttttcatagcgtccatcctatcggcggcgaggacgtgacggcggggagcctcgagcccctctccggtttgcgaattacgggtcgaaaaagccgttatccgcaattgggtgtgtgaaatcgccgtttcggagcctcaaaacggcgatttcacacggggaatcacggataacggctttttcgacccgtattgtgatgcccgccgactactgccggtagcagctgaggaagtcggtgagcttttccgtcgcgtccttgagcacttcgatgcgcggcaggtagacgatgcggaagtggtccggctcatgccagttgaacccgccgccgcgcgtgatgaggatgcgcttgtcatgcagcaggtcaagcgcgaactgctcatcatcagtgatgttgaacttcttcacgtcgagcttggggaagatgtagaacgcggccttcggcttgaccgcggtgacgccgggaatcgagttcaacgcgttgtagatgtattcgcgctgctcgtacagacggccgccgggcacgatgtagtcgttgacgctctggtggccgccgagagcggtctgcacgatcgactgggcgggcacattcgagcagatgcgcatgttggtgagcatgttgatgccctcgacatagtccttcgcgatggacttgttgccgctgagcaccatccatccgatgcggtagcccgcgatcatgtgcgacttcgacaggccggagaacgtgacacagaacaggtccggggccatggacgctatcgagacgtgctggagtccgtccatcaccagacggtcgtagatctcgtcggagaagatcatcagctggtgttcgcgggccagatcgacgatctgctgcagcacctccttcgggtagagggcgccggtcgggttgttcgggttgatcaggacgatcgccaccgtgcggtcggtgatcttgctgcgcatgtcatcgatgtccgggtaccattcggattcctcgtcgcacacgtagtgcacggcggtgccgccggccaggttgacgcaggcggtccacagcgggtagtcggggctgggcaccagaacctcgtcgccgttgtcgagcagggcggacaacgacaggttgatcagctcgctgacgccgttgccggtgtagatgtcttcgatgccgacattgggcaggttcttgagctgcgcgtactgcatgatcgccttgcgcgccgagaacaggcccttggacgcggagtagccttccgtgtcgctgagctgccgggacatgtcgtatacgacctcgtccggtgtgcggaagccgaacggcgcggggttgccgatgttgagcttgagcacgtgcatgccggactgctccatgcgggcggcctcgtcgacgaccggtccgcgcacgtcgtacagcacgttgtcaagtttggtggatttgttgaagtagcgcatgggtgttccttccggttcgtgtgatggtgacgttgtctggggtgcgggcgcttgggatgatggcgtgcgtggcgcgtcggcccggccgccgggattgtccggcacccgtttcggctgcgccggcatgtcgggccgtccgcgatcatggccgagcagccattgcccgtcgacctgcagtgtatcggcgaggaacctgagcgtatccgcgcggggcgtcgtcttgccgctgacatattggctgatgtggcttttgccgagtttgacacctgacgcctgggcggcacgcacgatgtcgacctgtctgaggtgacgggcgttcatggcggttctcagccgcgtcgcgaagctctccaatgacttcctcaattcacgttggttcaaagttcaaattctggttcaaaagaatatcacggctttgtcagcaaaacaacctgagttcaattttatctgtattgaacttttctccgatggacatatttagtttgcttacaaaccaaaaggtgctagcacggcagcgaagctgcacggtacgagaccgcggcggaacgcgagagactgcgaagctctctgcgcaaggtaatcgagaatcttcaagcctgacgcaacaggcatcccgtcgacctgccttccagcactacatcgggcagaacacacgaaaggagtcatgattcatgccgtattccatcaagcggctgatatgctttctggcgggaatcgccatcgaatccttcggcatcgcactcatcacgaaaagcgacctcggaacctcgccgatctccagcatagcctgggtgacgcattctccatcgtgagcaaggtgaagttcggcacggtcaaggtctgcttcgacgtttcactgccggagccactacaggccgaccgcgccgaacatgcgctcgatgacggcgtcgttgagcaaccggcctctcctcgtggcgacggcatggcccgtcgtcgggtcgagggtgatgaggccatccccgaccagtggcgtgaggcacgcgtcgtcgatgatgcgcagcgttccctgcgccgcatcttgcgcacggttcaccgcttcgatatgccgattgacgcggtcgatgtcgagtccttcccggatgcgaaggccaagcatgatgagctcttcaaggttctccgcgggcgatatggtctcatcgcccgaccacggcacgcgcccgtcgttgatggccatcccccacatacgcggatgcgcgatgtcccagccgcgcagcgatgtggaggttacggaagccgaaacgtctccagcggcgtcgctgttcgcggcgtcaccgtctgtggagctgcccataaccgtgttgtaatggctgtgcgctccagggcccaggccggcccagtcggcgttgcgccaatacccgagattgtgccggctctcatagcccgggcgcgaccagttcgagatctcgtaccattctaggcccgccgcggcgaacaggtcatcggcgatctcgtatttcgctgcctcgtcgtcatcgtcgggcttgggcaatgtgcccgccgcgatctgtcgacccatcttcgtggtcggttccacggtaagtgcataggcggagacatggttcacgccaagatcgactgcagtgcgcaccgagtctcgccaatcgtcaaggctctcccccggcgccccgtagatcagatccacgctggagcgcaggccggccctgtcggccgccctgacaccggcctccacattggcgggcgtatgcgtgcggtcgagggttttcaacacatgcggcacggctgactgcatgccgaatgacacgcgggtgaaccctccttccgcaagcgcgccgatatagcgctcgtcgaccgtgtcgggattcgcctcggtggtgatctccgcctccggttcgatgccccacaggccgcggaccgcgtccagcatcatgaccagatcgcgcgccggcagaatagtgggcgtgccgccgccgaagaacaccgtggagacgggcggctcctcgatgccgtgcacgagctgccaatcgcgcacgagacgcatctcacgcaccaccatgttcgcgtaattgccgcgggacgcgcccgcgcccatgtccgtggccgtgtatgtgttgaaatcgcagtagccgcaacgccgcatgcagaacggcacatggatgtagatttcgtagcctgccgcatcgcccgcgttggcgggggttgtcggcgtagccggctgaaggcggtcattcgctggaccacccccagccagccttcggctgtcagcccccgccagcgggggcatatcaaagacctccatcagccttccgtcttctgcgcggcgcggatcttatccttggtgtcgcggtcgttgccggcctcgccggtggacagggccgcgatgaacgcctcctgcggcacctcgacgtggccgagcatcttcatgcgcttcttgccggccttctgcttttcgagcagcttgcgcttacgggtgatgtcgccgccgtagcatttggcgagcacgtccttgcgcagtgcacggatgttctcgcgtgcgatgatgcgcgatccgatcgccgcctgaatcgggatctcgaactgctggcggggaatcagctcgcgcagcttcttggtcatcatcacgccgtagctgtatgccttgtcgcgatgcacgatggcgctgaacgcgtcgaccttctcgccctggatgaggatgtcgaccttgacgaggtccgcggcctgctcgccgtcctcatggtagtcgagtgacgcgtagcccttggtgcgggacttgagctggtcgaagaagtcgaacacaatctcggcgagcgggatgcggtagtgcatctccacgcggtcggtggagatgtattccatcgtgcccatgatgccgcggtggtcctgacacaggtccatcaccgaaccaatgaaatccttcggcgtgatgatgtcggcagcgaccatcggctcgacgatcttcttgatcttgccgtccgggaattcactcgggttggtcacccggtgcacggtgttgtcctcggcggtcacctcatacggaacgttcggcgcggtggagatcaggtcgagaccgaactcgcgttccagacgctccgagacgatctccatgtgcagcaagccgaggaacccgcatcggaagccgaagcccagcgccaccgacgtctcgggctcgtagatgagcgcggcgtcgttgagcttgagcttgtcgagcgcgtcgcgcagttcggggaactgggcgttgtcgatcgggaagagacccgcgtacaccatgggctgggggtcgcgatagccgggcagcgcctcggctgcagggcggacggcggaggtcacggtgtcgccgaccttggactggctgacgtccttcgcgccggtgatgatgtagccgacctcgccggcgccgagcgccttggtgggggtcatgtcggggctgatgacgccaatctcgatgggctcgtgcgtcatgccgatgcccatcatgtgcaccttctcacgcgacttgagctcaccgtcctccatacggatataggtgacgatgccgcggtacgagtcgtacaccgagtcgaagatcagcgcacgcgccggcgccttcgggtcgccgtgcggagcgggaacctccatgacgatatggtcgagcagatcggcgacgccttcgccggtcttgcccgacacgcgcagcacgtcactcggcttgcatccgatcagtcccgcgatctcctccgcgtgcttgtccggctcggcactgggcaggtcgatcttgttgagcacggggatgatggccagatcatggtcgatggccatgtacaggttggacagcgtctgcgcctcgatgccctgcgtcgcgtcgacgagcagcaccgcgccctcgcatgcggccagcgcgcgcgacacctcatacgtgaaatccacgtggccgggggtgtcgatcatgccgagcgtgtactcggtgccctcgaaggtccacggcacgcgcacggcctgcgatttgatggtgatgccgcgctcctgctcgatgtccatgcggtcgaggaagcggtcacgcatctcgcgctcaggaacgatgccgctcagttgcaggatgcggtcggccaccgtggacttgccgtggtcgatgtgtgcgatgatgcagaaattccggattagcgactgatcggtaaaccctggcttgttcttcggctcaatcaccctgatccggttcctttcgtccgtggtgctcgttcgtcgcgggcctttggcatcgtaaatgtgacgccatgtgccgcaagtcaccaagtttaccggtcaccgtcggcaatttcccgacgacacacggaacacggggtcggttttatccgaacatcgtggtagcatgactccctgtatgtccttatagcaaacgtcgtttggagaaaacgtggcaaacattaagtcgcagaagaagcgcgtgctcaccaatgagaaggcgcacaagcgtaacgtggccgtcaagtccagcctgaagaccgccatccgcgcaacccgtgaggccatcgccgccggcgataaggccgctgccgaagccgcctacaaggtcgcttcccagaagctcgacaaggccgctggcgctggcgtgattcacaagaaccaggccgccaaccgcaagtcgggcatggcagtcgccatcaacaacatgtgagcatgaccgtctgacggtcgtcacagcataagacccccgcggaaccgcaaggttcccgggggttctttcgtgttagccggccacccccacccgccagcgggggctcccgcgaagcgggtgggggtggtccgaaagcgtcaagcccgagactggtctttgtcgtcatcgccgccatcgtgggcatcaggatggatgaccgggcgtttcagataccgcgactcgctgggaagatacgtgttgtgccgcttgaccgcaccgggaagcatgatgctgaacttgaccgacagcagacgcatgaccacgaccagcacgacgatcgcgcagtcgagcaccacctcggccgtgaaatccagcatcttccattgcactcccctgcacacgaacacggtgagcacgcatccgaccgcggaaggaaccgcgtacaggtgcttgtcacggatgatcatcggcacgtcgttcaggagcatgtcccggaccagaccgccgcccagcgcggtgaacatgcccatgaataccgccgtcatgccggaggttcccaaatcgagcgccttcgaggtgccgttcaccgcgaacaagccgaccgccaaggcgtcgatggtcagcatcgaccatctgagcttgtccacttcaggatggatcacggcgatagccaggcccgacaccagtgcggtcagcacgaacccgcggtcggagatgcccaccggcggcagggagccgagcatcacgtcacggatgatgccgccgcccaacgcggtcagccacgcggtgatcagcatggcgaacaggtcatagttcttgcgaaccgcgcatagaccgcccatcagcccgctgcagaacaccgcaagatattcgatgcccatgaaaaaggcattgctttccagtgccagtccctccacgcgccactcctcgccaacatcacaaccatccggccgtacatgagcctaccgcaagccggctacccgaaactagaatcggctccgatccgggtcaggatctcgccgaccttgatccgatgtcgcgttccttgaacgtctgtcgctcataggtcaggtcgatgccgttctccttgcgctcctcgcgcacggggaacgatcccggggatgtgtcgccgtgcgcgaccaccgtgtcatacttcagagcccgcgggcgttgatcgtgcgcgtgttccaacgtccttcgaggaacgcctctcgagtgaaattgcaggcgaatacgtcgctctcgccgcgcaccggagtgacccggacgtaggggtcggcgatcatgcgtttaagcaggttgccgttcgggtcttcgggattgagcgggcggaacatcacgtggtggaaccgcttccacgacgagcggatgtactcctccggcacatggtcggcgcgcggccgggcctcgttgcggcgcagcagctcgtccaggggcacgtcgaaatcctccgtcagccagattgccccgtgccgtgtggcgagccgcgccagctcattcgcatactccgggttcgcatgctgcgcgtcggagaccacatcccagccggcgtcgagcgattccggccgtgcacccgcgggagacagctgatgcgtgtgaccgtacagcagcttgcgtccgtcgaacggcagcgcctgatcgtggaatcggaccgcgtcatcgggccatccgtacgcgaggtcttcgcgatatgggaagtgcgacaggttgaccgttccaagtccttccagttcaacggtgccgttcggttcgatgctctcgaacaggttcagcgccggcttgttgtccatccaccagtcatcatggttgccgatggccgcgtgcagatgacggcaacgcagctgccgcaggcaatccttatgggcatataaacaccaccctcagtctcgctacgctcgacagctcccgccagcgggagcgggttctatacgaaaagccccgccgggctcgatcgagccgatgggcggggcttcacgtagaactggactgcgctcagcagaccttccacatccagttgtgcgggtcttcgacctcgccgagctggatgccgagcagctggtcgcgcaggtcgaccgtgagcttgccggattcgccgttggccacggtcacgtcgaactccttggacttgaagcggccgatcggggtgatgatggcggcggtaccgcaggcgaacacctcggtgacctcgccggacttgatgtcgtcgagcaggtcggtgagcttgatcatcgtctcgaccacgtcgatgccgcgatcctgcatgagctggatcagggaacggcgggtcacgcccggcaggatgttgccggtcagggacggggtctccacgtggccgtccttgtgcacgaccatcatgttcatgccgccgagctcctcaaggtaggtcttggtggcggcgtccacgaagcacacctgctcgcagccgttgtcgatgccggtgtattcgccgagcagcgaggcggcgtagttgccgccgcacttggcgaagccggtgccgccggggccggtgcggaaccacttgtcttccacccagatgctcaccggcttgacgccgcccgggaagtacgggccggacggggaggcgatcacgcagtagtcgacctcgtgcggggcacgcacgccgaggaacggctcggaggcgaacatgaacggacgcatgtacagcgtgtactcgcggcgggtgggcacccagttgacgtcgcgcttgacgagggccgccacggagccgaggaagtcgtccacggacagctcgggcaggtacaggcgcttggcggagttctggaaacgctcggcgttcgcgtccgggcggaacagccaggtggagccgtcggcgtggcggtatgccttcagaccttcgaagacctcctgggcgtagtgcagcacggatgcgcccggatccagcttcagcggcgcgtacggctcgatgcgacggtcgccccagccctcgcccttggtccagctcatgtgggccatgttgtcggagaagacctggccgaatgccggcttgtcgatgagctcctggcgcttcgcgtcggatgcgggattgtcgttcggcagcacggtgaacggctcggtgagcttgtccagcgcggcggaatcgtgatgattgttttctgtcataaccacttctttgataacgtcgccgtttgcgtcacggcggccagatggggcagtcggcgcttctggcaccggctctgagggatactttctcacaccgatgacgcattcggcgtgagctcgttcacattatgaaaaaagcccacgcttgtggtgggcttttctcaagcgtcactcccgtgtgtcacgcgggaatccgatgtgctatgcgagacggatcacttggcgtccgcatcggcggccggagcggcagcagcggcgtcggcgtcagcggccggagcggcagcagcggactcggtggtgtcctcaggcacctcgacgctgacgacggaggtctccggatcgtccatgtcgagctcggcgccttccggcagcacgacgtccttgagcagcaccttggtgccgtcggtcaggccgtcaacgttgaccacgatgcgctcgggcaggttggtgacatcggcgcgaaccttgagctcctgcaggtcgacgaacgcgacggcggcacccttcggcgtgccttcgacgaacaccggcacctcgacgtcgatcttctcgccggccttgacctcgtagaagtcgatgtgttcaacgatgcgcttgacggggttgcgctgcacatccttgacgacggccagcttggtctggccgccgaaggagatcgagaacagcgcgttcgtgtggcgcagggccagcgtggtctccttcatcgggagcttcacgaacgtcggctggtcgccgcccgcgtacaaggtggcggggatgagcttggccacgcgcatgcggcgcgcagcgcccttgccgaattcgtcacggatgtcaccggcgatcttgatggtgtttgccataatggttctccttgagtgttacttgtcgttctgtctatttgacgccacgacgcgccgcagaactccccaaggaggggtggtattcaacgccgagtcgattacggcagacccgttctcgcgaatcggaatgccctcgccaaagcaacgagaaacaattatacggccgcgcgggacattcgatggaacgtctatcccggcaaacgaatcgaacgcccgatccgcccggctgtttcgtcgtcatgccgtcatcaaccccggcgaggccctacaatggacgcaatgggacatgcaccgaatcagctgggaggtttgcaatggcgcgtaacacatcacggatagtagttggaggcggaatcgcagcctccgtggtagccggcgccacttacgggctggcgaatctcatgttctcgtatgcgctggatgcacaggcgaagcactcgatgctcagatccggcggggatgacggcaaagtcgcggacaagggaccccgcctcgacgcggccgaagaggtcgaggcggcggattggttcgaccagtccaagcagccggtggtcatctcggcggaggacggcatccagcttcatggctggctgttcgatcccgattgcgccggtgcgaagccccacctgtatgcgatatgctgccacgggtattcggggcaaccgcaggatatggcgaagtacgcgcatcgtttcgcccgtctcgggttcaccgtgctggttccggcgctgcgcggccacgggctcagcgaaggccgctatgcgggcatgggatggctggaccgccgtgacctgatgcggtggatatcgctgatcatcggcagcgacgcggacgcccgcatcctgctgcagggcaagtccatgggcgcggccgcggtcatgatgaccgtcggcgagccggacctgcccagaaacgtcgtggcggcggtcgaggattgcggctatgcgtcggtcggccagcagttcatcgactgcgcgcggtcgatgtttcacctgccgaagttcctcgccaagccgatcgtgacgacgatgggggcgatcgcgcggcggcgtgccgggtacggtttccaggaagcctcgtgcgtggaacagctgaagcatgccacgattccgatgctgttcatccacggcggcgcggacgatttcgtgccgtccagggctttggacgagaacttcgacgcctgtgcgagcatcgaccggcagaaactgctgattccctcggcaggtcattccatgagcgccagcacggcaccggtggtgtactggaagacggtgacgaatttcgtcacccgcgtgttcggactctgatggcagcttcccggccgaagccgccatgcactccgccgagctgaatatgaattgggagtggcccgctggaaatccatccagcgggccactcccgtatcgtttcgctccgttcggcccggcgggccgagtgcggtgacggttacgagatgagctccttcacggcggcgatgacggactgcagaccggccttggcgtcgccgaacagcatctgcgtgttgggctcgaagtacagctcgttctcgatgccggcatagcccttgccgcgaccgcgcttcatgacgaccacgttctgcgccttgtcgacgtcgagaatcggcatgccggagaccggggtgccggggcgacgcgcggccgggttggtcacgtcgttggcgccgacgaccagggccacgttggcggacgggaactgcgggttgatatcgtcgaggtcgatcagctcctcgtacggcacgttggcctcggcgagcagcacgttcatgtgaccgggcatacgtcccgcgaccgggtggatcgcgtacgacacctcgacgccatgacccttgagcaggtcgcccagatcggccagctcgcgctgcgcctgggcctgcgccagaccgaagcccggcacgaagatgaccttgtcggcgtacaccagctgcacggcgacgtcatcggcgctggtctccttcatcgtgccctcggggccgtcggcgtcgccgccggccgaggtgccaccgccgaagccgccggcgagcacgctcatcagcggacggttcatggccttggacatcgccagggagagcgtgactccggccgcgccgacgagtgcgccggcgacgatcagcgcgatgttgttgatcgccagaccgctcatggcgacggcggtgccagtgcaggcgttaagcaccgagatgacgacgggcatgtcagcgccgccgatcgggatgacgaacaccagaccgtagcacagcgcgaacaccgtggtcagcacacaccacagcagacgctgctcgggctgcacgcacagcatgacgaacgagacgacggtgagcacaatgaagccgatgttccacacgcccttcgcggggagggtgagcttgcgcaggaacttgacgccctgcagcttgccggcggcgatcagcgagccggtgaacgtgacggaaccgatcatgatgccaagtccggcggtgatcagcacgaccagcgtcggcagctcctcggaggtgaggatgtcgttgagcgcgacgagggccgccgcgccgccgccgaccgtgttgaacacggagacgagctgcggcatgtcggtcatcttgaccttcttcgcgctccacacgccgacgatcgtgccgatgaggatgccgacgatcagcagcacgacggcgacgagatgctcgaagccgttgccgatctcggtgacgaacagcacgatgaacgccataaccaccgccatgaccatgccggccgcggagatcaggttgcccttgcgcgcggtcttcggcgagttcatcatgtgcaggccgacgacgaacaacacggcggccagcagatacacgaaccattcaacgacgccaagcgggttgctcagcacttcagcaagggtacccattacttggcctcctcattcttgtcggcggacttcttcgatttgtcagacttgaacatctccagcatgcggtcggtgaccacgtaaccgccgacgacgttcatcgtgccgagcacggcggcgaggaagatgaacacccaggccaggagcgaggtggcgtgcgcggcgacgatgacgacaccgacgatgacgatgccgtggatggagttggcgcccgacatcagcggcgtatgcagggtggcgggcaccttgccgatgacctcgacgccgatgagcagcgcgagtatgaacagtgtgatggcaacgatgatgtccatggattattccttgctttctgcggcgggacgtccggctacgatgagggcgtcgtcaagttcctcgttcaggtcgatgctcagacgaccgtcatgcacgaagtgggcgagcacgtcgcccacgttgcgggcgagcaggttcgaggcggtgttggaaacctcgctggcgagatacggggcaccgatgatggtcactcccccatcggtcacctgcgtgccgacgcgggatccctcgacattgccgcccaggtcgctggccgcacagtcgacgatgacggcaccgcgcttgaggccgtccacgccggccttggtcagcagcatcggaggcttacgaccgggaaccttggccgtggtgatgatgatgtcgaacccggctgccttctggtcgacggccgtctgctgggcggcctgctcctcggcgctgagctggcgggcgtatccgccctcgccctgccccttggagaagtcgagaccgagatcgaggaacttcgcgcccagcgactccacttcgccgcgcgaagcgggacgcacgtcgtacgcggtaaccacggcgcccagacgacgggcggtgccgatggcctgcaggccggcgatgcccgcgcccaggatcagcaccttggccgggcggatcgtgccggcggcggtcgtcatcatcgggaagaacgagccataggcgttcgccgccaccagcgcggccttgtaccccatgaccgaattctgggacgtcatctcgtccatggactgcgcggagctgagctggcgaggcagcttctccatcgcgacaccgacaagaccggccgcctggagggcgtccacatacgcggcatcggtgaacgagccgagcatgccgatcacccacgtgccggccttgagccgcgcgaccgtctcggcagacggacggtccacgaatccgagcacgtcggcgcgcgcgatcacatcgtccgcggcgacgacctcggcccccgccttggcgtaatcattgtcggtatattgtgcggcgattccggcgccgctctgcaccaggcaggacacacctgctttcttcaaccgtgtgacgatatccggcgtcaatgcgacgcgggtttcgtcctgcgatgtctcgttgaggacaccgaacaccacggtggctttctgggtttcagccatgagagccctttcttcgtcgaactcaagcgttctttgcttaccgttgcaagtgtaccgaaggaatcgacttttggcgcgttccgtttcacctgacgaatggccgcgggcgagcgggcgacccgcacgacgctgtttcctacgctaccgtaaggtgaaaagaggcgtttttacgggtaatatttatgtgttaagcattatcaggcctccaaggagcgtcacgtgtcattgttcacctcagtaagacagcaagctgcgaatatcacgcagaaggcacttcgtttgggaggtgacttcgcgcacccgatcggcgacgattcctccaacggcccggattacgcggagaacgacgctcttgccgcgaacggcgaggtcagcctcccgaacaccgccgaatgggggccaggatacccgaccacgacgctgatcgacagcacgacgggcctgctcaccacgaagaccgagggcaacccgccacttgacgagggcatgtccatctacgacatctatgcggaccgcgccgaacgcatgggcgacgagccgctgtacacctacaaggacgactccggcaagtgggtcaccagcacagcgaacgagacgctcgccgacatccgcagcgtcgccaagggcctgctgcactacgggctgaagaagggcgacggcgtggcgttcatgtgccgcacctcctacgcgtgggatgtcacggacgctgcggtcatggcctgcggcggcgtgctcgccaccatctacgacaccgactccgccgagcagatccgcaacatcgtcaacaattcggacgcgcggctgctgatcgtcgggaccgccgacatgcgcgacaaggcagagggcgcgatcgaggaatgcccgtcgctggagaccatcctgtgcatcgagaccggcggcctagaggagatcaaggcgtacgggaccgcggtgagcgacgaggagctcgacgagcgcatcgactcgatcaagaagaccgacctgtgctccatcgtgtacacgtcgggttccacggcggcacccaagggcgtggagatgacgcacgagcactactgcacgaccgcgctgaacctgcccgtctacatgccggacctgctgcacaacaagaagaactccgtgctgctgttcctgccgcaggcgcactcgttcgcccgcgcgatcaactacatctgcgtggcgagcaacatcaggatctacatcgcccagggtatcaagacgctgatcgccgaccttcaggtcgcccggccgtccgtgatgatcgtcgtgccgcgcgtgctggagaaggtgtacaacgcggcgtcccagaaagccggccacgggccgaagggcgtggcgttcgccgccgcggtggtcgccgcgcagaactacatgaaggagctgggtgccaagggcaaggtcggtgtgctggccaagacccgccgcgccgccttcaacccgatcgtctacaagacgctgcgcgacgtgctcggcggccgcgcccagtggatcgtcgccggcggcgccccgctggaccccgaactgctcgcgttcttccgcggcgcgaacgtgcccgtgtacgagggctacggactgacggagacgaccgcgccgtgcgcgttcaacccactcggcgtgccgtaccatcagggttccgtcggcatcgccttccccgggttcgagctgcgtgtcgccgaggacgaggagattcaggtcaagggcaccgcggtgttcccgaagtaccacaagaacgaggaggcgaccgaaggctcgttcaccgatgacggatggtaccgcaccggcgacctgggcaggctcgacaacgacggcttcctgtacatcaccggccgcaagaaggatctgatcatcaccgccggcggcaagaacgtcgctcccggcccgatcgaagaggtcatccagcgctgcgagttcgtctcgcaggtgctggtgctcggcgacaagcgcccgttcatctccgcgctggtgacgcttgacgaggagtcgctgcgcccctggctggaatccaagggcctcaaccgcgatatgacgatggaggaggccgcctccaacgccgcggtgcgcgccgaagtgcagaagtgggtggatcaggcgaacgagggtgtgtcccgcgccgaatcggtgcgtaagttcatcatcctgcccgaggagttcagccaggcgaacggcctgctgaccgcatcgatgaaggtgatccgacccaaggtcatccggcgttacgccacactgctgaacacgcagatgtacaccaagaagaagtgacgctcgacatccttcacgcgtgaggcgggtggttcaacacgattgttgaaccacccgcctcacgccgttttatcggtgccaacgcccgcgcggcgcgcaatcagaagccgagcctctccagctgcttggggtcggactgccagcccttggcgaccttgacatgcagatcgagcttggccttgcctccgacgatgcggttgaccggggtgcgcagcttcttcttgacgcgcaccagatgctcggcgccgcgtccgatgatgatcggcttctgcgagtcgcgctccacgtacacggagaccatgacctggatcttgccttcgtatgactgcccgctctcgttgtcttcgggccgttcgatggagtccacgacgacggccagcgaatggggcagctcgtcatcaagctcttcgaggaacgcgccgcggatcagctcggcgatggtgtcttccggacgctcctcactgacctggtcgtccgggtacatctgcggcccctcaggggtgttgtcgatcagcacctggcggacctcgtcgagattgtcgtgtcccagggcgctgacgggcacgatgtcggagaagtcagcgaactcattgatctcgatcagcttgtcgatgagctgctggcggcccagctggtcgatcttggtgacgatggcgatcagcggaaccttccacgcgaacgtcccgtcctcgcccttggtggcgaaatcggtgcgcagacggcttaggatgcgcttgtcgccggggccgatctcctggtcggcgggcagcaggaacgcgatggcgtcgatatccgacagcgattcctcgacgatgtcgttgagacgctggccgagcagcgtgcgagggcggtggatgccgggcgtatcaaccagcacgagctgcgcatggtcggtggtgaggatgccgcgaatcgcctttcgcgtggtctccgggcgcgatgaggcgatggccacctgcttgccgatcagcgcgttgatcagcgtcgacttgccgacgttcggtctgccgacaaccgctatgaatccggaacggtacgccggctgggattcctgctcgtcagtattggtcatattcgtgtcatgccttttcttcgcgttcggtttggtcattgtttctctacggtagcggttcaccttgtcattgggcggacggctccgtcatttgccttgcggggaggcggactcgccgtcctgttcgtcgctgcggggctcatcgtcgtcggctgcgggaccctgcgacccggccgccggctccacgacgatcatcgacaccctcttgcgtcggcctgccgtgtcgacggcggtgaggcgcaggccgcgcgtcaccgcgctggagccgacgatcgggacgcggcccagcagcttggtgagcaggccatatacggtgtcgacgtcgtcctcgtcgatgtcgatctcgaacatctcctcaagggtggcgatgggagtcctcgccggcatcttccacttgcgttcgccgatcttctcgggctcggaatgctgcgtgcggtcgtgctcgtcctcaagttcgccgacgatctgctcgatggtgtcctcgatggtgaccagtccggcgatgccgccgtattcgtcgacgacgatcgccacatgctgccgggtctgctgcatggcgtggaacaggtcatccaccggcttcgactcgggaaccagcatcggctgcctgacaatggaggcgacatcgcgctgcgaggcggcgggattgaacgccgtggcgcgcacggcgtccttgagatacgccacgccgatcagatcgtcgacgtcgtcgccgatcaccggcacgcgggagaaaccggaccgggagcacagacgcagcatgtcggcaagtgtggccgtgcggtccatgcagatcatgtcggtgcgaggcaccatgatctcgcgggtcagcgtctccgacaacgtcagcacgttgcgcagcatctcggagacttccggatcgaaatcattggcctccaccaagcggtcgatggtggcacgcccctgttcgagctgaatcttctccagctcctcgtcgtcggacaggtccgattccttggagcgacgcttctgacccttctgctcgcccgccttcgcaaacggcgtgatcgcggtggcgaacctgaccagtcccgccaaattgagcatgatgtcgatcggcttgctggctcccgcggaccgcgggcggaccagcaccgagacgatgccgacgatcagcgcgaacaggaagccgcacagcagctgcagccagatcggcgcatcaagcagcgacgccacgcacgccaccagcacgccgtcgaacacgttgcatgtgatgcggaagaacgcgcagctgcccgaggtggcataccggttggcgatgagccgctgcacggtatggattttgccgatcttcttcatccggatgaactggctcgtctcggtgtcggtctgcacttcgaggatcttgttgttcagtcctgcccgtgtgacgcgcccgaccgcactttccgcggcggccatgctcaacgacagccagaccagcagtgcggcgacgacgaccaacgcgacaaccaggataatcgtggacgtatcggtcaacggcataggaatccttcgtttgagttcatgtgttcagcgccggtgacggcattgccgccgaacggcgacggggaaaagacgcgtcattccgttatctgccgtccgccgccgtgcgacgcgtcgtattcggcaagcgcgtcggccgcgcccttcggcaatgtggccggttcgatggtgatgcggcgcacggccaggaacgtgagcagcagctgccgctgcagaccgaacatctgcctttcctgctccggcgtgacatggtcgtagccgagcaggtggaggatgccgtgaatggtgagcagcatcatctcctgcatggtgctgtgacctgccgcggccgcctgctgggccgcgacccaggggcatatgacgaggtcgccgagcacgccctccatcgtggtcttgccgtcgccgggcctcagctcgtccatcgggaagctcatcacgtcggtcgggccttccagcgacatccaccgctcatgcagctcggctatgggatcgggatccacgaacaggatggtcagatcggactgggtactcacgcgcatctggtccatcacccacaggcccaggtcggagaacgcctttgcgtcgatgtcccagatggtctcgttggtcacttccacgctcatcgtgcgtcctcccgcgattccttgcctcggttgcgcctgacacgggtggcgtcatgacggtcgtatgcctcgacgatgcgcccgaccagctcatggcggaccacgtccccggcgtcgagatgggcgaatgctatgtcgtcgatgccgcccagaatgccctcgatggtggccagaccggatcgtggcacggcgaggtcgacctgcgtgacgtctccggtgatgatcatcgtcgtgttgaatccgagacgggtgaggaacatcttcatctgctgttccgtcgtgttctgcgcctcgtcgagaatcacgtaggcgtcgttgagcgtgcgtccgcgcatgtacgcgagcggcgcgacctcgatggtgccgtcgtcgagatagcggtgcagctggtcggggccgagcatgtcggacagcgcgtcatacagcgggcgcagataagggtcgactttgtcgttgagcgtgccggggaggaaaccgaggctctcccccgcctcgaccgccgggcgcgtcaggatgatgcggcgaatacgcctgtcctggaacgcgcgcaccgccttggccacggcgaggtaggtcttgcccgtgccggccgggccgatcgcgaaggtgatggtgtgggcgtccacggcgttgacgtaggcgatctgccccgccgtcttggcacgcacgggctgcccggccgcgaaagtgatgacgccgggtatgcgaggcttgcgcgcatcccctgaacgcgctgcaccgagcgacgcacggccccgctcggcggacctgccgtatccggggtgttcggcgcggaccttgttgggcagcacgtcctggtcgagcagcctgcgcacggtgtcggcgtccatcggggcgctgtacgcggcctggataatcgtatggatgacgtcttcggcgcgagaggcctgcgattcggtggacttcgaatgggagacgatggccaccctgtcgccgcgtacgatgatggtcaggtcagggaacgcgtgctcgacctgccggatgacctcgtcgaccgggccgaagacggccaccgggtcaagctgcgacgggatggtgatggtacgggtcgtcgttgtcacgaatcgccctactcgtcgagcttctcgccggtgagcacatgcgcgtgcacgtggaacacggtctgcccggcgtcgaggccagtgttgaacaccagacggtacgcgcccgagaactccttgtcggcgatgccctgagcgagcccgacgatatgggccagttccgcgggatcggcggcggccagctcggcgacgttcgcgtagtggtccttgggcacgatcagcacatgcaccttcgccttgggattgatgtccttgaacgcgtatgtggtgtcgtcctcatataccttctcgctgggaatacgcccgtcgatgatcttgcagaacaggcagtcctcggacttgctcatatgctcgccgctccttgctggccgtgatggaaatctgcttccatgctattgcgtattgaggatattctcggcttcacgcgaaacgccccaacgccctcgacagcagcgacagcgccaccgggcccgccgtcgatgcgcgcaggatgttcgagccgagcaccacgctctgggcgccggccccgacgaaatcggacacctcctgctcgctgatgccgccctcaggccccacgacgacattgatgctgcgcggccgcccgtcggcgagacaacggtcggcgagccgcgagacctcgtcctccacggacgaccatgacatggtggcgtcctggtgcagcacgatcaccagatcgccatgcacgcacgcacgcctgcagatagcaactacctgcttgcttgagacgcactgcgccagttccggcgaccacacgcggcgcgactgctcggtcgccgcgtcgaggacctgccgccatttgcgatcagtacggcccgccttccacttggcgatggaacgattggcctgccaggggattacctcgtcgacgccgatctgggtcgccatgtcgatggccgcctcgtcgtgaccggtcttcgccagcgcctggatgagcacgagccgcgtgaccggctgcggctgccgcccgacgcgctcgacgctgacgagaccggcctgcgcgtcgacgagcgtggtcttgacgcacagcccccgaccgtcggtcagcgacagcccgtcgccctcggcgaggcgcatggcccccaaggcatggcgcttcaccgaggccggcagcgtgatcgtccaccccgcgttgagaccatcgccgttcaccggcacatcatcggtgtcagggtcgaaaaggaatacaggatcagtcatggatacaaggctacaacatccccgcaaacacaggcgacacgccatgatttggcatcatccgaaaataccgatatagtatctattcgttgtctgaaaacgacacctgtccgggtggcggaatggtagacgcgcaagcttgaggtgcttgtgcctattttatacaggcgtgtgggttcaagtcccatcccggacaccagcgaagaccccttggaaacaaggggtctttccatatatacataccgtatgcgcagacggccgcgcgcaatcgggccgacgacggtacgacgacatgagaacccgaggcacgcccatgcaattcatcaccatcgactccatcgacgacgagcgggttgccgcatacacgaacctcaccgaaatccagctgcgcaaccggctcgaacccgagcgtggcctgttcatcgccgaatcgcccaaggtcatcgaccgcgcgctcgccgcgggccgcgaaccgatctcgctgctggtcgaagagccgtggatcgagggcatgtcacagaccttcgacgtcgtcgacaaacggtggggaacggacatccccgtatacgtggcctcccccgaacaactgcgccagctcaccggataccgcctccaccgaggggcgctttcggcgatgcggcgctggccgctgccgagcgtcgaggagacatgccgcgacgctcgccgcgtggcggtcatggagaacatcgtcgaccacaccaacgtgggcgcactgatgcgctcggcggccgcgttggatgtcgacgcggtgctggtcaccccgtcgtgcggcgacccgctgtaccggcgcgccgcgcgcgtgtccatgggcaccgtcttccagataccgtggacgcgcatcggaggcgacgacaagcatttctggccgcgccgaggactggaggaactgcgctcgctgggattcaccacggtggcgatggcgctgagcgacgactcgatatcgctggacgagctgacacgccggctgaacaacagtcccgaatccgcggaccacatcgacaaactggcgctgatcttcggcacggaaggcgacggcctgtcacgtcacaccatcgcgggcgcagacctgaccgtgaaaatcccgatgtcccacggcgtcgacagcctcaacgtcgccgcgtccagcgccgtcgccttctacgcgacatccccgaagcgcgcggaacaataagaacagatcggatatttttcatgactttttcatgacgcgcaacgccatttccttgcgctcacggggaaatgtgcaattattgtttctgtaggctccggcaacgaagcaggggcggacaggcagacggtgtcatcagacgctgtgaacaacgagaggagcactcagatggcgaagaacaagcagaagattctctccatcgtcctggcaggtggcgaaggaacgcgcctcatgccgctgacacgtgaccgtgcgaagccggccgtaccgttcggcggcgtattcagactgatcgacttccccttgagcaacctggtgaattcggattaccgccatatcattgtgctgacccagtacaagtcgcattcccttgaccgtcacatctcgcagatgtggcgtttctcgtcgttgctcggcaactatgtctcccctgtgcccgcacagcagcgtctgggcaagcactggtatctcgggtcggccgacgcgatctatcagaccatcaacatcatcgaggacgtccagcccgacatcgtggtcatcgtcggcgccgaccacgtctaccgcatggacttcggccagatggtcgagcagcacatcgaatcgggtgcggagttcaccgtggcaggcatccgccagccgcttgaggagtccaaccagttcggcgtgatcaacgttgacccgaaccaccccaacatgatccgcgaattccaggagaagccggcgacgaccgaaggcctgcccgacgacccgaattcgttcctcgcttcgatgggcaactacgtcgccaacacggacgcgctgttcgatgcgctcgccaaagacgagaaggccgcggacaccaagcacgacatgggcggcgacatcgcgccgtacttcgcctcgcgcggcgaggccggcgtgtacgacttcaactccaacgtcattcccggctccacgccgaccgaccacgcctactggcgcgacgtgggtacgatcaagcagttctatgacgctcacatggacctgatcgcctacgtgccggagttcaacctctacaaccaggcatggcccatctacacgaactcgggcacgctgccccccgcgaagttcgtgcatgccggccgcgatcgtctcggccacgcgaccgactccatcgtctcccccggcgtcatcgtctcgggcggtgaggtgcatcattccgtgctgtcgccgaacgtgcgcatccattcgtgggcccaggtggtcgactccgtgctgttcgacggcgtcatcgtcaaccgtcgcgcccgcgtgtacaaggcgattctcgacaagaacgttgtgctgaccgagaactccacggtcggcatcgacaccgagaaggacctcgcccgcggcttcaccgtgacgccggaaggcatcaccgtcgtgccgaagggcaccatcgtggacgactgatcggctcggatatacgttttgagggggtttgccggattcgcggcaaaccccctcaactatattcacgtgtcttcgttcacgtgtcttcggctgtacagagaagccgcagacacggatgaggtcagtacttcggcatgttgtcgaaattgaaaccgagcgcggccagctgctcgcgcccctcgggcgtgatcttgtccatcgtccagcgaggctgccacgtccagtcgatgcggaactcctccacaagacccgccagcgtgctcgcgcactcgtcctcgatgaggtcggtcagcgggcatgcgggcgtcgtcagcgtcatcgtgatgatcgcgcgtccaagctcatcgatctcgatgccgtagaccagaccgaggtcgatgacgtcgatgcccagctccgggtcgatgacctgatgcagggcctccttcacatcctcggcggtggcacggccgatatcgtcgatggccttgagcggaatgtcatcctcgctgctgtgctcgccatcctcgcactcgctcttcggatggcggccgcacgcgcacatctcgacgccgccatcgcttttgggggcaggatggccgttggggaacccagccgcaagctgcgggttcgccatcacgcggcgcgccgcctcctcgtcgcccagaaccttgctcaccgaatcgaacacggaagcctgcggctcaggaaccagattgtcgctcatatctctccagtcgttaatcgcgaaaccgttaaatcaagagtaccaactcggaccgctctcatggcagtgcggtgaccgtttatttcgccgccagcgccttggcgacggagtcgcgcatgccctcccagccaagcagcgcgcacttgatgcgcatcgggtacttggacacgccctggaacaccacggcgtcctccagcttctcttccttggcctcgtcctgcaatccagcgccgcgcgactccatgagctcatggaagtcgcggaacagctccatcgcctcgtcgacggtcttgccggcgcacaggtcaaccatgacggacaggctcgcctgcgagatcgagcagccgtggccgtcccacaccagacgctcgatggtgtgcggctcgctgtcggagacctcggcgtgaaccgtcgcctcgtcaccgcaagtggggttgaactggtgggattcgcccggcgtgcagtattcgtggctggcgcgcacggtcgtgtcggccggcgcggagccctgttccttggacacgtccgccgcgaaatgctcacgaccatgcgggtcacgcgcggcctcaagaatcacttcctgatacatctgctcaagatcgtcgccgctcatgccgaaatcacccatcggtcaatcccttcccatgcatagcgctcgatagcgctcgatatcattcacgaacacgcgaaacgccgtccgcgtgagattccgtggatattatgccacatgccgtgacagtatcccgtgggagtcatacgcgaacggcgtaaacgcgacacgtatcacagtccgaagaacggacggaccttcgccacggcctcgaccagggcgtgagcgtcgtcgacgctgttgtacacgccggaggatgcgcggtttgacgcatacagaccgaagtggcggtgcaccggctgggcgcagtgatggccgacgcggatggcgatgccttgcgcgtcgatgaactgcccgacgtcatgcgggtgtacgcccgcaacgtcgaacgccaccgtgccgatgcggttcacgttctcgcgcggcccgagaatccgcacgccgtcgatgtcgcccatcttgagcagttcggcggcgatcgtgcgctcatgcgcctcgatgttctcaagccccacgttcatcagccattcggcggccacaccggctgcgaccacctgggcgaccggctgcgtaccggcctcgaaacgggccggaggcaccatgtactgcgcgggctggtccatccacgcaagctcgaccatggaaccaccgaagttcgccggcggcagggcctccaacagctcacggcgcccgtacaggaatcccaccccggtgggaccgtacatcttgtgggcgctccacgcggcgaaatcgacgtcaagcgcgtggaagtcgaccttgaggtgaggcaccgactggcatgcatcaaggatgaagatcgcgccgacctcatgggcacggcggatgatgggcgcgatgtcggtgatggcacccgtggtgttgcccacgtgcgtgatggcgacgaccttggtgtgttccgtgatcacctcatcggcggtatccgagcggatgcggccgtcttcggtcagatcgaaccatttgagcgtggcaccggtgcggtatgccagctcctggaacggcagcagcacggaatggtgctcggccttggatacgacgatctcgtcgccgggcttgagagcgaaccgtttcgccgcctctcccccacggcccagactcgcgttgccgaacgcggtggcaagaagattcagtcccgcggtggccccggcggtgacgacgatctcctcgttgccctcctcggcgttggctccgaccaggcgggcgaccttcgcgcgggcgtcctcgaacgccatggtgctgagggccgccagctcatgcgccccgcggtgcacgccggcgttgatcgtgcggtagaactcgctctccgcatcgatcacgcactgcggcttctgcgaggtggccgcggaatccagatagacgagcggatgcccgtggatctgctgatccagaatcgggaactgcgcccgaatcgccgtaaaatcaaccattgtttcccttagattcaatgtcctgccgatatgtcgtttttcagttatccgcttattcgctcgccgcttccagcggtggatcatgcttccggcggtggccgcggggtgcagggatgtcctgttcccgggatcgcttcaggccgctcgggccaagtttacggtcgggaatagtacacccccaggcaatgcgaccacacctcaaacgcaacgaaacgaagaaatcaggccagagccgattcggagtcggagccttcgggcaggtacttgtcgtagccggtctcttcgagttcgtcggcaagctcgggaccgccggtcttgacgaagtggccgtctgcgaacacatgcacgatgtcgggcttgatgtacttgaggatgcgcgtgtagtgcgtgaccatcaggatgcccagtccggtgctctccttggcgcggttcacgccttcggacacgatgcgcagggcgtccacgtcgaggccggaatcggtctcgtccatgatggcgaacttcggcttgagcagttcgagctggagcacttcggcgcgcttcttctcgccgccggagaaaccttcgttgacggaacgcgacgcgaacttcgggtccatgcgcagcttcttcatcgcggcgccgagctctttggtccaggtgcggatggcgggggccttgccgtcgacctcggtcttggcggtgcgcaggaagttggtcatcgacacgccaggaacctcgaccgggtactgcatggcgaggaagagcccttccttggcgcgcaggtcgggggtctgcttgaggatgtcgacgccgtcgagcagcgcctcgcccgagtcgacctcgtacttggggtggccggccagcgtgtaggcgagcgtggacttgccggagccgttggggcccatgatcgcgtgtgtctcgccggaatgcacggtgaggttcacgcctttgagaatctgcttgcgaccctccttggtctccacggatgcgtagaggtccttgatttcgagagtgtgctgttcggccatcgttacttatcctccaatacggctttcatggcgtcgctttcgccgcgggcgaggcggcggtcgattacgttcatcaggtgttcggcgatgaatggcacgccgatctcttcgacgagttctccgaagaacccgcgtacgacgagcttgcgggcctccgtttcggggatacctcgcgactgcagatagaacagttcctcgtcgtcgaaacggcccacggagctcgcgtgtccggcgccgatgatgttgccgttctcgatttcgaggttcggctccgaatcggcgatcgcgcccggggtgagcacgaggttgcggttgagctcatacgagtcggtgcccggcgcggtcggcgcgatcagcgcattgcccacccaggtggagtgcgcgtccttgccgtcgagcgcgcccttgtagaccacacgggacttgcactcgggatggttgtgcaccaccatcgtgcggtgttcgatgtgctcgccggggtcgacgaagtagatgccgagcatgttgaggtcgccctgctcgccgccgaagtcctgatccatgcggatacggaccacgtcgccgccgagtgtgacgacggagtggcgcagggatgcgccctcgccgacgtggatgcgctggttgccgacgtgcttggagcccttctcccactcctgcacgaaggtggtggagacgtgggagttcttgccggtgacgatttccacgccttcggcgagacgggccagaccgtggtgctcgacgatgacgtcggcgtgggcctcatcggccgtcgagatgaccagatgcagggcatcgaggtcgtcgccgctgccgatcacgttgaccagcaccggctgggcgatctcgcccgacagctcgatcaccgttgcggtacgcccggaattccactcgacggcggccgcccgatcgctgggcttggagaccgtgccggagactccttcgccgagggcgcactggctgacggccacgtgcttttcgtcgaccgcggtgccatcggcgtaactgatcgcgatggtcgtctccccgctcggcttgaacacgtcgaagaactctccgatgcggtcgagcggcgtgtagcgccaatcgtcctgcttgcgctccggcacggcgaaatcgttcacgtcgaacgagcgcggctccctgtcggcgctcgacggcatggccgccggcaccgcgtacgggtcgttcggatccgcgacgggaatggtgatttcagtattgttcgatgccatgggaatcagcccaccgatccttccatctgcagttcgaccaaacggttcagttcgagcgcgtactccatcggcagctcgcggctgatcggctcgacgaagccacgcacgatcatgcccatggcctccttctcctcaaggccgcggctcatcagatagaacagctgatcctcggagaccttggagaccgtggcctcgtgggccatcgtcacgtcgtcctcacgcacgtccacatgcgggtacgtgtcggaacggctgaagtcgtccaccagcagggcgtcgcacacggtggagttcgacgagccttcggctccgtcgacgatcttgaccagtccgcggtacgcggagcggccaccgccgcgcgagatcgacttggcgacgatcgtggagctggtgtgcggagcgagatgaatcatcttcgcgccggtgtcctgatactggcccttgccggcgaagccgagggacatggtctcggccttggcgtacggctcggcgagaatgcacgccgggtacttcatcgtggccttggagccgatgttgccgtcaacccattccatcgtgccgccctcgcgcacgtaggcgcgctgggtgacgaggttgtagacgttgttcgaccagttctgcacggtggtgtagcgcacgcgcgcatgcttctcgacgatgatctcgacgatggcggcgtgcagcgagtcctcggaccagatcggggcggtgcatccctcgacgtagtgcacgtaggagccttcgtcggcgatgatcagcgtacgctcgaactggcccatggccggcgtgttgatgcggaagtaggcctgtagcgggatgtccacgtgcacgcccttcggcacgtacacgaacgagccaccggaccatgcggcagtgttgagggcgccgaacttgttgtcttcggggctcacgacggtgccgaagtacttcttcaccaggtcggggtattcgcgcacggcggtgtcggtgtccacgaagatcacgccctggtcggcgaggtccttctggatggagttgtaaatcacttcggactcgtactgcgcggccacgccggagaccagacggcttttctcggcctcggggatgcccagtcggtcgtaggtggagcggatgtcgtccggcagctcctcccacgtcttggcctgcttgtcgatcggcttgacgtagtacttgaagtcgtcggcgttgaatccgctcaggtccacgccccaatcgggcatcggcttctcaaggaacgccttgaatccgcgcagacgcatgtcgagcatccactgcggctcgcccttgtccgcgctgatgtcacgcacgacctgttcatcgatgccgcgcttcgcggcctcgccggccgcgtcggaatcatgccagccgtaggtgtaatcaccgaattgctggatgatctcgtcatcctttttgagtttctcttcgtccacacgctggcgatcggccacatactggctcatctccacgtcggacgcggcgttgggcgcctgctgggtgtcgctcaccttgacgctgcctcctattcatcacatagttcctacgttaagttagcagaacctcacggcgaactccacagcagacccgcatgttggcttagcgcaaaacgtgagcttgcttatattgcgacttctccgcaatgatcgccggaccggcactaaacaacgatggggatgccctttcgggcatccccatcgtcgcgtatcagtctactcttaaagccacacgctcaggcctgacgggcttcctgatgatccagcgcggccttgacgagccccgcgaacagggggtggggcttggtcgggcgggacttgaactccgggtgagcctgggtgccgacatagaacgggtgcacatcctgcggcagctcgacgaactcggtgagctcgccgtccgggctctgaccggaaatgcgcaggcccccctcgcgcaggagatccttgtaggccacgttcacctcatagcggtggcggtgacgctcggtgacatgcgtggtgccgtacagctgcgcagcgagggagtcctcctccagctcggccgggtagctgcccagacgcatggtgtggcccatgtcgccgtggccggcgacgatgtccttctgctcctccatcgtggcgatgaccgggttggagcagtcgggctcgaactcggaggagttcgcgtcctcgatgcccagcacgtggcgagagtattcgatgaccatggactgcaggccgaggcacaggccgagagcaggcagcttgttttcgcgcgcgtacttgagcgcgccgatcttgccgtcgatgccgcggatgccgaaaccgccggggatgacgatgccgtcgacctggtcaagcgcggcggccgcgccctcctcggtctcgcacttgtcggcggcgacccacttgacgttgaccttggcccagttggcgaagccgccggccttgatggcctcggtgacggacaggtaggcgtccggcaggtcgatgtacttgccgacgatcgccacgttgacctcgtgcttggggtggtgcacgcgctccagcaggtcagcccactcgtcccagtcgacgtcgtggaacggcagccccagctcgcgcaccacgtaggcgtcaaggccctcgtcgaacaggatgcgcggcacgtcgtagatgctcggcgcgtccacgcagttgaccacgccctcctcatccacgtcgcacatcagggagatcttgtccttgatggacttgttgagcgggcggtcggaacgcagcaccagcgcatccggggaaatgccgagctggcgcagcatcatcacggagtgctgggtcggcttggtcttgagctcgtgcgcggcggagatgtagggcaccagggagacgtgcacgaacatgcagttctcggcgccgaggtcgcgacgcacctcacgggccgcctccaggaacggctgggattcgatgtcgccgaccgtgccgccgatttcggtgatgatcacgtcgacatcatcgctcgcctgggcgcgcatgcgggacttgatctcgttggtgatgtgcgggatgacctgcacgcactggccgaggtactcccccgcgcgttccttgcgcagcacctcctgataaatctgcccggtggtgacgttggccttctgggagaggaacacgtcgaggaagcgctcgtagtggccgatgtcgagatcggtctcggcaccgtcttcggtcacatagacctcgccgtgctggaacgggttcatggtgcccgggtcgacgttgatgtacgggtcgagcttctgctgcagcacatggatgccgcggctgcgcagcagacgaccgagtgaggaggcggtcaggccttttccgagggatgagaccacgccaccggtaacgaaaatgtgcttggtgatgtgttcttgagaattgccatgttgtcttctaaccatggaatttcactgtatcatctgcctatgacggattcctgtgcggcatgattgggccgccgcccgcgcaacggctcgccggccgtctcggactgcgggctgcggtggtcgcggtcatggcggcgttggccatgttgccgcaggtcatgtccgtcagcgcgttgcgctcggagcccgcgcatgcagcgacgagcggcatcacgcttcgcgccggggagaatctcacgcttgcgggtcatgcgttcacggtgacgcgcaccggccgatatgacgatgtcaggcatgccggcggtacagtgaccggattcgatgtcgtcggcgacacggcatggagaaccgcgtcctccatgcaatcgtcgcctcgaaacgaaaccggcatgacgaacgaaaccggaatgacggttgacgaagcacaggcatacaaccggaggctcattgattcaggacaatacgatctcgggcaaccggatgccgagcaacagaacggctccggagattcgggcacggtcatcggcaggatactgattccgaccatatcgactgacttgcccatccgccagagctctgacgcagagacgctgcggctcggtgccggcctgctacacgacaccagtctgcccgtcggaggccccggaaccgcaggatgcaccgcaagacgatcgatcccgatatatgggcttcatgccgacgatcccggcaacgacgattcccctcgtgacgttcacacacgcaatcggcacggaacttcaaaggctgttacggaatcgtaccaatagcctcatatcccgccatgccacacgaacaacggcctctgcatcatcccgccaaagccccatcccgacaccatcaaatgggactttggcaggatgaggcttacagcaacaatgcaccctcatatcctggcatcaaacatggggggcacggatgcaacacccgttgattttgacgggggtatataagggggttactatggggaaaaacctgaaagcatatgatgaggtatgtgattgtatggggattttcgatgacctgactgggacaatcggcatggttgatgatgacaggcggtcattggattcgctggagcgtctcgttctcgaaatgacacctggattgcgcatagcctggtcggtcatcgacgggccgcgcgccgtgagcctgacgctggacgcccggacgagaccagatctggtcctggtcgacctgtcgatggaatccatgtcgggcgtcatggtatgccgtcgtatccgccgacgcgacagcatggtgaagcttctgtccatgacctcgttcgccaaggagacgttcggattcgacgtggcgcaggccggcgcccaaggactggtcagcaagaacgacgagcaggaaatactcgaaggcttggcgacggtacttggcggaggcgtttacggtgatttcgggttcgttgacgcccgtgcctcattcgaccagctcgcgcatgagacgccgaaacgggctgacctggtctccaaccgcgaagtgcaggtgctcgatcttatgtcgcgtgggctgaccgacctatcgatagcgaaacgactcggcattaaagcggccaccgtgcgcaagcacgcgcagtcatccatgcagaagctcaacgccgaaaaccgcgtccaggcggtgctcaaatggaccgggcatcataccgaagacggcatgcgccgtcagggatgatgcccgcgtcacacaatctaccggtcgaacgcggtcagccgcgtcgagccggccgacacctcgttcgacgcggatcagtagcccgtcgaatcgtaggaatcaccgtacgaatcataggagtcgccatacgaatcgtacgaattctggttgtcatacgagcttgagccgccgtacttcttcttgtagttgtcgagttcctgctgcagctcctgcttctttttgtccagctcctgcttcttctgctggtagtccttgttgatggagtcgtaggagtcgtcgtcggagtttccgttcgagtcgccgcgcggaacctcgatgtagccatctttgttcttgttgttcgaaccgccgttcgtcgtctgcgacgtttcggtgcccttgccgtccttgccgtcgcctcccttggacgtcaacgcccaaaccagcacgccgatcagggccaacgcgacgacgatggagacgacgatggcgatgatcttgcccgtgttgttcttcttcggaggctgaccgtacggctggtacggagtacgctgatacgcaccctgctgcggatagccgccggcgtatggctgctgccgttggcctgctcccaccggaggatagacgggctgcccgcctgccggcggacgctggccgccggcgtagccgccctgaccctgccaggagtcatgttgcgggtaaccgggctgcgcgtaaccgggctgatgctccccgggctgcgaagcagctccatactgcggataatcgttgttgccgttgtgtgcatcgccctgaaccccgtaaagcgatgcaccgttcggataaccgccattggccggaccttgcgggtacccctgattcgcttcatcgttcatggacaccacactaggcgcagcaagcccgacgcgcaagcgcaccagcaatgatgaccacccgttgaaacggttctgcgactgcggatcagccgataagatgcgcgatggcgtccagcgcgagcttgtacccgtagaatcccattcccgtgatggtgccggtggcgaccgggctgatgaccgaacgcttgcggaactcatcacgggcggagggattggagatgtgcacctctatcagcggcagtccggcatcgcccaccatgtgcgcggcgtcggccagcgcgtacgagtaatgcgtgaatgcggccgggttcatcaccaccggggtctgctcgtcgacggcctgatgcatccagcgcaccatctcggcctcgtcgtcggtctggcgcacctcgaccttcagcccgagcgcggcgccccactgggagcattgcgtgcgcagcgtctcaagatcctgcctgccgtagacgtccggctgacgcactccgaggcggcccagattcggtccgttgacgactatcaccttggtcatgatgcacttcctttggctgatgattgatattgctggggtgggcgaaaacgcgactcggaccggtcatgtggagaccggtccgagtcgtcacgcctggatacgtctgaatgcctcctcgaccgcgtccgccggcggatcgtccagatgcaccggatggccgatcgaatcgagcacgacgaaccgcagcttgttgccacgagccttcttgtcgcggtgcataagcgccagcacttcgtcgaacgtgccgccgttccatgaggtcggcagaccgagcgagccaagcagagagcggtgataatcgaccagatcctggtcgatatagcccagcagatgacccaattccgccgcatacacgcatccgaccgcgaccgcgttgccgtggcgccagcggaaatgctcaagtttttcgatggcgtgggcgagtgtatggccgtagttgaggaattcacgcaggcccgcttccttgaggtccgcggagacgtggtacgccttgacccggaccgtgcgctcgatcagttcggcgaccacgttctccagaccgctgtcaaggaacgtagccccgtcgaatgcgcgaagttcggccgcatgctcttcaaggatgtgcaggatctcggggtccttgatgaatcccgatttggcgacctcgcccagcccttcgatgaagatgtcgttgggcagcgagacgagtgtcttgaggtcggcgagcacgccggcaggcgtgtagaacgacccgacgaggttcttgccctgcggcgtgttgatgccggtcttgccgcccgtggaggcgtccaccatggcgagcagcgacgtggggcaattgacgtaccgcacgccgcgcatccatgtggcggccacgaaaccggccagatccgtggcggcgcctccgccgacgcccaccacggcgtcggagcgtgtgaagccctcgtcgccgagccgctgccagatgccgttggcgacctcgatcgtcttgcccgcttcggcgtcggggatcacgatgtccgacacctggtagccgccttgtcgcagcagcgtgcgggcacggtcggaatgacgctgcaccggctgcgtgtggatcagggctatccggaccggcttcggccccagcacctcggagaggtggttcatcgccccttccccgatgctcacgtcataatcctcgatggtcgcgccggtcacatgaaccgttcgttcggtaatcatatccatcatcttcctcgccgcggcgagcggcgtctgcccgtatgtttcgacatggacgttcgccacccggtagtacaccgggtcgcgctggcggtacagcttcttccagcgggcatcggcgtccccctgcagcatcggccggccgccaccgcgatgggcccgttccatggcctcgcgcgggtcggccatgagatacacgaccttgccgccgtcctcgatgtattccttgagatcgtcctgcactgcgggcgtcatcggggcgccgccgcccagggcgaagacgcctccgaacccgtgcagcatcccggcgatgacctcggattcgacctcgcggaacgcgggttcgccgtgacgctcgaaatattcggggatgcgcatgccgacctcgtgctcgatttcgacgtcggcatccgcgaacggcatcgacatcagctgcgcgacctccttgccgacacgggtcttcccggcgcccatcataccgatgatgacggcgactggtcgagcgggcatggtttctctcccttggttcaggacgtacggttcgttgcggatgacgttaccgcgccgtcagcgcatgtgctccggccaggaggcgacgtactgctcgaagttgcggcgcgtctccgctacgctgtctccgccgaacttgtcaagggcgtatcgcgccaagatgagccggaccatggcctcggccacgacggaggccgcaggcacggccgtggtgtcggaacgctggttgatggcggatgcggcctcgccgtcggtgacgtcgaccgtgcgaagggcgcgcggaatcgaggggatcggcttcatcgcggcccgtacgcgaatcggctggccgttcgacatgccgccttcgatgccgcccgcacggttggtcagtcgcgtgatgcgcccatctgcgccggggaccatctcgtcatgcgcctgcgatccggggcgcacggcctccaggaacccgtcgccgatctccacgcccttgatggcctggatgcccatgaccgccgaggccaaggcagcgtcgagccggcgatccgattcgacgtaggtgccgatgccggcgggcacgccgtatgcgagcacttcgatcacgccgccgacggtatcggcggtggacttgatctcgtcgatgcgcgcgatcatcctctcctcggccgccttgtccagcgtacgcaccggggatgcgtccagcgcttcgacgtcgtcgggggtcggcaacgctgcgtcatcggcgtcctcaacgcccgcccctccgatggagatcacatgcgacacggtgcgaatgccgaacgcctgctcaaggaaccgcgcggcgaccgcgcccagcgccacgcgggacgcggtctcgcgcgcgctggagcgctccagcacgggtctcgcgtcgtcgaacccgtatttgcgcatgccggtgaggtcggcgtgtcccggccgcggcctgctcagcggggcgttgcgcccctcacgcggcagatcgtggtcgagtggatccgcgctcatcacctcggtccatttcggccattcggtgttcgcgatctcgatggccaccggtgatcccagggtctcgccgaaacgcacgccggtgagcagacgcaccttatcctgctcgaacttcatgcgcgcgccgcgcccgtatcccaggcgccgtctcgccaatgcatcgacgacgtcatcgctggtgacccgaacgcccgcaggcagcccctcgatcatcgcgaccagcgcctcgccgtgtgattcccccgccgtctgccagcgcaacatgccatgctcctttgattcaatcggtaacttcgctatatcttatgtcatgacctaccttgcataccttcccagcttgatatgtggtatcgccgtgagtgtcgaggacattcggcgccggcgtgtgccgcgcctgtggatcgccatcgggtgcctggcacagctggtggcggtcatcatcgtcgccgtcatggcgaacacgatgttcctgctggtacaggcccctctattcgccgcgctcagtgccgtgctgcaggccgggctggcgatggccaagcccggatcgatggggttcggcgacgtgacctgcacgctggccatgggcctggccgtggggatggccgggctgaccgccgtggtggtctggtggctggccatgggtctgctgggattggcatggatggcgctgtggctaaggttcgatccccagcgccgatccgaccatgcgggcaaggtcccgttcgcacccgcgatcgtctgcgcggcggtggtcgcggtcatcgcgacgacgctgctttagttcgcgttcttgttgttgtccttgtattccttgacgtactgctcgaactgcgcgttctgctcctcgacggagccggtggtgaatttcgtctcgccggtactcaggttcacggtgacgaaatacagccagtcgccctgctccgggttcatcgccgcctggatggcgctgtctcccggattgctgatgggcgtgggggtgagtcccttgttgacgcgcgtgttgtatttgttcgacgagtcgttgagctgcgcgttggtcagctgcgtgccgttgatgcccagaccgtacgcggtggtcgaatccatgcccagcgtcatgtcgcggtcgagacggttgaggatgacgcgggtcaccttgccgtagtaatcgggcgaattgacctcggcctccgcgatggaggcgatgatcagcagccgctgccgctcgctgccggtgggcacgtgcatctcgttgagcttggagacgcgcttgtcgacgatggtcttcaggatcttctgcgcggagccgagtcccttgacgtcgtacttgccgggttccagccatccctcgaagttgccgccggcttccgcgggcagtattccctcgcctttggcgtcgatgatcttctggaattcggattcgtcgatctcgctgagcgccgcggccttcttgatgacgtcggacacccgctcccccgcgttgacgtcgaggaagccctccgccttgctctgatcggacaggatcgccgccacggacgacgcgggcatgtgcttgcgcagctgataggtgcccggatacagcgtcatacccgatgagacaccggtgaacgcgtccgcggacttgaccacttcggcctcgacgagacgcttggcgatgctggacgggctctcgccctgcgagacggtgaactccacggacccgtatccctgaccgctgtagtcctgcacggagtaggtgtcgccgtcgttgcggtccctgatggcgcgcaacgccctgactccgaagaacccgccggctatgaccacgacgagcaccgcgacgaccatggtcagcacgatgatggtcttgcggcggcggacattgcgccgacggcgcatttcccgccgtgatttcggcggtctggggggctttaccgacgtggtgttgcctttggagtcgacccaatgggtgttctcctcgaaaaaatcggcgaggtcatctgacactagctctctcctcacactttcatggcgccgtccagcgcggtctgcaatatcacgacagcggattgctgatcgaccaccggacgatgacggcgggacccgagttgcgcttccagcaattgccgatgcgcgctgaccgtggtcagccgttcatccaataatgttacctgaggaatgtggtacaacgcgaaatcgtgttcatccatcaagttgcgcatgcgcttttccaggttcgcgctccaacggcgagccttcttcgcgctttttccttcggtgccgtcaagttgaagcggcagtcccaccacaatgtggtccaccgcttcgtcctcgatgacagtaatgacgtcatccagcgcacggaacgaatcgccgtatgcctggatgttgccatagggatgggcaaaggtgagctcagggtcggacaatgcgagcccgaccctggcgtcacccaaatcaacgcctagccataccacctgatggttcagcccttcagcgcctcggcctcaagtgccttcagcgcctcgtcgatgcagctcgcgtcggagccgccgccctgggcgaagtccggcttgccgccgccaccgccgccgagcatcttggatgccccgcgaaccaggtcgccggccttgatgccgttcttgcgggcggcctcgttcgtggccacggcgaccatcggcttgtcgtcctcggagacgccggcaagcgctacgacgaccgacgcgtcctcgccgagctgggcgcggacgtccatcacggtcttgcgcagcgcgtcgaacgagccgaagtggccgacgttcttcgcagcgaccttgacacgcgccgcggacgtcttcgcggccgcgacgagctggggcacggacgcggccagctggccttcgtacatggcggccagacggcggtcggattccttgagcttggccagcagcgtgttgacgcgctccgccagctcgtccggacgtgcgttgagcttgtcggacagctgggagaccagggcgtgctcgcgggcgttgaactcgtaggcgccctggccgacgacggcatccacacggcgcacgccggagccgatcgaggcttcggacatgatgttgatcgagccgatcttgccgacgtggtcgacgtgggtgccgccacacagctcgcggctccagccgtcctcgccgatggagaccacgcgcacgatgtcgccgtacttctcaccgaacaggtgcatcgcgccgagcgcgatcgcgtcgtcgaacttcatttcggtggtggtgacgatcaggttgtcacgcagacggtcgttgactcgcgcctcgacggtgttcatcacgtccttgctcggtgccgacgaccactggaagtcgaagcgcaggcggttcggcgcgtcctcggatccacgctgcgtagcctgggggccgagctcctcgcgcagggccttgtggaccatgtgcgtggcggtgtgcgagcgggcgatggcgccgcggcgggcgagatcgatgctcgcgctcacctcggtgccgacgaccagcgtgccttcggtcagacggcactggtggacgatgagatccttgatcggcttctgcacgtcgtcgacttcgagcaccgcgccatcgtcggacaggatctcgccctgatcggcgagctggccgccggcctcggcgtagaacggcgtacggtcgaggatgacctcgacgttcgcgggggcgctgacggccggaaccgaacccttgccctcctgcatgatgccgaggacgcggccgcgagcggacatgtcggtgtagccgaggaagtcgatgggctgcacgagcgtcttcttgaagtcgtcgtacacgctcaggtcaacgttgtggcgcttcttcagcgcatcggcacgggcgcgggacttctgctcgctcatcagctcgcggaacttggcctcgtcgaccttgacgccctggtcggccgccatctccagcgtcagctcgatcgggaagccgtaggtgtcgtgcagcgtgaacgcgtcgtcgccggagacgaccgggtcggaggtcttcttcgccttgttgacggcgacgtcgaggatttcgatgccgttgtcgagcgtgcggcggaacgcgtcctcctcgccgtaggcggattcggagacgtcatggaacgtcttttcgagctccgggtagctggcgaccatcgcgtccttggagacgggaagcaggtgcgggatcaccggctcggtgacgcccagcacgcgcatggcctggatggtgcgacgcagcagtcggcgcagcacgtagccgcggccgacgttggacgggcgcacgccgtcggacatgatcatcagcgcggaacgcacgtggtcggccacgacgcggaacttgacgtccgcggccgcgtcctcgccgtacttgcggccggaaagctgctcagccgcctcgatgaccgggtagacctcgtcggtctcgtagatgttctgcttgccctgcatcaggtaggccagacgctccagaccggcgccggtatcgatgttcttctggttgagctcgccgacgatgtgcaggtcggtcttggacttgacgttgtcgacctcgtagttctcgaacacgagatcccagatctcgatgaaacgggtctcgtcggccgcggggccgccgtccttgccgtattcgggtccgcggtccacgtagatctcggagcaggggccgccggggccggggccgccggtggtccagaagttgtcttccatgccgaagatctgcatgtgctcggggtcgaagccctcgttcttccagatcgagcgggcttcctcatcatcggtgtacgtggtgacccacagcttctcgggatcgaagccgtaaccaccttcggactgcggcgtggtcagcagctcccaggcgtagtggatcgcctcctccttgaagtagtcgccgaaggagaagttgccgagcatctggaagaaggtgccgtgacgggtggtcttgccgacctcgtcgatgtcgagcgtgcgcacgcacttttggttggaggccatgcgcttgtggggaggggtctgctcgccgagcaggtacgggatgaacggcaccatgccggcgatggtgaacagcgtggtcgggttcggcgagatcagtgacgccgaaggcatgaccagatggtcgtgcttggagaagtaatccagatagcgcttcgcgatttctgaagtgcgcatgagttggtgagctcccttgtgggttggggccgtgctggcccgcatgcaaaatgatagataaaaatttaaacagctgttatgcgtgtgaaagtgggggcatgccccggattcgctaccgcgcggcgcggtcgatgtaatgttggttgagctcagcctcgcgggctcggcgggtggcgttgaactcgttgaccaggccttccagcgtcctcatgcccacatggtcctgatccggaccgaacacgaacgctcgtgcggcgtcaggggtgttggccttgacgtaggcctgggctttgatgacggctagggcgccgacggtcacgccgacaccgatccagaacaatcgtttgaacatcactgagccttgctttcctgctgtccggagccttcgacggagtcacggccggtgctcttcttggcgacgaacgactgcgcggtggatttcagcgcatagaagaacgacgcgatcttgatgacgggcttgccgaggaacgaaccgtaaagatcggtcagggcgcctacgttgttggcagtggacgacgcggccgcggagatcctgttgacatcctcaagcgatttgttgacctgcttgacggtggtgacgccctcatcgagggccgggatggcgtgctcccccgactcacgcacggtgtccgcaatctggtcgaacagcttgccgaggcgaatcaacggatagatcatgaagcccgcaagcacggcgaacgctattgccgcgataaggccggcgatctggccaacacccatgtgtacctcttttccgtcccacaggcatacgcccgtgcacacaatacccgcaacacactagccgtcacccgagaccgacgctgccggcggcatgcgggtcggccggcccggtcgcgcgtctcactgattgtatgacacgacggtgagagccacttcgaacggcttggtcgtatcgaaatcaaggcacgtaaccgacccgttggccggcctctcgctcaggtcatacccttccggcgcgaagcggtgcatgaggctgagcagcgtattgccatgggatatctgcagcacgtcgtcgccgtccttgagatccgggttggacgcgatcagggaaaacgccccgtgcacgcgggcccagtattcggcgtcggattccgcgtcgtggaacgggtcggcctccttgaggaagtcgcgggtcgcggcgaggccgtacttggcgacgatgtcgttgtagtccttcgcgccgtggggccctcccgcggccgtccaggcgagcgacatgtcctgaccttcgaaatagccgtagcactgctcgcggaaatgcatgtccgacacgagcaccggccgggcgttgccgacctcctcgttcacgtcgaggatgcgcttcgcggtgatctgcgcacgcgacgtatcggagcagtacgcggcagcaaaccgcacgtacttgagtttttccgccgccttgtcggcgtccgccaaccccgcttcggtcagcggcgcattgcaccatccctgaagtcggttatacctgttgaacgtggtctgtccgtggcggacaagatgcagatggagaatcataccgacgattattccacgcttcccgcatgccacaaaacccgccgcgcccatcgccacagacccctccagtctgctaacgcccccgctggcgggggggctggcatgcgcggcatgactgggggtggttctcagctcaatggaacagcccgcactcagtccctacccatccgtccggctgattcgctcccatcccgtgtgccacaccaggcgaaaaacaccccaaaatcgcatggtgtggcacagcagaaggccacaccatgcgatgtgagccttcacatcacgtggtgtggcaaagcacgggtcgcggaaaccgccattttccaatgaccggtgaatgggcccggaaccgcccttggccacaccagccccaaaaccgtcaaaaaacgcatggtgtggtacaggcgatagccggatgacggtcggcggggaatcatccccacgcctttcccgcgaaagtcccatcaggtgacgcgcaaacgggactttcgccggatgaacacatatgaacacaggtaaacacaagcgcaagaacaccaatgaacgcgaacgcgggttcaggtcacaactatagccatgaaacccgcggtgaagtagactaggccacatgagagagcaagaacagaaggggctgcctgacagccagcggcaaatccgtttcgacggcatcgacggcctgcgtgccgtggcgatactcggcgtggtcgcattccacacccgcccatcgctgcttgagggtggtttcatcggtgtcaccatgttcttcgtgatcaccggcttcctagcgactcgttcggtgattcgcgcagtggacagccatggcacgttccagtatggaaggtatctggggcgccggatcaagaggctgtggccggcaacactggccacaatcgccctgaccgctccgttcgcatggctgttcgccccgagccttctcgacaaggtgcgcaccgacgcgcttccaggcgcgctgttcgccagcaactgggtgaacatcttccgcaaacttccctatttcgcggcggccggactcccctcccctctgacgcacctgtggttccttgcgctggtcatgcagttctatctcgtatggccgctgctgatcatggcgatcggccgtctcgttcgcgccaaatgggctcggaccgtcgtgatggtgataatcgtgcttgcgtcgagcgcggcgatgtggctgctgttcgatcccgacgacacgtcgcgcgtgtattacggtacggatacgaggctcgcggagctggcgatgggggcgatgctggcgatgctgatgcagcgtgccgaccggaccgctgacgatcgcaaacagagagacgacggtcgcggcgcgtccgctatcatcctggacgtgttcggctggctgtcgttgctggccctatgcgccggtttctggttcatgaacggctatgacgacacgatgtatcacggcgggtaccttgtcgccgccatattgggcgccttggccctcgccggcgccatcagaggagtgagcctgccgcgtgtgctcggctgcgctccgctgcgttacctagggtcacgctcgtattcgctgtatctcatgcattacccgctgctgcagttcatgaatcccgccacccgcaccgaagcactgccgtggtggggatggctgattgaggcggccgtgatatggacggcgacggaggcgttctaccagctggtcgaggcctctcgcatgtacgagccgacgccgcgcagcaggcatgcgagggcatcggtggtgccgagcggacggctgaggccggggtcatgggtgatggcggctctcggcatcgtcaccgtggccgcgctcacttgggcgccggtgaattgggagcagatcgcccacgaccgcatgatccaactccggcccgaactcgccgagccggcgaagcctctcgccctgcccaagccgaagagcatcgaaaagccctcggacgacggtacgacgagtaacaatgccacgacgaatcagacgaatgacgacggctccgagcggaacggagacagcgcaaagccggcgtctccatctgtcgcgcccattgcggagaaggtgcccgacaacctggatgcttcgaaataccactatgaccccaatacaggaagctgcaacgccgacatcatgatgatcggcgattccgtcacctccggcacgaaggatgcgatccaggcggcgtttccgaacggatacatcaatggcaagccgaaccgtcagatgcctcaggccgtcagcgtgttccaacaggcgaccactgccgggcacagcggcagcgtcatcatttacgggctcggaacgaacggcatcatccgcaacgaacaggtggtccagcagctgatcgaccttgcgggcggcaagccggtgtatttcgtgacgatccgtatgccctatccgaaccaggagaagaacaacaactcgatgatgcgtgccgcagccagccacaacggcaatgtgggcatcatcgactggtacaagtacagcgagggccacggcgaatacctgtacgacgacggcatccatcccaacatgaccggcgcttatgcgtatgcgacgatgctgcggcaggcggtgtgcggccagtgacgatgaacgcggccgatggccggtcgaacccgtgagaacaggaccggaatacacgaacgccccgggcgcaatgccacggggcgttcgtgtgtatgtatgtccttacgctgtaaattacaggtggtggatccagatcagcgagcgtagaactcgacgacgtactggatgttgacctgaaccgggatctcctcgacttcaggcttgcgggtcagggtggccttcagggaagccaggttcacgtcgaggtagccggggacgggcggcagcacatcgcggtgcacgccttcggcggcgatctggaacggaaccatggtctggctcttggccctcacctggatggtctggccgggcttgacacggtaggacggacgatccacgatgttgccgtcgacgaggatgtgacggtgcaccacgaactgacgggcctgagcagtggtacgggcgatgccggcacgcagcacgaggttgtcaagacggacttcgagatcggtgagcatcgcgttaccggtctggccggcggtgcgggtcgccttctcgtaagcggagcgaagctgcttctcggagacgccgtactgggcgcgcagacgctgcttctcgcgcagacgaaccgcgtaatcggattcggtgcgacgacgggtgcggccgtgctcaccgggagcgtacgggcgcttttcgaagatgcgctgagccttgggggtcagtgcgatgccgagggcgcgggaaaggcgcacctgacggcgagaacgctgaacgttggtcattcttgttcctttattctgtcgttatctgaacggaacgcgaggctgtccccgcgctgagtcggcctccccagtgcttcgtcgtgacgtgcacgaacggcggaaaaccgccgccgacccactgatgggctaagactccagatagcatccgccttatggcagacacaatcgtttataatcgcataccctatggacgaccctgcgtgtcaggctccgccggccggggtgagccgccccgcgtccatggcatacacgcggtcggcgtatggcaacgtgtcgccgtcatgggtcacgataagcaccgccgccgtctcatcggcgacgttgcgcagcagacgcatgaccatcgtggtgctcgtcgcgtcgagatcgccggtcggctcgtcgaggatcagcagcttcggcccgttcatgagcgcccgggcgatggagacgcggcgcatctcgccacccgacagctccttgggatagctgtcggacaggtcagccacgccgagtcgatccagcagcatcgtcgcccgtcgctccagggcgtcgggctcgtgctccgccgtgagatcatcgtcgatgacgtcgggcatgtcggcatcgtcctgctcacgtgcggaatcggccgcgccggcggcatcggcttcgccgggcgccgcaacatcatccggcaccaccgttttcttcgccgggccaaacagcacggccggaagaatgacgttgtcgagcacggtgaggttgccgagcagcgtctgtccctgcgtgacgaacccgagcgtcgcgttgcgcagctgcgagagctccttgtccgacagcttggagacgtttcggccgtcgatctcgacggtgccggacgtcggcttgagcaggccagcgatcagattgagcagcgtgcttttgccgttgccggaacgtccgatgatggcgaccagttcgccctggtccatggagaagctcacgtggtcgacggcggcgaaacgcgcgctgcgccgggtgaattcacgggtcagatcattgatttcaagcatcgccatgatgaatcactccccctcgcgcaacgtgagataggtttcgggcgcggacagcttgaccgcggtgacgattgacgccagcagtccggtcgcgacggcgaacacgaggcttatggcgacgagcgcgacgaccttgagcgcgtcggtctgcaggtatggcagctgcagctgcctgctgatcagcgtgttgaacgggaacaccgccagagacgcgcccgcgatgccgatgacgccaccgaccagtccgatcagcgccgattccttgacgatgagcgcaatcagtgtgccgcgcgtggcgcccatgatgcggtaggccgcgaattccttcttccgctcgttcatcgcggatgcgaacactgccagcagcacgatgaggcccatgatccagaacactgcgacgaacagcgtgacgtacccgaccagcgcgtcgaggttggtcttggtggtggctgtcacgccgcccggatacacgaatccgagcccttcgagaccggattccttggtgatgttgagcgagacctgcttggcgtcatacccgtccttgaccttgatgaggatcgcggagaccgccttgtcggcgtattcggcggggatggccgtgtgtcccaccgacgacgagtacgagacgatcgaggggatggtggacatattgacgaacaccgaattgtccaggctggtgccggtcgagccgagctgggcggcgaccgggaactcatgcccgtacagcttgatcgtgttgttgccggatacgctgatgttcgagccggctacgacttctccgtctttcagcgtcccgtcgaactgcgatgtgatccagggggtgatgacgaagtcggtcgcggggttgaagcctatgatctgcaccttctcgtcgcagcatgcggccgcgagcgatgatatgtacgtctgggccgtgactcgggagatgccatcagccttggagaccaggttctcgatgtcgttggtgaaatagaacgtgttggatccgccgttggtgagcagggcctcggctttggcgccggtatcctgcggcaccaccatgaggtcggctcccatgcgttcctgcatgctgcgcaatccgttgcgcaggttcatggacagcagcgagccgccgaagaacgcgagcgtcagcatcatgacgacgatgacgagcgcagccgtgcgaaacggcttgcgcttcaggttctccagtggcagtcgtttgagagtgattcgtgtgatcatcgcttgacgggcttggagtcaaggtagatggcgacgacggcgaacagcagtgccagaatgccgatcacgatgagcgtcggcctggtgaccatatggcaatgcatcatggcgcccttgcacacgccgatcagcaccgtcggcacggccagcgacagcagtgcgttcaaagcgacggcgatattgagacctgtacgtatcttcgggctgcagaacaaagcgatgataccaagcagggcgatgaccacgccgatgccaagctccgcttgcgcggtgtaatggcacgccatgggcatattatccttgacctcgcacacatgagcgaatgcctgcggggcgacggcgataagcacgccgaacacgatggccggcagcgatgcgaatagtctacggaacattgttgtctcctctcggttgaagatggacatcgacgattatgtcaaccgtttccgggaaacacaagccttgacttttcaacgcttttcatatatgcgccggtcatccgccggtaaggtcccgccaccatcctcccgctggcgggaggtggcgcgaagccgccggtgggtggttacctcagagcttctccagcggcgccacgcgcagcatcagccgcttgacgcccgacgagccgaaatcgaccgtgattacggagttgcggcccttgtcctgcgtgtcgacgacggtgcccagcccgtactggtcatgcgtgaccttgtcaccggcatggaagtcggcgatgttgaggttattgtccttgctgagcgacgaggccggtttggccgacgagagagatgacttgggagcggtgcggcgcgtcgtgaccttgccgccacgcgacaatcccgtggatgagccgaaccggctgcccgacccgtactgctgtccggagccctgacggccggaaccgccgtggcgcgaagatgagccgaatcccctggccccgccatatgacgagcccgatccaccgcgcgaaccggagccgaacgacgaggaaccaccgtacgaggaacgtccacgagaaccgtatgacgaggaaccaccgtacgaggacgatccgccgtatgtggtgccgccgaagtcgtcatcgtcccatccgccgaactcgtcgtcgaagccgcggcgtgaccagccggagcgcatgccctccatgccggtttcgcgccgtttccagtcgatgagtcggtcggggatctcatcgaggaactggctgggcatcatctcgttggcctgcccccactgcgcgcgcacggcggcacgggtgacgtacaaacgacgcttggcacgcgtgatgccgacatatgccagacgacgctcctcggaaagctcgtcggcgtcctccatcgcccgcgagtgcgggaacgtgccctgctccatgccggtgaggaacacgacggggtattccaggcccttggcggtgtgcagagtcatcaacgtgaccttgccggagtcctcgccctcggagggcagctggtcggagtccgccaccagcgccgtggtctccaggaatcccgcgagtgtggcgtccggcgtgttctgctcgaattcggcggcgacggactgcaactgggacaggttctccacgcgggaggcatcctgtggatcctcggaccgctgcagttcttcgagcagaccggactgcgagagtacctcccccaccacttcggacggcttgccgtcatgttcggccgcgaacgcgctcagggagcgcatcagatccctgaatgcggcgagctgcttgccggtacgggtgggcacgccgtcgatctggtcaagatggtcaatgccgtcccagaacgtggtcgcatgagcatcggcatatgagacgatgatcgattcggcgcgaggtccgagaccgcgcttgggcacgttgaggatgcgccgcatgttgacgttgtcggccggattgacgatggcctgcagatacgcgatggcgtccttgacctcccgccgctcgtagaaccgcgtgccgccgaccagctgatacggcagtccggcatgcacgagcgcgccttcaagcgcacgcgactgcgcgttggcacggtacatgatggccatgtccgaatacggcgtgccctcctcggcgcggacgcgagcgatctcccccgctatccacgcggcctcctgctcggcgttgtccgcggcatagccgacgatcgggtccccgctgcccaatgcggtccacagcttcttgggcttgcgaccctggttgttggcgatgaccgcgttggccgcgtcgaggatggtctgcgtggaacggtagttctgttcgagcatgatggtcttcgcgttggggaaatcctgctcgaaatcctggatgttgcggatgtccgcgccgcggaacgcatagatcgactggtcggagtcgccgacgacggtgatccatgccgggccggcccgccccgccgagggggcgtcctgcacgacctgcccggccgcgtccacgcccgccagctcgcggatcagctcgtattgggcatggttcgtgtcctggtattcgtcgacgaggatataacggaacttatgacggtaatagtcggctatctgcggttgggtgcgcagcagttcgaccgtccggccgatcagatcgtcgaagtcgacggcgttcgccatggccagacgatgctggtattcggcgtagatgacggaatacagcacctcgatgtcgccgaaattgccgatctgataaccgcgctggccgggccggtagtcgggcgcgtagcgcttgagctgctcctgccagccgatcagtgagttcttgtagtcggagatgcgcgagaggatcgcgcgcggcgtgtagcgcttgagatcgatgttgagatcggcgccgaccagcttgacgaggcgctcgcagtcggcggtgtcatagatggagaagcccgacgccagccctatcgactggccgtcacgcctgaggatgcgcacgcatgcggaatggaacgtcgacacccacatgcgctgggcgaccggtccgatcagaccttcgaggcgttcgcgcatttcagcggccgccttgttggtgaaggtgatggcgaggatctggctcggccatgctccgaattgcgtgaggatccacgcgatgcgccgggtgagcacgcgtgtcttgccggatcctgcgccggcgccgatcagcagtgcgggcccccggtactgcaccgcctcggcttgctgcgggttgaggtcgccgacgagttcctcggcgcttcttgcgatgagatccggatcctgctgcacgctgctccccctgacggttgacgatgattcggctttcctgtttaccacatggttcggtcagtgtcactcgatatgggcgacctcccattccgccaacgcgttcctcagaccggaggcatacaggtcttcgccttgtccggcctgcgggtggatgccgtccggtccgagccaatcggtgtgtgccgcgatagcactgttccagtcgatcagaatcgaatcggtgggatgcttgcgcacgtagtcggaggccgcctgattggccacgggaatccactcgcggtcgccatacgcattgatgatgaccagcacatgcccatcacccgccgcggccgcaatccgctcgtattcgccgaccgtggtcgcgctgttcgtgttcagcgagatcaccacgtacttgcgcagacggccttccgccttcatctgcgcgacgataccgggcgcggtcaggatggaccgcgacacctgggcgtccacggcgatgccgggcagtgacttctgcaatgccgccgacgcgcccacggtgacggagtcgccgatcacggagacgtcctcgccgttcagggtcttctcgatggctgccttggcctcctcgcggcgcttgcgctcctcctcggcgcgtttcttcgcctcggccgcggccttggcgtccatcttgcgctgacgttccttcttggcgagcgcgctctggttcttctccagcatgatctgtgtctgcgtcttcgccggggcctgggccacacccatgaagaacccgatgacgatcagtaccacaaccgacacggtgacgaccatgcgcatcgcctccgcggtacgggagctgcgggatgcgacgaccggcgcgtcttgcggcgagggcaggggcgcagcctgagagtacggctgagtgaactcgacgttgttgaggtgcgtcccatacacgccacgtgcccgcgcgctgccgacccgtcgcggagccgaacgttgcgccaccgggcggcggggagccgacttgtcgcgcttggacttgatccattccgcgaccggattctccaccatccaccatgacaccgcggtcatcacgaggctcagcagcaacgtgagcgcctggaccacccacaatccgctgccacggtaaccgggaagcatgagctgcagcagcaggtacaacggccaatgccacaggtacatgccatacgagtatttgcccagcagcgcgagcggacgccagccgaacaggccgatcatccatgaatccttggaaatgctgccgccgatcagcactacggtgagcacagaggccagaatcagaccgccgcggaacgctgacgcatcctgtccgacgcgcggcatcatcatgatcaacacgaccagtgcgccagtggccagccagggcataaccatggtgaacaggcggcgcggctcggcgtcagactcctcgctgtgccgcacgacgaacgccagcgcgactcccaacagcatgccaaaacagtgcgtgtccgtgccgaaatacacgcgtgtggggtcggcggacgggttgtacagcacccacatgccacacgcggacagcgcggcgagcagcaccggcaccaacgcctgcacgaacgtggagccgattctgtgcagcatggccgtcaaaagcggcagcaccagcgtcgcttgggccagcagcgccacgaaccataagtgccgcagcaattgcggcgacgtcgccgcgaaatagctgtctccggagaagatctccccccaattcgacgtgaatgtcagcgcggagacgcttttgcccggcacacccaccagaatgtcatggttgacgaacaggccgagcgacaccgagccggcgatcatgaacgccatcgccggccacagtcgagacaacctgcgcagatagaaattgccaagacgcagtctgccggtacggtcgatctcacgaaggacgctcagggcgagcaggaagccggatacggtgaagaacacgtccacgccaatgaaaccgccgggcagcgagcgttgcgacaggtgataccagatgatgccgatcagggcgaatcccttgataccgtccaggctcccatagcggtcattgcgcatgctgatactccttacacgacttcccgttccgtcgaggttatgctagagcatccccctccccaaaaaaaacattttggaatcacagagtgttcgtcaaggactcgtggcggattcatacaggtcgccgcggtcatctgcatggcgtatgctgtccctctgtcctattcattgacggtacaggcaaaggggacttatgaaggagctggaagagcgcattcggcgtgatggaacggtcaagaccggtgacgtgctcaaggtggacgcgttcttgaaccatcagtgcgacgtgcgtctgttcgaccatatggggcaggagtgggcccggcatttcgccggcaagaccatcaccaagatcctgaccatcgaggcgtcgggcattggcatcgcctgttgcgccgcacgccacttcggcgatgttccggtggtgttcgccaagaaggcccagtccatcaacctcgacggcgaccagtacaccaccacggtgtactcgttcaccaagcgcaaggagtttcccgtcatcgtgtccaagaaatatttggacgccgacgaccacgtgctgctcatcgatgatttcctggcgaacggcaaggcgttgcacgggctcatcgagctgtgccatgcggcgggggcgagtgtcgagggaatcggcatcgcggtcgagaaggggttccagggcggcggtgacgaactgcgcgcgcagggctatgacgtggattcgctggccatcgtcgagtccatgaatcccgagaccggcgagatcacgttcagggactgagtccggaacagcagagagcaacggtagatcagaggagagaaaaggaaaccatgtcgcagaagaaaacgaagaattccgtatcgttcgaggcgctgtcctcgctggacgcgcccgtgtcgttctggaagggcattccgttcggcctgcagcatgtgatggcgatgttcgtcgccaatctagccccgatattcatcgtcgccaacgcggcgaagatgacgtccgcgcaatcggcggccgtgattcagtcgggtctgctggtggcgggtctcggcacctgcctgcagttgtatggcgcgtggctgatcggctcgcggctgccgatggtgacgggcatctcgttcacctatgtggccgccgcggccgcgatctgcgccgacaagggttacggagccgtagtcggcgcggtgatcgtcggcggtctgcttgagctggtgctgggcctgaccgcccggtactggcgccgtttcgtgcctccgatcgtctccgccatagtggtgacgtccatcggcttctcgctgctgaccgtgggcgccacgagtttcggcggcggtgacgcgtccgccgcggacttcggatcctggcagaacctgacgctgggtctcatttcgctggtcgcctgtctggcgttccaattgctgatgaagggcaccgccaaacagctgtccgtgctgttcggcctggtggtcggctatgtggtggcgatttgcatgggcaaggtcgatttttccgggttccaggagctttccgtcgtttcgctgccgcagttcatgccgttcaagcccgagttcgattggggcgcgatcatctccatcggactgctgtacgtggtctcgtccgtcgaggttctgggagacaccgccgcactgaccaaggtgggtctgaaccgtacgccgaccgagcgtgagacggccggagcgatcgccggcgacggcctgatctcctcggtctccggactgttcggatgcctgccgctgaccagtttcgcccagaacatcggactggtggcgatgacgaaggtcgtcaaccgcaaggtgatcctgtccggcggactgatcctgattctggcgagcttcgtgcctgccgtggcggaggcgttcaactcgctgccgcaagcggtgctcggcggctgcacgatcatgatgttcggcaacatcattctttccggattccagatgatcgccgaagccggcttcacccagcgcaacatcaccatcgccgcgttgagcctgaccatcggcatcggcttcacgcaggtgagcgacatcttcgcgcagttcccggccctgttccgccagatctttgcctcgaactgcatcgccgtggctttcgtggtggccgtgatcctcaacgctgtgctgcccggcgaagaacgattcctctccgcccccgccaagaacgaggactaaaaaatctaagctgcagagcatctgccatctccagtcgcgaagcgactggagatggtcattggcaatcaaatcacgacctcgccgaaataatccgcgtcatgcaccctgccggctgattccgcccttgtgaccggtcgccttgaacggtttggcggatcttcccctcaccgggcgaaaaccggcccgatctttcggcgggtttgcctccgggtcgtcatgacggtgcctgccggcccgcccgacctcatcctgcggcgtgcggatccctttggcctgcaatgcgcgcagccacttgtctttgttgttcgtcatctctcgtccttcgccatctctcgtccttcgccatcgcgtcactcaatcgtgacggatttggcgagattgcgcggcttgtccacgtcataccccttgatctcggccatatccatgtcgaacagctgcaatgggaccacgtcgacgagcgggctcatcaacgtcgggcattcgggacgccggaacacgacatccacataacgttcatcatcccggcgccctgttcggcgacggcgatgatgaacgcgcctctgctcttgacctcctcgatgccggaccgcaccttggcgtgcagcacgtcacggccgcgctcgggcggcatgatgaacaccaccagctctccctcatcgaccagcgctatcggaccgtgcctgcctgcgtgtcgagcacccattggatcttggccggcatgcccttgagcgagtcgatgatctgatggcatcggattcgcgcggtatcgacgccacctgcgtgttgcagatcgacagcaccatggatccctgctcgcgcacgtggcgcagggccatcagcgtgtccatagtctctccggactgcgatatcgccacgaccagcgtacgcagggggtggggatgggcgttcacgtcggagggcgccccgttcgtggcccagcgggtgtgtccgatggcggccgtcgcgggcggcatcgggttacgttccacgctttcgacgagattggcgagccttccggccttcttgtgcaccactgcatgccccatgcccgaagcgacgagcgccactcccgcagagtcgtacccgcggtattccaggcgttgcaatccctgaagacacacctgagggggcttgccgcacgtggccgaaacattacctgcatatccgacgattccgcacatggtctcacagcttagcccagacgccaccaagccgccaacatcgcaatccgccatgtaggacaagtacggataataagtcatctcaagctgttcagcattccgggcatacaccggcacggcattgtcatatatgagatcgcttccataacccgactttgctgaaatatcctcgatgcgccgttccacatcgtcatatcggcgaagcgcatcattcaatcgttctacaggggaagaatcaatatatcgcgttggatgacgcagagcggagcatcatcaatgatgtatgtacggctctgggagggcaaaccgggaaccggcttagtgcgcgtacccacagtgaatcaccgtggctcaacgctcgaaatggtatgcccaatactgccccgtgcaatgcaatcatcagcaaagattccatatcggcctattaccgattgaatcccatcattacagcttagcgatggaatgatcagccgacttcggcagcgacggtggaaagataacgattcgccgggtgccgtatcatcgtaggcatcgacgcaatcgcagattcgtgatgaccggaggaacgcttatggaaaacaggggcagccgtccgttcggctactgggattcgagttaccgggccaaactgcgcaggacatggatcgcgttgcccttctgcatcgtcgcggccgtcgccatgccgatattcaccgctgtcaaatacggtgacgtggtatcgggactcgcattttccgttgtgctcgccgtcgtctgggcatgtcagctgatgtacgccaagagcaaggcgaaggcggaggcggaaaccagaaacgccgtgccccgatacgatgacaatgagctgccccggtgagtcccgatccggctgtcgggcgcgccgtttataggggcttatgcggttggcatcggtcgcttatgatgggaaacgtcagtcgaatcgaacgatgatgggagcatgacatggccaaggcgctgattgtggtggatgtgcagccgacattctgcgaaggcggcgagctgggggtcgaaggcggcaacgcggtcgccgggaggatcgccgactatgtgaacgcgcatcgcggcgagtatgcgtataccgccaccacgcaggattggcatatcgagccgggcgcacactggtcgggcaatccggatttcgtggatacgtggcccaagcatggcgcggcgggcacgccgaacgccgagcttcatccggccatcgcggttctgggcatcgcccatcatttcaagaagggccagtattcggcggcatactccggttttgaaggcatcgaagacaataccgaccgtatccagacgcgcgaggaggtcacggccgaacagtccgccggcaagacgctggccaatgcgctgaaggccgcaggcgtcacgcaggtggatgtggtgggcatcgccgaatcgcattgcgtcaaggacaccgcgcttgacgcgaaacgtctcggctttgatgtcaccgtgttcgaggatctgaccgttccggtcagcgaggagttgggtgtcgcggcccgcaaacagatggccgatgccggcatcatattggcggaggctcgctgagctttcgtcgtgtggcctcccggtatgaaagggaggccacacgatggggcgcatgtcaacggcaagtcggtgtagtggtatcaccggatcaatcgtgcggtcgtgtttccttgagcgcggatttgacggcccatttggtcagcgcgtattgcgcgtagatgctcgccgcgacgatgacggccgagacggccacaccgatgatgttgaccgcggtgtcgcccttgccgagtcgtttcagtgggcaatgcgcggccttgccgcagccctcggattggtacaccagctcgtcggcgtcgccgttgtcgccggcgccgtccggtatgtgttcgttgtaatcactcatgatgttcccgattcatttggccgttgtggccttatggtcacgtacgcaatgtatcaagccaagctggaagaacgctactcattggcgctgccgaagcaacttcgcgatgcggttcaacagacggccatatgctctccgaggggaagagcgtgacgatcagcgccacggaacaggaactcacgacggaacaagccgcgcacactgggagtatcgcgacagacgctggtcagaatgttagataaaggactcattcctttttcccgcccatcacgtcatcgcagaatccgcctgacagacttgctggaatacgaacgggcttcccgcagccgccgtgattcctccatcaggcagatcacgttgattgcgtcgtaattgtcgtacttggggtaatcctcgggcttatagcgtttcacgaggataagttcgtcgtgacgttttctgatgtccagattcgtgaaccacgaggcagcgccgatgcttcgccagttctgccccgattcgtccgtccagaatcacttgtcattctcgctgtgagcctcataatcgcccggcacccgaaactccatgttccccgagtagcagccaagccagattcggttctctttgatgagtgggaacacttccttataggtaacagcgttctgattgccgatgacgacgaacttcttatcatgctccatgagttgagcaatgtactcacggaagaggctaaacggtgggttagtgaccacgatgtccgcttcgtccagcaactccacgcactcgggtgagcggaagtccccattaccctcaaggcatgcaatgtgaagtggcctgatttttgttccgtccttatagtggggcggcttgtgccgcttgatgttgatgatactcggtttccaccgcttcgggtgtcctgtagcccagggactggtgcaggcgcttcgagttccaccacgagacccaccggaacgtcgccaattccaggtccttcagatccgcgaagggtctgcgccgccataccagctcggtcctgtacgcgccgtcggcgctttcggccatggcgttgtcacacgagtcgccgacggtgccggtcgacggcagcaccccatattccataaccccggtggcgtacaccgtgccggtgcactgcgtgccatggtcgccgtggcggataagaccatccgcgccgccgcgggacgcggcccatgagatcgcctgccccaacgcctgcaacggcagctcctgcgtgttcatggtcatggcgcacgcccatcccacgatccgacgggcgtacacgccgtcggcgaacgccgtgcgccgctgattcgtctggggtggctacgagaccgtgtcgtccagcttcatctactcgcgtacctgattctgccgatcgtcggcatcggattcggatacgtcatcaccaatctggcccagatgtcgcttggcaccagcgcgttccacgccggcgtcctcgtgctgccgggcgctctggtcggtgcgttcttcgcgcccgtcggaggcatgctgtacgacaaattcggcccgacgaagccgattctttcggcgatttcggtggccacgttcggaccgatcctgctgctggcattctccatgcggttgacgcctgcgctgctcgccggcttctacttcattttcgggctgtgctatgcgctgggattctccaacatcatgaccagtgcgctgagcggcatcgaccacgcgttcatgccggatggcaatgccgtgttcaataccgcattgcagttcggcggtgccgtcggcaccgcactgttctcgatgattctcggcgtggctcaggcgggcgccggctcggccgaaaaggggagtgccgcgttccgtcacgccacggccgtgggcggcacgtggatgttcgcgacgatgacggcgatctgcctgatcgcgatctgctcgcttgcctgcgcgttccgtatccgtgcgtcgagaacggctgccgagcgctgactcccgctccggggatggttcaggtcagagccatcccaccgccagcagcgcgacgacgtaggcgacgcacgcgactgcgaccattagatcgcgtcggcgcgcgcgcattactctccaatgggtgcggtggatgccttcctcgtagcagcgcgcgtcaagcgccagactgagattatccgcgtgacgcagcgccgccacaaggatcggcacgatgatggcgaacagcgctttgacacgagtggccggcgaaccggtctcgatcgtgccgccgcgggccgattgcgcgtcgatgatcgccttggtctcgtcgctgagcgtcggcaggaaccgcagcgcaagactcatcaccagagccacttcctgcgtgtgccagccgatctttctgaacggcatcagcagggagccgaacgcatccgtcatcgcggtgggggtcgtcgtcgcaaggaacacggcacccaggatgatcaccagcgcgagacggcacgaatacagcaccgcgaccatgagcccgccggtggtgatcggcagcgggccgatatgcgcaagcgtctcgccggagcgggcgaagaacatgttcaccaggcccatcaccgcgaatacgatcaggaacacgcgcacggaagacagcaaacgcagcggatgcagccgggcggccgccacgacgcatgcggtcaggacggcgcccatcgccagctgcgccggcctggtgatgacgaatgcggtgaacatcaacgtcaggaacgtcaccatcttcgcgcgcggatccagggacgctacgaatgacggacggttcctggattcgtcttcaatggactcgatgccggctttgccggcgttcgtggaagactcggtggcgtcgccgacgctggtgtcttcgtcgtctccggtgccgcaaccatcgccttcgccgtcgccattatgcgatcctatggtgatgatgcggtccgcgcagtgctcggcctcgtcgatggaatgcgtgatgatgagcaccgccacgccctgacttttcagggaacccagcagcgcgtggatgcgggagaccgccgattcgtccagactggcggtcggctcgtccatgatgagcacacgagggcggcatgcgatgacgcccgcgatggcgacgagccgctgctgcccgcccgacaggttgaacggagaacggtcggcgagatgctcgatatgcagcatccgcagcgcctcctctacgcgggtggccacctccaactcgctcagatgctggttgcgtgggccgtacgccacatcctcggcgacggtgtcagcgaacagctgacgctccggatgctgcatgacatagccgacgttgcgccgcagggccgcgcgttcttttcgggtgagtgcgcgaggccgtttcccgtgtttcgacgacgcgaccggtaatccggccacggtgatcgatccggcggacgggcggtccaaggcgcacagcagacgtgcgagcgtggtcttgccggcgccgttggcacccatcagcgccacgatttcgccttcggcgacgcgcagagaaagattctcgaaaaccggggcgtcgccatcgtcataacgatatgacaggccggatactgcgatggcgtcggatgctgagcctgtaggtggaatgggtgatgcgtccgacttggtagacgccggttttacgggttgtccggatttcgctggttgcgcgggcgacgcggccgcggtggaacctccgggctcctcagctgccgactccgtggagcctgcagcgtcagtcgcgtcagcgtggctccgcgcaatcacttgcttcgccgcgatcgcttcgacctgcgtgagcagcccgccgtctatgcgaagtacgcggtcggcgtgcatggtctcgtcatgatgatgcgtgaccagcacgatcgtcgtgccacgccgttgcagcatgtcgaggatgcgcatcacctcgatccgcgcgtcgggatccagcatcgcggtcggttcgtcgagcaccagcatgcgcgggttcatcgccagcattccggcgatggcgatacgctgctgctggccgccgctcatgcgcgtcggatccgcgtggcggaaccccgccatatccaccgattgcagggattcgtcgatgcgcccgccgatgtcgtcccgagccacgccgaggttttccgggccgaatgccacatcatcctcgacgatggtggtgacgatctgatcctccggattctggaacaccgtgccgatgccatgccgggcatcgcggtattcgctcggattcgctgaagcggtctcgccgtcgaagacatgatggcccagcagcgtcatatcgccgccgtccggggctgcgagaccggcgatcagacgcgccagagtggatttgccggagccgttggggcccaccagacacagccgctccccgctgcggatggtcaggtcgatgccgtcaagcacccatgtaacgccgttgtcatagctgaatcgcacatgctcaagtcgtgcggcgggaaccatgctgttcatatcatccattcacaaaacatcgtggtcaatccatatcatagcggccattgtcaccgctgacggatgcagcccgccagagaggtcatcacccggactgtcggaaataagcctcgtgcgatgaccctcttggcgggctgccctaggcggcgacttcgcgccgcgtcatgtcagcgattcagcaggttcgaaatcggcttgtacactaggaacgtgaccacgccgtgaatcacgaacttgatcaggttgaacggcagcagcgcgggaacgatgatggccgccacctcggagaccggccagccggtgtagatcggcgtgatgaccagattgccggcgatggccgcgaccaaggccagcagggcaccgacgaccaaaccgatgacagcgcccttgcgcgtgtgcacgtggcgatagatgagcgccgccggcaccgacagcgtcaaggccaccagcacggccatcagcgtgccccacgggtccatgaacacgtgcggtacgaagccgagcacactgacgatcgcggctgcggccgggccgtacgcgaagccggcgatcaggcacacgatgccggacgggtcgtatttgaggaacgagaacgccgggttcggcaggatcgggaacgagatgaagctggtcgccatcgccagcgccacgaacagcgcgtacatggcgatgcggcgggtcgaccagcggccggaatcggcgacgccggtcgaatgcgccaaatccgggcgcgtcggcttggccgcgttcgacgaatcggctgaattgggttgcgaagatacactcatggtgagctccgtttcttccatccggactttgaccgttggctccggattcccaccggatcagccgcttgcgcgggtcgcgggctgccgcggccgccgttatgaatcccggctccgcaggtcaccgccagtaaggaattgcaccttccctgaaacttgcttgaccatgtatacgccggggtgtggatgattgacgtaacgttgcccacatagcgaacatgaggcatccatgcgcgtaggtggccccatccactacgttgtgaccggttttcgcgctgtataccggcgcaattgcccatttcgacacgatttcgttatacaatttcgcgtacagccactatgacgtgcgtgtcgcacaccatccaacaggaggtcatgatgattgataccgctcaagcgtttggcgtggatatcggcggatccggtatcaaggccgctccggtcgacctgaacaagggggagttcgccgagcccaggctgaagatcctcaccccgtccgagtccaccccgcaggcgatcggatcggtgctgcgcaagcagctcgaacatttcgaggttccggagacggttccggtcggcatctctttccctgctccggtcaagcccggccagaagctgaattggatcgccaacctcgaccagtcgtgggtaggcgtcgacatcaccgaggcgctgtccgaggagtgcggccgtccggtcacggtcgtcaatgacgccgatgccgccggcttggcggaacagcagttcggcgcggccaagggtcaggagggtctggtcgtcgtgaccacgctcggtaccggcatcggcacggcgctgatctatgacggcgtgctcatcccgaacaccgagctcggccacatcgagctggagggcggcaagggcgacgccgagcgctacgcatcctccgcggtgcgcgagcgcaaggagctcagctacaagaagtgggccaagcgtctgaccaagtactacagcctgatcgaaaagtacttcagcccctcgctgatcgtcatcggtggtggcgtgagccgcaagagcgacaacttcgtgccgttcatcgacatcgatacgccgatcgtccccgcgaagctgcgcaacgaggccggcatcatcggtgccgcctactacgccagcaccaagtagcgcagaggacacaggcacatacattcgcacgccacaccttggccgaccatcgtcccggcaatgcaggacgcatggtcgcggtagggtagtggcgtgcgtttttcttcccgagtagatctgagcgagcccaatcccatagccgcagccgagacacattgccggcgcgaaggcatgcccctgggcaagctcaacgattccaatcccacacgtcacggacttgcaccggcactggtgccgggcacgtacaccgccgacccgagaggcccgcggcccgcacgggaggcgctggcctccttcctgaccgagcttcaccggggcgccgaaggtgccggcaccgcgccggcggcggatccgaatcgcctctatctgctgagttccacgtcacaggcgtactcgtggctcatgaagctgctgtgtgacgcgggcgatgcggtgctcgcccccaagccggggtatccgctgatcgaatccatcgcccgcctggaatgcgtcgacactatcgaataccagctgcgtttcgacgggtcatggtacatcgacgtcgccgagttgcgcgcgctgctggacgggccgcagggggcgcgtatacgcgctttggtgctcatcaaccccaacaatccgaccgggtcctacgtcaaggcgggggagcgcgagcagctcgtcggcctgtgccgcgagcgcggtgtcgccatcatcgccgacgaggtgttctacgattacgcactggagccgttccccggcaatgcacggctcgccggcgaggcgggggcgctgacgttcgcgttggacgggttctcgaagatgctcgccgcgccccatgccaaggtcggctggattcaggtgtcggggcctgagacggacgttcgcgaggccatgcgtcggctggatgtcatcgccgacgactacctgccgatgagcgacatcatcgcctcccgcatcccggacctgttggaggcggcgaaggtccagaccgacctcgtgcgcggccgggtgcagggcaatctcagggcactgcaccgcatgctggagtccgacctgctcggcgtcgtctccgtgctgcgggccgagggcggctggaacgtgctgctgcgcgtgccgggcgtcatcgacgagaacgagctggtgctgcacatgattgacgcgcatggcgtctccggccagcccggctatttcttcgacatggcctcgaacggctatctggccatatcgctgctgcccgaaccggacgaattcgcgcataacgtgcgcgtcgtgctggactcggtggccgaattgctggggtgattgtcgaaggacgctctcaaaactcgcagatacagattccacgttttctgcgttttggccattttccgccgttttcgcgtaaaagcggaaaacgtatctgcgagttttgagagcgtgctttccgctatcgtgccactttggaccgaatcaggtcctcatagaacgcggccgcggcggcaggttccccgtcgaataccaccgtgtggtcgtcgaccaccagcgcccggtcgatcgcgtactgcggccgtgtgatcatgtccacgtcatgcgtggcgaaaatgacctgcttgttgtagccgaacagcgccttcgccacgtgggccgagccgatctcgtccaggcccttggtgggctcgtccgccacgatcgccgcgggggagaagctcaacgcgctggcgatggcgagcaggtgccgctgctcgctgttgagcgagctggccgactgccgagccacggtgctgagcccgaaatgcgcgaacaggttgccgacgatagccagccgctctgattcgggcaccttgtgctttttcaacggctggtcgatcgcctcgcggatggtcgccgcacggtagtaactgtcggggatctcctcgcggcggacacgcccgacgatgtcctcgatgcgtttgagatcacgcttgacggcggggctgagcgcggtctcgccagcggtgatggagacggatccgctcgtggcggccaatgctccgtcgagcagcttgagcagcgtggtcttgccggcgccgttcagcccgatgaccgccacgcgcctgtcgtcgggtgtgatcgtcagcgatgtgggaagaagcccgacggaaccgtcctcataggtgtgtccggcttggtccagcgtgaaggtcacctgcgatggcaaggcttcgtccttgccgaagagcgagtcaaaaagtcccatgactcctatagtagcggcatcggcgcattcgcatcggcccgcatcgcgaaaaggcccggcggccgccggtacgcggtcgtcgggccttctcgtcatggcctgcgggcgatcgtcttcgcgtcaggcgaagtcgttgtcgaacatgtagatgtagtactggccgtcgggcagcagctggatggtgttgaagtggatccagtcccagctcccggatgcggccggatcggattcatcgatgccggagtggccggtggaagccttgtaatcggggaacatctcgccgaagtcgacgagcttcgtcaccttgccggtgctcgtgttgaccttgatggcctggtcctgcacggcatggtcggatcgtgtcaggtcggtggcgagggagacgatgttgccgtcatcgtcgagcgcgtagtcgtggtggaggatgaaccggtcacccaggtcgatgatcttctccagctttccgaaccggttcatgccgacgaaatgcttggtcgacgcggagaaccacatgagcccgttgtcgtcgaacagtagccggtgcgagcggtcgcacggtaataatgcgcagaggaaacgctatgtgttgtctggcgatttcctgaatcgcatgaatgtcgattatggcgggcggcttatacgtgtcgcggtccggtgccgtccgcgacacgcccgcgggcgtctacagcctgaaccaggcgacgaccgtgtcgtagaggaccggattgttgttgatcagcgagtcgtcgcggcccgggatgaagcaggccagcacagccaggatgatggatgccatcagcgctgccacaaccagtccgcggacgcatgcgagcaccatcgggtgacgcttcgtgacgtctcgccgaggctcgttgcgttccgacggatcgggcgcactggccacgatcgcgtcgccgtcgggatgcatgagatacagcatcggcgccagcgcggcgattgccatcatccacccgaaatcgcagatgtagcgccatcccaggcccgcggtgtggctgtcgaacaccgccagcagcaccgccagggccagggagcacgtggcgagcccccagtaacccgacctgtgcatcctgcgtcgcaggaacggggccgccagcgcgagcagcagcagcgggcatgtcgcgaacaggccgccggccatcagctcgtaatagccccattcgcggaacgctatgggcgtcatgccaatgaaggggaactccgacgtgaaccgcaacggcaggaacaggtaggcgcccaccgacggcaggaaattggccgtcggctgcacgaacctggtcatgtcggtgacggtcatctggtagtcattgccgaaatccagcggcgacccgaaccgggcgacgttgtaggccatcagcggcagcaccacgatcagggcggggatgatgacggcggccggcgctcgcagggcccttcgcgggggcagggagcggcttttcaacccctgcagcagcgaggtgatctgcggccagaagatcgggaagcacagcagcgcggacagcgcgaacgtgggccggcatccgaaattcgccgcgatgcatgccgcgccggcggcgagatagcgcagcgatagtggttgggcgcccgcgaccgaccagctgcccacatggacgtgctccccgcgcccgggatgccgttcgggtgtcgctttgagccacagccacaggccgagcgtcgtgaacatcagggatgcggcgaagggcacggagtagaaattcaggcggaaatgcagataactggcgttcgagccgagcaggaacatcacgatgacgatggacgtggccgccaccgatgcgttcgggcacagacggtgtgtcagccgtatcaccagcaggcatgcgaagacggcgaacaggaacatcatcagcagtatgcacacggacgtgggcagcatcatgccgccgggcgtccatagggacgttatcgcacggaacggcaggaagaacagcaccacgggcaccacgccgaaatacgaataccagtggccgccatagaaggcataatcccagaatatctgcgtcttgccggattcgaacagctgaccgcgcaccaggatgtcatgcgggttcgcagcctgcgccagctcgggggagaccggcagatccagccacacgcggccgttcagcagcgactgcgcgacatggtcgtactggtcgaagtcgtaggtgtagccatgcgggttggggaacaccagcggcccggagacgaggaattcgccgacgatgcgcaccgtggtatagatggccagcggggcgaggaatgccacgagcgcccaccgctgccgtacgctcgcgggattgagccgtatgcgccacaacgcggagccgggtcgccacagcgcgaccagtagcgccaccgcggccatgattgacacgcgcagccaactgaactcgaagggaacccgaacgttagctctgaccgcggagaacgggatacgagagcccacgggctcctcgatccacaggcgaaccgagctgcccggcttcaccttaaggtacagcgagcacggcgccgacgtggagacggaggtgatctcgccggtgcgcgaatcggtgtcggcgcgcacgaacacgttgctcgccgctttgacgtcgccgccttcgggcgtgttcgccgcctcgatgcgcacgtatgacgacgtgccgtccgcactcacttccatgtacgccgacgtcgggtcggtgacggtgaggatgccgtcctcgccgcgtttgagaccgtctcccatgacgttcgtcgccgcggcggaatcggtgctggcaccgagcgtggtccagaacggcatgttgaatgccacgcattcgatcaccaggatcgccagcagcgtcacaagcatggctggcagtgaccgtcgcatgtggtctcgggaaatgatggaagaacgcaccccattattctatcggcttcatgtcgggttggattgaaagaatgtgtgccatgttccgaaacgcttcacacttcccgtcagaaggctctcttggagggctgatctcaggcctgtccggcgcgttgcgacaggtgggggacgccgccgcgtccgtactgggcgggcgtggcgttcgtatggacgaggacgggcagggaccgttcgaggcggcggtgcaggccgcggccgggtccggcaacgacacggatgcgatgatggccgcgctctcgaagcattcggtgagattgacgccgcttatcaagcgccgcgtgtttcccgacctgcccggtgtcccgcgcggtgtggcgctgggatgggcgcagctgacctcgggggagggcgccaccgtctcaatagggctgttcatcgggcatgaccgtttctcgcagatcgcgctcgccgacgggaacgggcgcgtgttcgtgacctccgacccgcatgccgatacgcatgatatgaagccgcggttcatgctcgtcaaggaggaggagctggacgccgtcgacggcgcgagattcggcgcgaaggcgcggccgccgtctgcggtgacgggggcctcgaccggcgagtcggcgggcacggtccgcgcgtttcagggcggcatcgtgggacgggacgccacagggcgcatgacatggcttgcctcgtggctgaagacgggaaaccggtacaccctggagcagatgcgctccccgctgcctgcctcgctgcggcagcgtctggagtaccgtgacgccatctccatcgccttcctcgccgcatacatgctgcccgaaatgcgggggctgctcatcgggttcggatcgggcaacatcttccgtcgcctcaaccgtgaggcgccgatgggtgccatacgccgcagcatacgcgacacgatggaggctcgcgcgcacggcatgcgggcatccggtctggaggatcatttcgccgacctgatgcaagaggccggcgccctcgaccatgcgtccggcctggaggcggtgcacggggccgaaccgctgcacctgtatacgtccagttactccggcgggtatttcttcgcgtgggactccggactggagttccgcgccgcgctgcgctcgctgagaatcgagggcaatctcaaccgtttcgccgcagtgagcgcgtggatcgaacgatccgcccgcaacggcggcgtgaccgaggacacggtcacgcgcgcgcaggccgcgcagatcgatcttgcgctgctggacgatccggcgctgatggcgctgccttgggaagggaaccccgcgatatccggaatcgatttcccgcacgacgacggcgtggcggcgatacgacacgtgtggcggtacgcgggcgagaccgctgaccggatgcttcaagacaatccgaatcccgcgggcgggcggctcggttccgacccaggggcgtcagaatgggtgtaccgtcaggcggtgtcccggctgctgcgccagctgaggctcccgtatcgcttcgacatggaattccgcagcaatctcgaacaggggacgaccgcggtggcgttcaccacggcgggcccctccatgatgccggaaagccgctatgacgagcgcgcccacgattgggtctcgttctcgcagggggaacgggccgccatgagcgccgcgtacaatctccgcgtcgggctcatcatcgcggcactgtgcttcggcgcgagcgaacgggtcgatcaggtgtgcgtgcgcatcgattccatcggtctggaagaggcggtcgccgagcaggacagcgcgatctccgatctgatgagcgcagcgctgcgatcgttcgagcgcctgcacacgggcgatgccggcgcgtccaaggccgatccgaaggacggcgaccatcacggcgatccttcgcatacgccttccgcggagccggcgcctgatgcccgcacaccgcaggcggatgccagaggcgcccaggacgcgaagacggattccgccggtgagtccgtttctgcgaccgtcggggatgatgatctgcagtcgttggagagcttcgccgacatgatgaaggacatcaatttcgaagacttcgtacgggactccccgcaggaagtccaggactccgactccggcgatacgggtcaggcggatgacgccggagcggcccccggcggcgaaggcaacgaagaaggcgacaccgaccccatggatgcgctgcgccgcagccccaccgtgcgaaacctcgtcaccgtaacgttcaccaggcaggagttgctgcagcggctgcgcgaagacgcgttgcggcaccccgccgacacctatcgcctgttcggcgcggtgatggacatcgacgagcggggcggactcgcccccatcagcgccgaattcgacctgcgcgacgcgaggttctccccgacgggctcccaggaggagccggaactgtcggacaaggtcttcccggcgactgtcgccggcatcctcggcacggacaacgccgagggcctgtccatccagcgggcggacctgctgcagcgctgcgtcgacgaattccaccggctcgccgccgacgggaccctggcgtcggtctccaaggcgcagcatgcgatgcatgtcatcgaccgcgtcgccgatccggagctgtccgaattgtcgtcacgcgtcaccagtgcgctcatcgacggtaccgacacaccggacttcaccttccagctggcggacgaactcgaccgggaacgcacgcgggcccgcgacctgctgttctccggtcaggacgatcaggccgtgaccgtcgccgaagcggccatcgaacgtgtggaatcggcttatgccgacaatccgggcgtgccacggtatttcaactcgtatgccgagcgcgtcgtctacaaccgcctgttcgccacggacggcgaacgcacggtgctgatccccgacaacctgttctacgcgcacaccgagctggcggacctgctgtctcagctcaagggcgcgaaggccgcgctgccgcaccttaacgcgatggtggcgtatgctcccgcttacccgttctcgcacatgaagctcgcagtgcagctcgcccgcaacgaggattgggattccgcgcgcgcggcatgcctgaacgcgctgcgcgtggcgctcgaccgtgatgacgccgcattcgcctactaccggctggcatacgcggaatggatgcgcgaccgtttcgatatcgccgccgcggcctacatcatgagcgagcacatcgcaccggggcagatcggggcgcttgacggcgagctgagggaactgctcgcacgcgccgaatcccaatgcatagcggtgcctaccgacgtggagtcggcagccggcgtgctgcgcatgcacgatctgccggtgtggccccacacccaggtcgccgcgatcgtgcgcgacgccgcccgcgtgtgcgtggacgagggcatgttcgttcccgcacggacgctgtcgatggcggccgcccgtatgaacgacggcgacaacggcggtgtcgacatggtgcagtcccagttcctgagatcgctcaactcctgatgccgtggcgcgggcgtcgccgaggcgggttcatgttttcgattacaatcgaatccagatgaattcgcacatacgaaggggaagtgatggctcgcgcagcggtttcgcaatcatccggcgaccagttggcttgggatttcgacgatccggacgccggggaggctccggcgccggtcgagaacgaaggcgcatcccggttcgcgcccggctcatcccagtgggtcgccgcgctgcagtccacggacgctgatgcggcccggctggatcggctggatgtgtcctcgctgtcgaacgaggttgcagcccgcctgtgggcacgcgtcgcggcgtgggtcgaggccgaccagatcgcctattacatcgatgacgcgccggtctcgtccgacgcggcctacgatgcacgcttgcgttgcctgcaacggctggaggcggagttcccgtcgttggattcaccgcaatctcccacgcaccgggtcggcggcacgttctccaatgatttcgcttcggtgcggcatccgtcgcgcatgatgagccttgacgacgtgttctcgatcgaggagctgcgcgattggtacgattcggtgctgcgtgatttggactggcctgagggcaagccgttgccgatgacctgcgaggtgaagatagacggtctggcattgaatctgatataccgcaacggcgtgctggaacaggggctgacgcgtggcgacggcgtcaccggtgaggacatcacgctcaatgtgcgcacgatcggctccattcccgccaatctcggcgggccggccgcggatatccccgagttcgtggagatccgcggcgaggtgttcatgcgttgggacgatttcaaggcgctcaacggtgaacaggaggatgccgggcgccctccgttcgccaacccgcgcaatgcggcggccggatcgctcaggcagaaggatccgcgcatcaccgccacaaggcggctgagcttttacgcgcatggcatcggtacgctgcgctggggctcggggcggcccgccggctcgcatgacgtcgtcgccgaccagtccgaggcgtacgcgctgtactccaagtggggagtgccggtgtcgccgcacaaccgtgaggtcacgtcgttcgcgcagatcctcgacatgatcgactattacggcgagcaccgcggcgacatcgagcacgcgctcgacggcatcgtcgtcaaggtcgacgatctcggcctgcagaggtcgctgggcgcgacctcgcgggcgccgcgttgggccatcgcctacaagtacccgcccgaggaggtcaacaccgaactgctggacatcaccgtgcaggtcgggcgtaccgggcgcgtcacgcccgtcgccgtgctcaagcccgtgtatgtagcggggtccacggtgtctcgcacgacattgcacaatccgttcgaggtcaagcgcaagggggtgctgatcggcgacacggtggtggtgcgcaaggccggcgacgtgattcccgagctggtcgggccggtcgtggaacgccgcaaggggcgtgaagacgacctgcgcgaattcgtcatgccggatcgttgcccgtcctgcggatcgaagctcgcaccggccaaggagggagacaaggacattcgctgcccgaacgtggaatcctgccccgcccagctgaccgagcgcatcatcaacctggcttcgcgcaaggcgttcgacatcgagcatctgggcgaccagtcggccatcgcgctgaccaacccagaggagaaccggccggattcgccggatacgttcgctccgaacatcaccgagattctcgtcaagcccggcgaggagccggagccgtacgagcccgtggagggactgcggctgccggaacggcagaagccagtgctgtcgagcgaagcggggttgttcacactggacgccgcggcgctcagggatgtgcgcgtgtggcgtgaggccgcgatcatcgagatccatgagacggtcacggctgacggcaagaccaagcgcactcgcaaacgcatcggtggctcgggcctatggcatcaggtcccggcgttctggaccgcgcccacgccggcgaagaagctttccgcgcgacggcaggctgcggccggcgcgccggccgacgctgcggctgagccgtatccgggatatgacgtgccggccgatgcggtggtcgtgcgcgtcgatcggaagaccacgcgcaacggcacggtcgacgtccccgtgtacgtccgccccggcgagaacacgcgcaagatgttcgacgagatggacaaggcccggcacgccgacctgtggcgggtgctggtcgccttgtcgatacgtcgtctcggcccgcccacggcccgtctgatcgcctccgccttcggctcgctggaggccatcgagcaggcgggcgtggacgagctgtcggccattgacggcatcggcccggaaatcgccgaatcggtggtcaattggttcgccgccgcccgtgagccgagggattggcggggcgagacgctgcgcgcctggcaggcggccggcgtcggggtcgccgccgccgagaccagcacgctgccgcagacgcttgccggaaagaccgtcgtcgtgactggttctctggagggattctcgcgtgattccgccaaggaggccatcatcgagcgcggcggcaaggctgccggctcggtcagcaagaaaaccgattgggtcgtcgtcggcgaaaacgccggctccaaggccgccaaggccgaagaacttggcatccccatgcttgacgaagcccaattccgcaccctcttggaaaccggcgccgtgcaatagactgccgccccctctccgctgacggagggctgtcgcggagcgactggggtggtccatgcctataaacccacccctcagtctcgcttcgcgagtcagcttccgccggcgggagcaagtacccgccccgcgctttgcggcccatttcacagggtggatttcacgccgcctctggcacgccgtcgattcacacgctagtctggtacgcggcaataaggaggataggatacatgacagacgcacgccacatcgaggcgcagatctacgaacggctcagcaaagtcatcgacccggagctcggacgctccatcaccgatctggggatgatcgccgcaatcaacgcggtgggcgtcacctcccagggcgacatgccgtcatatgacgtgaccgtgcatgtggaacttacggtcgagggctgtccgctgtcgcagaccatcaccaatcagatcaacggcgcaatcgtctcatatcccgacgcgaagctcaccccgcacatcgaggtctcatccatgagccatgacaagctcgccgacctggtggcgggtctcaaggcggagcgcaagcagaatccgttcaacaaaccgggcgtcaagacgcgcatcttcgcgatcgcctccggcaagggcggcgtcggcaaatcatcggtgagcgccaatctggcggcgaccttcgcggcgctcgggtacgacaccgcggccatcgacgcggacatctacggtttttcgctgccgaagctgttcggcgtgcacacgcagccgacgaacctcaacggcatgctgatgccggtgaccgcatggggtgtcaagctgatttcgattggcatgttcgccggtgccgaccgtgcgattctgtggcgcgggcctcgtctgcagcgttcgctggaacagttcctgtcggacgtgtggtggggggatccggacgtgctgctgctcgaccttgccccgggcaccggcgacatggcgatttcggtggctcaggcgttgccgaacgcggaactcgtcgtcgtcaccactccgcagccgtcggcttcggatgtggcggtgcgctccggtctggtcgcattgcaggtgccgatgaaagtacgtggcgtggtcgagaacatgagctggtatgagcataagggcgagcgactggagatcttcggcgcgggcggcggtcggcgtgtgtccgatcaactgaccgagacgcttggctatgacgtgcctctactcgcccagctgccgctcgaccccgatttgcgtgaggtgggtgagtccggccgtccggcggttctgaacgaggacggcgcactgcgctcggatgccctggggcgcacgttccgggagcttgccgagggtcttcttcgcagcgaatgattctcaataagaaaggtgcgaggattgcgcacaaatacgcacagtcgcacattcctgggagtggcggaatagagccgtttctgcatatttcgtgtgcgtttggccggcagtcggactcgcacctttcttattgagaaccgttcgctgcgagccagtagtgcaaataacgctgccggttgacgatgtcccgcaccatctcgatgaaggcccgccttgattcctccgtccgcaggtcatccgcggtgaccatgatgatggtccagccattgtgctgcagctcgttgaaccgcgcggcgtccttgcgcatctgctcggggctcgcatgatatgcgccctgatattcgaatcccaccttgcagtcggggtaggccatatcgatcagtctggttccgtgcctaagcctcactcggtaattcgcatacggcctgccgagccccgaatccaagagaatgccgaaaagaggtgtttcgggtggtgaatccgtgtcctcgacgatgtacgggagcgcctcctcgcattttctcttccccgcgaaacgggggctcgcgtcgagatatgcggcgaagtcgtctttcctggccttcttcctgcgttcctcgcggctggcaaacgccgaggctatcgtcgccagggcttccgtgtcgcagtaggttgccatctgcgcccatgccatggcgggggaggccatccagaaccgttcatattcgtatttgcagtattcctcctttccggagaacacatggaatgtgactccggcgatgtgattgcgatcctgtgcgcgaggcacgctgacatggacgcgattcgacgccagatcggttttcggcacgggagctccccagtatcgtatggcgttgatatatccgaccctgagcggtctcttggtgcgcatggcggcttcattgcagcgtttgcgttcgttccgccgcccgttgactatatccgtgttcatgaatcccatggggcaacggtatggaatggaatgtgccgatggcaagcgatttcggggtatgtggtcgaaggctaggcatttttggcatgtcttcggcgtgttatccacattccatgtatcagcgaacggttctcattaagaaaggtgcgagtcggttctgcaggcaaacgaacatgaaattgatgggaacggcgttattccgccgatatgagaaatgtgcgattgtgcgtatctgtgcgcaatcctcgcacctttcttaatgagaatgattcgctgatacatcggggggggggaaaaaaagagaaggagggagaaaaagatgaggaggggaagagagaggaagagataatgaaaaagcccctcggcactcgccaaggggcttttccatgagcatctatcagatgtggaagtacagctcgtactccagcggggtcggggccaggcgagcctggtcgatttcgccgcgcttgaggtcaagccaggtctcgatcagatcgtcggtgaacacgtcgccggcggtcaggaagtcgtggtcctcttccagggcgttcagggccgcgtcgagggagcccggcacctgcttgatgttggcgtgctcttcgggcggcagctcgtagagatccttgtcgaccggctccgggggctcgatgtggttcaggataccgtcgaggcctgccatcatctgggcggagaaggcgaggaacgggttgcaggacggatccggtgcacggaactcgatgcgcttggaagcgggggaggttccggccagcgggatacggatggcggcggaacggttacgggcggagtagaccagcgaaaccggagcttcgaagcccggcaccagacggtggtaagagttcagcgacgggttcgtgaacgcgaccactgcggaggagtgcttgatcagaccgccgatgtaccagcgggcgatgttggacaggccgccgtagccctgctcgtcgtagaacagcggcttgccgtccttccacagggactggtggcagtgcatgccggtaccgttgtcgcctgcgatcggcttgggcatgaaggtcacggccttgccggcgagcgctgcggtctcgtggacgacgtacttgtacttcatcaggtcgtcgccagcgtgctgcagggtgttgaagcggtagttgatctcctgctgaccggcgccggccacctcgtggtgggagcgctccagctgcaggccgaccttctgcaggttggcgaccatgtcgtcgcgcaggtcctggtagtggtcgcacggcggaaccgggaagtagcccttcttgatgcggttcttgaagccgatgttcggggtgccgtcctcttcggtgtcgacgccggagttccacggagcctcaatggtgtcgacctcgtagaaggagcgctgcatggagttctcgtagcgcaccttgtcgaagatgaagaactcggcttcgggagcgaaggaagcggtgtcggcgatgccggtggacttcaggtaggcttcggccttgccggcgacctggcgcgggtcgcgggagtacggctcgtcggtcagcgggtcgacgatggagaaggccacgtcgagggtcttgtgcttgcggaacgggtcgacgaaggcggtcgtgacatccgggatcagcttcatgtcggactcgttgatggcctggaaaccctgcacggacgaaccatcgaacggcatgccgtcggtgaaggcgttgtcaatgaattcgctggccgggacggtgaagtgctgctgaacgccgatcagatcggtgaaacgcacggagacgtactcgatgccttccttgttgatcagtgcttcgacctcttcaggcgtgtgggcgaaaatcttattctctgccacaatcgctcctttgttcttgagaacttgtttgagaacttacaatcgacaagtctagaaatgtgagtttcacgcgctcgtcaattgggttacgattatgtttcgagatgggcaacaggcggtgtaatccgcgtttttccaatgttttgggatttatgaaattcgtcgcgtctcagtgtcgcgtttcaagtagtggacggtctgacggttgtcggtcgggacccggccggatatgggaaagcccccgcggcgatgtcccgcgggggctttcccgatgtatgaatgatgccggttcggcgtgaggttgcccgccgaagatcagcggcctcgcatcgcgcggcggctgacgtgctgcatgcgcgtgggatcgatgcccttggggatgcccatgccgttcttggtctgcaatgtgcgcagacgggcgttcagtttctccagctcggccttggtgaggatgaaacgctcgcgcgggtggatcttcgccaggagagcgttcttgtggtgcgtcgggcggtacgccttgcggcggatgatgttgctacgcagcttcttcagcggcacctgaccctggccgttgccgaccatcacacggtacacggggatctgcgagccggcggtgacgctcttgatggactgctcctggcggtccatcgcgcgcttgacgcgatcgtaatcgccttcaccgagcaggtagatgccgttgtatccggtgccgcgccaaatggcgtccttggtgcgcggatccacccacaccggctgctcggggaagttgaagccggccttgttgatgttgcgcagcacgctgatggccgcgccggtcttgccgtcgagctgcttgtatccgaccatgtcggcgcggcgggtgagcacgatggtcgacagcagcatgccgagcatgatggcgatgagcatgaggaacacccacgtcagcaccgtccaacggaatatgatgccgaggatgacgaacacgatcacgggcacgaggaacgcgccggcgatcagcgccggaagcatcttgtcttccttgtgcgtgtacttgaagatcgttatgatctgtttgatcgtgccctgcttcttgggcttcgtctgcttggtcttctcgtccttgcctgccatcaacttcctcgcttggtctagggtgaacacactgagcgacaagtttaccagcagatgtgcccttctgccgaccatgagccgccgcgtcgctcgtttcgtggtgtctttatcgggtgtgcagcggccggtcgtcggctttgagcagcgtctcgcccagcgtctcgctgaaggtgggatggggatggatgagacgcgcggcgtcggaaagcggggtgtggttgccgacgagctgttccgcttccgcgatgatgtcggatgcgacgggcgcgaccatgtgcacgccgagcacgaccctgacgccgggctgttgcgcacggatgccgctgacgagcgacagagatccgccggagtcgctcatcatcatgcgggcgttggacatcatcgggtacacggtctccttgatatcggagaggtcgttgcgctgtttcgcgtcggtcgcggtcagtccgacgctggcggcctcggggttcgagaacacgatctgcgggatggtgtcctcatcgagcggctttgggtcgagtccggcgatggattccgcggcgatgatgccctgctcgaacgcgcggtgagcgagcgcgtgcccttcggtgatgtcgccgacggcccatatgcctgcgaccggcgtgcggccgtatccgtcggtcgtgatgaatccatggtcgtcgacggtcacgccggcgtcacgtatccaaccgtcggaggtcagcggatcccgcccgatcgcgacgagcacgaattcgccttcggcgatgtgctcggtggagccgccgtccttggcgctggtgtagtgcacgagggctcccatgttgacgccggtgtcgatgtgggtcaccgtcgagcggtcgatgacgtcgatgccgtgtcgtttgagctcacgcgtcagggtcacgccggcgcggcgatcccatccagagagcacacggtccttgcggataagcatcgtgaccttgcatccggcggcgttccacatggaggcgaattcggcggcgatcgcgcccgcgccgatgatgaccgcgttgtgcggcatcgccatcgacatcgcccgcgtcgaatcgatgatcgcgccacggaacggctcgccgggcagctgccgcgggacggatcccatggcgagcaccacatcctgagcggtgatgtcgaaggacgggccgatgtcttccggcacgtccgagcgcacggaccgttgcacgtcctgcccgtcagcaggtgcggcgatgtgcacggtgatgggacgtgccgcgccggtgatcgaggcggcgccccggaacacggtgacgccccgatgggcgagcagacctgccagcccttgcgtcatcgtgtcgacgatgcgcttcttgtaatcgtgcagcgtcccgtagtcgatgccgttgatggtggcggagatgcccagttcgccggcgtgccggatggagtcgattgcgtgggtggcgctgatcagcgccttcgacgggatgcacccgcggttgaggcaggttccgccgagcgttgcgtcgcgttcgatcatggccacgcgtttgccgagctcggccgcccgcaatgctgtggaatatccgccgggtccaccgccgattatcgcgatgtcaaaagcttcactcatgttcgactcctttgtgctcgtaccaaaaccatccccatcgtaataccttacgcccgccggcgggctgagctgtggagcaaatagcagggctgttcgtaggccaagagcgagcaaggtgggtgctgtcttgccctcgctggcggcggggctgtcgggcgcagcgagactggggtggtttcacgcagcctagggcatacaaaaaacggcgctcccactatcgggagcgccgtcaggaaagcagcagggaggctgtcacttcggccagttgccgtgcttggggctgcgcggtttgggcagacgccagcggcgcacctgaatcgcgcggctccaggcatacgatgcggagcgcgagcccttggcaacggatgcctcgccatacttctcgatgagcttcttcttcagcttgcgccacatgacagccacgtcgatgatcacggcaatcaggtacacgtacagcagaatcatcatcgggaccgacagctgcggcgcgatggtggtgacgagaatcgagccgagcagcatgatgaacgcaaccgggatgaagaactcgccgaggttgcggcgcgcgtcgacgtagtcgcggatgtacacgcgccacggcaaccgttcggccttcggcatgcggttgatgtcgccggtgcgcatcgcctcgtactcttcgtcctcgcgcttgcggatccgctccttcgcggccttggcgctggccttgcggtccggcggcaccagaggacgcaggttacgcgcctgcgcctgcttcatcttgggggtcggacggcctttcccgacggtcttggcgggcgattcctcttcgaccggctcctgggccttgtccttcttgaaagggttccatgtcataatccgtcagaatacggccacgcctcgacgctggaaagccggatgaaccggttacaatggcagctgatatgaccatctgttccaggccggccggttcgtgcaggcgggatggatgatgacgaacgcaacagtaaggagcatcatgaccgcagtgttttccgacgagctgcgcgcgcgggtcgaagccgatttcggccgcgtcgtcgatctgctgagccgtaaggtcgcgctgaagtcgatttccgccgagggcatcaccgccgagcatatgaagcggtccgccgaattcgtagcggacgagctgcgccaggtcggcatcgacgcgaaggtcgtccaatcgcgcaacccggatggcacgcccggtgcatgggaggtcatcggctcgaagatcgtcgacccgcaggcccccaccgtgctgctgtacgcgcaccacgacgtgcagcctgtgccggatccgtccgcatgggacactgacccgttcgtcgccaccgaggtcggcacgcgcctgtacggccgcggctcggcggatgacggcggcggcatagcgattcactcgggcgcgatgaaggcgctcggcgacgatctcaaggtcaacatcaaggtgttcgtcgagggcgaggaggagatgggctcgccgagcttcatcccgttcatcgaggatcatcgcgacgagttcgcgtccgacgtgatcgtcgtggccgactcgggcaactggtccgccgatattccgtcgctgaccacgtcgctgcgcggcaacacctgtgtggacgtgaacgtcaaggtgctgcaccatccggtgcactccggccagtacggcggccccatcctcgatgcgaacacgctcgccgcgatgctcatcgcctcgatgtacgacgccaacggcgaccttgctgtgccgggcgtggccgcgcaggagccggtcggtggcctgcagcgcgaccttgacgaggccaccgtgcgcgaggacgccggcatcgtcgactcctatcgtctcgccggcaccggttcgctcgcttccaggctgtggaccaagccgagcgtgaccgtgatcggcttcgacgcgcatccggtcgagggctcattcaacgtggtcagtcccgagaccacgttccgcctgtccctgcgcaccgcgccgagccagcacccgcaggaggcgcaggacgcgcttgccgcgttcctgcaggcacacgccccgttcggcgccgaggtgaaggtcaccaagttggagaacggcatgggctgggcgatggacccgaacgcggtcgccaccaaggatgcactcgcggccatggaggaggcgttcggcgtggcgccgatcaacaagggcgagggtggctcgatcccgttcatccctgagctgcagcgcatcttcccgtccgcgcaggtgctcgtcaccggcccggaggatccgaaggccaacgcacacagccccaacgagtcgatctcgctgcccggcttgaagaacaacatcctcgcggaggccctgctgctcgccaagctcggcgagtaaggccggcggctgcctccgtttccccgggaacaggttgggtggcatacccgaaacgggtatgccaccggtgtgctgcgacgatgcggtgccctccgttccggtagccggcggcggttttcggttgcccgccgtggctcttttggtggtgcgatgaaaaataaagggaatgaacacatactccgaaccggatcatttgaccggctattgcgccgatgccagagtcgccatcgtcgacaatgacgagcgcgccttggagtctgtagtctcgctgtttgctgatcgcctacctcaaacgatgttatctggtcgacgactgaggggttgagggcaatcaaatcatgcaaggagcatgagctcaagccggatctgctgcttcttgatatgtcatcggaaggcatccaggggccttcggtatgtcgtggcatccgtagattcgatgggagggcctgctatgaatggacttcatagcatcatatgaggggtgaacgggatcatcgaaccaaaggcggtcgaggatgaaaaaacggcgtaatcgcggcaaaaacggcaaaacagtcggcaatggcagcatctccaagacccgcaatagcggacgtatatctgtgatatggctgctgctggccgtggtggtcgcggtgtcgctgacggtcggggcatgcgctttgtggctgcccgaccgggcacccgcactgctcggctccgccaaggagatcacgagcgcgccggccggagtgcaggagtacacgggagccacccaggtcaccatgattcccacggtctctcagacgcgcgaactggtcggcaacgcctccggcacagtgacggaggacatgtcatcgcagggattgacctctggcaagaccgcgatgaaggtcaacggagtctcggtggtggcactggcgacagccacgccgatgtaccgcgacctcgccaccggggacaaaggcgacgacgtgctcgcactcaacaacgaactcgcacgcctcggactgccggcctcggcgaaatccaccacatatacatggaacacgtctcaaggagtgaagcagctcatgagcgccgccggcaacacgtcggacggttcattgccgctgaccgacgtgctgtggatacctgccgcgagcgtgcgggtcggcgaatgggccggcactgtcggggcgaccgtggccgggggaagcgtcgttgggaaggtgcccggcagtgtcacgaaattctccatccagaacgggcagccgtcggaactcgaccggacggtcaccctgatcgggcagaccgccacgctgaaagccggcaccaccgaagtggatgacgccgagttctgcgccagagtcgccgccacacaggaattccagtcactcaccagcgacatgctcgccacaggtctggaagccagcgtgcagcttgtgaatccggtgcaggcgctgcgcgtgccggccgcgtcggtgatcggcgtcaacggcagcaaggggtgcatcgtctcgggtggcaggaccatcaaggtgtcaattgtcggatccgagctcggggcgagtctcgtcgagccccaaggcgccgatgccgcggctatcacctcggttgagataggcagtggtttgaccggcgaaagctgccgatgatgacgggggaagatgtatacgccggtgccggagtcggtgccgcgccgcagccggagcgatcggtgagcgtacatgatttggcgcataggttccccggaacggacgtgttgttcgaacatctggatttcacagcgatacccggccagaccgtggcgatatgcgggccatccggatgcggcaagtcgacgctgctgtcgattcttgccggatgggagaagccgtaccatggcacggtggaacgcaagaacgtggaacgtgtaggctgggtgtttcagaacccgtacggcgtgcccgggcgaacggctctggaccatgtcgtgttcccgctgctggccaaggggctgcgccggcgcgaagcggagccgcaggcgttggaggccatggggctgttcgacttggagtatgcggccgaccggcggttcagcgaactgtcgggcggcgaggcgcagcggctcatgctggcccgtgcagtatgctccagacctgacatgctgctcgtggacgagccgactgcacaattggatacgcgcaccgcgcactcggtgagccacgtgctcgggaacctggccggacagggcatgatcgtgctggtcgccacccatgacccggacacgcgcgacgcctgcggtcgcgtcatcgacctggccgactacgcccccggcgataacgaggactccggttttgcccccgctggcggaaacgaacccgctgagcctaccgattccgcccccgctggcgggggctcccgcgaagcgggtgggggtggtcccaccgactcaactgacatcgccgaaaatggatcggaggtgcgctcatgagactgggatccatcatctcggagacgctgcgcaacatcgcctcgggcaccgcgcatgctctcgccatgttcctcgccgtgctgttcgccggcgccctgctcggaggatacgaggcgatgtcggtcatgaggttggaaaccgaagccgcggtgcgcatccgcgcattcgccgacgtgaaaaccgtggtcggcggcaatgtcgacggactcgcctgcgaccggctctccgaccatgacgacccgtcgttcatttccggggcgatgcggtccggcccgcaggtcgtgccgctggcaacgaatggcatcgaactgtcatcatatgaggtgaccgcgggcatgatacggctcatcaccgccgaagacccgcaggaggttccggactcgtccggcgtgtgggtgtcatccgacgtctcccatgatttcggtctcgtcaagggcagccgcatgcagacgaatcatggcacggtcaccgtggcgggcgtgttcgattggccgaatgacggcagggacatgcggttcgcctatgcgatgatcgcaccggcggcatcgagcggcggcgtgttccaggaatgctgggcaaagcagtggccgcaaagcgaccagatggacgagctgctgctgtccaccgccacgaagaacccgaaatcggagatgcgtcccggtgtgaccgctcttaacaagggggtcgatgcgcattatgacgcgcagaagggctatctgacccgtgtgacccgttggatgccgtatcttggactggcggtcggcctgctgctaggcgtgatttcggtacgccgccgccggctcgaatatgcaggcgcgttgcactcgggcgaatctaagggtgcgcagctgctcggtatcgaactggaatcactgatctgggcaggagccggcacgctcgcgacatgcgcgctgctctccgcgtatgcgctgcgcatgtcgcagtccgaccctcttgccgtgttgctggccgccgttcgtacgccgctcgtgttgctggccggagtgctcgtctcctcgctgttgacgggatcggtgatccgacagacgcagctgttccgctacttcaagaaccggtagcgcctaatcccgtgtcacttcgccagtcccatctggtatttcagggtcattacgcgcgttgcggaggccgtcaccttcttcgcgaaggccgggtcggactgcgcacgggcgatgataccgtcaagaatcggcgtcacatatgacgtatcgcctatgcacgccaaatcgccgccggcgtccaccagacgcacgcccaggtccttggtcgctatgccgctgaccgccgcggccgaaagggagtctgagatcaccacgccgtcatagccgacgctgccgcgcagcgtgccgtcgatgatcttgctggagaacgcggcgggcgccgacgagtcgatgcgctggtaggtcgccagcgacatcatcaccatagccggcttcgcctgcttgatcgtggtgttgaacgcgcctatctgctcgccatcaagcgtggtcgtggtgtcgaggatgccttcggtcgtgaaatcggtattgccggtcaccgcgcccaaaccggggtagtgcttgacggtcgcgccgacgcccgcgtcgcgcatgccttcgatgaacgcgatgccgtgctgcgcgtttccgttggaatccaaaccgaaatcgcggttcagcgcgccaatcggagcgttcgaggaacgcttgacctgcaccgtccccaataccggggccaggtcgatgttgatgccggcttgcttgagctggccgccccaggtctttgcggaggagcgcagcgtgtcagcgctcatctggccctgcgccaccgcggacggcatcgtgtcgaatccactgcccttgagatgctgcacctggccgccttcctgatcggtggagacgatcagctggttgccgctcggagcatagctttgcagcgcgtcagcggcggtcttggctgcggctgtgccgttgttccagttgccgatgagcaccacggaaccgacatggcgtgtgctgatgagggcgctgagatcggccggattgccgcctgcgaacatcggtgccatgatgagctgcccggcccgttcatcgagactcatcgtggcgatggcgcggctcgccttggccgcgggggagtcatcggctgccttctgatgctcctgagatttcggtgtgggggccttgtcgcggttcagcgtcgaagaggaggactgtggctgcgcgagatgttcgagcgcgtctttttgctgggggcgcagcatccaccatgccgtgcctgccgccacaagggccaccacgcagagcatggccgcgatgatggtgggggctgaactggggcgcggccttctgccgccgtgtttgatctgctgcatcctcatatgcactagcgtaggccatcatgtgtagtggttgtgagacggttgtgcgacggctgtgttctcagctcagagcatgaccagctttcctagcctttcgataggcttgtatcatgtctttttttgatatgttgggtatgttcgatcccggcgacgggccacgcgggccacgtcgggactccggtgcgaccgatgacgatccggtgatcgtcgacgtgcaggcggatggcgacgatcatggcgagacgccatccgccggcaagggggagccgccgaagcgcggcgtgccgaggctcacgccccgaccgttgccgaacgggcccagcaaggggacgaagattctgatcggcgtcgtgctggcgctggttgtcgtcgtcggcctgttcttcggcctgtcgcagttcatcacggacctgatgtggtacggacagctcggttttcagaacgtggtgtggacccagctgggtgtcaagttcggcctgtgggcggcgtatgcgttgctgatggccttggtcagctatgtgtccgcttggctggctatccgcgctcgccccgattcgtccgacggctcgacgttccgcatcaaggatgacgtcatcgaagtgggcaagtcgttcagttccaagaccgcgcgtcgcgccgccgtggtcgtgtcgctggtcgtgggcgtgatgttcggctcgcagttcaactcgaactggtctgagatcctgctgatgttcaacgcgcagagcttcggcactgccgatccgcagttcggcatcgacaacgggttctatgtgtttgtgctgcccggtttgcggctggtgatgtcggccgtatcgatgctgctgctgatgggcattgtgttctccgtcgtcacgcatgcgatgatgggcggcatccgcttcaccatgccggtgcatggtcgcggagtgctcgctgtgaccaagcgcgcccgtcgccagatcggcatctggctgatcctcaacatgctggcctggtccgcgcgccaggtgatcggcgtgttcacgcatctgacccagcagggcgaccgcatcaccggcgccgcatacaccaccgtgcacgcgaccattccggtcacgttcatcatggcggccattaccgcggtgctcggtgtgttcctcggcgtgtggctgatgcactcccatgcgttggaaggcgccgccaagccgagtgtccgcgccgccgcggctctcaaggcgtggcgtacgccggtgattgcgatcgccgccgcgctggtcgtctcgctggtgctcaccgtcgcatggccgatgctgttgcaacggttcaaggtgaacccgaacgcgcaggagatggaatccacctatatccagcgcaacatcaacgccacgcagcaggcgtacgggctcgacaaggtgaaggtcgaacagtacaaggccaccaccaagggcaagtccggagcgctgtcgtccgaggccgaatccaccgcgcagatccgactgctcgacccacaggtcgtcagccccacgttcaagcagctgcagcagtcgaagcagtactacacgttcgccgacacgctggccgtcgacaagtacgacatcgacggcgtcagccaggacacggtgatcgccgcccgagaactggatctggaaggcaacgacaaccgcaactgggtcaacgaccacaccgtgtatacgcatgggtacggtgtcgtggccgcatacggcaacaaggtggcggcggacgggcagccgcagttcttcgaatccagcatccccacccagggcaagctcaccgaatcgcagaagtacgagccgcgcatctacttctccccgaacgcccccgaatactcgattgtcggggctccgaagggcatggattcgtgggagttcgactatccgaccggatcgcagggcgcgaccaatacgtttgacggcgatggcggcccctcggtgggcaacatcttctcgcggcttttatacgcggtccggttcggatccgatcagatcctgttctccgaccgtgtcacctccgactcgcagatcctgtacgaccgttcccccaaggagcgcgtcgccaaggtcgccccgtacctgacgctggacggccgcgtgtacccggcggtggtggacggacgggtcaagtggatcgtcgacggctacaccacgtcggatgcctacccgtattcgcagatgaccgatctgggaagcgtcacgcaggattccaccaccaagacgtcgaacacgatccaggcgttgggttcgcagaaggccaactacatccgcaactcggtcaaggcgaccgtcgatgcgtacgatggctccgtcgaactgtacgcctgggatgccaacgatccggtgctcaaggcatgggagaagatcttccccggacagtaccacccgatctccgagatatccggcgacctgatgagccacctgcgttacccggagaacctgttcaaggtacagcgcgagctgctcgcgaaataccatgtgtcgtccgcaggccagttcttctccggcgaggatttctggcagacgccggtggatcccaccgaatcggccacggcgcagcagcagggcgttccgcagcccccgtattacctgtcattgcagaccggcgggtcgaagaagccggtgttctcgctgacctcctcgtacatccccgccggcacgtccacgcgagaaatcctcaccggcttcctgtcggtggattccgacgcgggcaacgaaaagggcgtaatcgggccgaactacggcacgatacgattgcaggagctgcccaaggactccaacgttcccggaccggggcaggcgcagaacaacttcaacgcgaacgcggacgtgtcgaaggagttgaacctgctcgaatccggttccaccaaggtcaaccgaggcaacctgctgacactgccgctgggtggcggtctggtgtatgtgcagccggtgtacgtgcagtccagcggatcgaccagcttcccgctgctcaagaaggtgctggtggcgttcggcgaccaggtcggattcgccgatacgctcgacgaggcgctcgaccaggtgttcggcggcaattcgggtgcgtccgcgggcgatgccgagaattccggcaacacgtctcaaagcggtgacgggcagaacagtggcgggcagaacggcactgaatccggtgatggcagcgagagcaacggcaacgcgaatggcagtggtacgaacgagggcaaggaccagaacggttcctcctcgcagggcggcagccaaagccccgagcttcagcaagcgctgaaggatgcggcccaagcgatgaaggactcccagtccgccatgaagaacggcgactggaccgcctacggtgaagcccagaagcaactggaagaagccctcaacaaggccatcgaactcgacggtggcaagtaagagccaaaccagaaaaccccagtactgtgaacgcccccacgccgggggcgttcactatttcttgccccgctggcgggggctgtcatgcacagcatgactggggtggttctcggcccagaacggcccccagccatgctctacccacctgaccatctgattcgctcccagcccgtgtgccacactaggcgaaaaacaccccaaaatcgcatggtgtggtacagcagaaggccacaccatgcgatgtgagccttcacatcatgtggtgtggcagaatgcgagtcgtgaaaaccgccattttccaatgatcggtggatgagcccggaatcacccttggccacaccagccccaaaaccctcaaaaatcgcatggtgtggtacaggcgagggctagatggcagtcggtcggtaaccatccccacaccttctctcgcggaagtcccatccggcggtcttcaaacggaactttcgcgggagggagggagctgactagtgggaaaggggaacctgactagcgggcggcgatgagatcgaatacgtgctcgactacgcgcgccgtgcaggagccgtgctcggggatggccacgttgcgacggatgaacgcctgataggcggcatggtcgaaatcgtcgtgctcgatggctctcacgatcgcctcggcatcatccgtgaacagcgtcgggatatcgcgcttcgggtcgatgtacaggctgcgtttcttcgaatagtccggccagtcgtacgcatagaggaacaccggcaggtcaagcagtccggcctcatagatcacggtcgaatagtcgctgatgacgtaatcggcgacgaacagcatgtcgtactggctcggatagtgctggaatacgtgcggattgttgatacgcaggtcgtccaacggatggcatttcacgatcaggttgtacttgtcgtaatcgatggcatcggcgagggctgctgccgcctgagtctgattggcgggcgtctttttgcggaacgtggggcagtagacgatgttgagcttgcgcccgagttccgggaactcgcggatgatgcgttcgcgctgctgcgcccggtacgagctgttgatcagcagatcggtgcggggcagtggcgcctcgtagatgatggacgggtcgatgtcgaagccgcgagcgtaatcgctgatgaacgatttggatgagatgagcacggacgtgtacccgcgatgcatgttcagcagcgaggcggtggagaacttccggccttccttggagcccaacgcggtgtatccgaacctcttcatgttgccgagcgcatgccacatctggatgacgggcacgtcgatgtagccggcgagcaggcttaccacgatggcgtaggtgtcgagcagcaccgcctggctggtggcgatgaaatacagctgccggatcatatggaacccgtatcgtaccgggttgtgcagcttcttggcgaggatcaccacggaataatccggatgcgtctgtctcacataatggcggatgagccggaaatcggtggtcggtcggtcgctctcgcgacttaggcacacaatcctacgcttgcgcgggaacgcgcggaagaacctatacataagaagcatcatcatccgaactgcattaatcagaagacgtttcattcttgttctcccttaccgaagcatcaggttggtgtgttagccggtctaccgtaactgcaactctatatattacatgggttaccacaaggggaaccataaggtgtcgtaaaggagcccggggatgtcactggacgttcaccaaatccgctggcggtcaagttacttggagatcgactattcctcgcgggatggtggtgtgccgtggctgtattgcgtgggacgtcgccagttcgttccgttcgagatcgtcgggcttgagagcggtgtccgccgcgcccgcctgaacctggtgctcggggacgggcgcgaggtgcttcccggcggccaatggatcatctgcgagaaaatcaaggagtctgcgctcttcagtctgcaggcgctgtacgccgaatacccgctcatgccgcagcgcgtcgactacgatgtacgtcacctgctgcccccggagttgcgtgacgatgatgaggcggtcgcacagtacaccgacgaagagcgtctggaactggtggctcggcacccctatgtcaccagcggagtcacctacgacgatgaggtgctggagcggcttgacaatctcgaccgcgtgttccgctacggcaagaacagctacgcctatactggtgtgttcgtgcccaagacgaatcgtgccggtctcatctatctcgcgttgcacatgcagttcttccagcgcaacaagaccccgcgccaccgtcagcgcagtcgtcgccagatgcagaaggacgttttcgcggcgacgtactcggtgatgaccaagctggtgccgcgcaagcgcaatcgaatcctcttcctcaaggagaacggcgagggcccgacggagaatatggaggcgttgcagagccgcatgatcgagcgcggcatggacaagcgcttcgatattcgtgcccggtaccgcaacgtattcgcgggcaggcagaacatcgtcgcctggctgcgcgacctgttcgagatcgcccgaagccggtacgtcttcatcgacgattacacccctgtattcaactttatcgaccccggtgaagatgtgacgctgacgcagatctggcatgccggcgtcggtttcaagtcggtcggctatgcccgttttggtctcaagggctcgccggatccgtacaattccgcgcaccgccgatacacgtacgcgctggtcggcaacgagcacctgcgtcgcatctattccgaggtgttcggcatcgaggaggaggcgctgctcgccacaggcatgcccaggctcgaccatttcctcgatgagaaggtcgagaaggaataccgcgaggagatggccgacaagttcccgtggtcggccaagggacgcgtcatcgtgttcgctccgacgttccgcggcaccggtcagcgcaccgcgtattacccgtatgacgagatcgacatggatcgtctgtaccgcatgtgtgtcgagacggacacgtatttcgtgttcgagatgcatcatttcatccgcaagcgtccggatatctctgccgagtacgccgaccgcatcttcgacctgtccgatgagagcctgacgaagctgttcttcatcgccgatgtgctggtgaccgactattcgtcgtgcttctacgactacctgttgctcaagaagccggtagtgttcttcgtgcccgacaagaccgcgtattcgctgatccgcggtgtgcagcggtccatcgacgagatggcgccgggcgtggtgtgcgatacgttcgacgagttcctggacgtgctgaggactcgccattatgagacggtttcccctcacccctcgtccatcgaccgcgccgccgagcgcagcggactcgccagcgaccgtgccatcgacactattatctacggcaaggatgttccgggtgtgcgcaaacaggcctccggtaagggaggcgcggtgccggtccggcagtccgacaagtcggccaagtccgaaaggaaggcaaaggaactgctggattccaaggtcgccgacaaggataccaagtccgcctccgacgaggaggagtgagcgtgccggggaaaacgagcatggccgtcgcgcccgccgccggcgccggtgagcccggcagtggctccggcgagactgcccggcacgcggcaccacgcggtgccgggcgcccatcatacgagctgctgtccaaataccgcggcgtgctgatgggcgtgcagatcctgctgatcatggcgttccactacaccgaggacctgtcgaacgcggccgaccatttcaacggtcccgctcaggtgttctacgactatatcggcagttccggcgtcgacatgttcctgatgatctcggggctgggcctgtactactcgtggaagcgcaacccggacgcgggggcgttctaccgcaagcggctgacccgcgtgctggtgccgtacgtcgccgtggcgctggtcgggtggatctggttcgacttcgtccattcggatgccggagtggtgcgtttcctcgccgacatcgcattcgtcacgtttttcacggacggtgtgaagtggttctggtacatagcggtgtgcctgatttgctatgtgctgtttccgctcgtgttcgccgtcgtggacggtacccgaaacgtcgccgcggcatgggtgcgaacgttggcattgtgtgcggccgcggtgctggtcgcggtggcgctgtacagattcgcgccgtctttctacgacaacgtcgatctgatcgtcaaccgcataccgtgcttcatcttcggcgcgctgctgggaaggctctcgcatgaacgtcgtccattgcccatgcccgtggtcgccgcatgcctgacggccgtggccgtcatgctctacccgatgcagctggttgatgtccctctggtcaaggtgtaccttcgcgcggcgttgaacctgctgttgtgcatatgcggcgtcgtcatcatggacgtgatggcccgcgcgggaaagcccgcgctcgcaggccttcacgacgtggtatcaaaagtgctgagctggttcggacggtattcgctggaactgtatctgcttcacgtgatgattcgcaagatgctgaacctcaacgacctgccgaccacgcacctgcgctatgaggccgtcgtgatcatcggcgcgatcgcgctgtcgatacccctgaaacggctgtgcaacctgattcagcacaggctgctgcgtgggaaacgtttacttaatgccaaagagtataggggcacatatgcggcttgatgcaccagcaggcgaaaatatggctgtattcgtttcacatgcctttgttctatatttgaaccctctgccggtacctcacatagatggcccgttcctgttcggcccgaaccgtttcttccgtgactacctagagggacgcaatatcgcatttgaggatcaagagttgcaggtggatttctcttccatgaatgagatgggaataacattcatggaagaatggaacaagatgtacatgggtgaggcgcaatcaaagctgtctgtcttcaaagagaaagatgtccgctattacgccgatgactatgccgcctatgtgggccagatggtattgggttgcgagatcggcgccgagcgtattcttgaacaccctgatatcgaacgtttgaaaactgagaacaagaaactatctgagaagcgaaagaagctcgaagcggatctcaagaaatctcgcgccgaggtccagaaactccgtaactcgaagtcgtggaaggtcactgcgccactgcgggcggtcatgcgtctgtttgaaaaggactgatggtggtccgtcttagtgcactctgcgtgccgaataccacagaaaggtgaatgctcggtaaataagtcgtgtctggaacatagactacgtatgagttaacggggctgcaagcccgaaagcgcatataacgatggagaggtcatgaacatcgctgtcatttttgcgggcggcaccggccaacgcatgaattcgcgaaccaagcccaagcagtttctgctcgtgcacggcaaaccgatcatcatctacacgcttgaggcgttcgatcagcatcccgacatcgacgccatcgtcgtcgtatgcctgaaggaatacatcgacgttctcgaacagctcatcaccaagttcggcgtcggtaagatcgccgcgatcgtgccaggcggctcatccgggcaggagtcgatccgcaacggcgtcgacaaggcgaacagactgtatcccgcggattcggtcgtcatcgttcatgacggcgtcaggccgctgatcgaccagcagaccatcaccgactgcatcgtcagtgtgaagaagaacggcagcgccgtcaccgtcgtacccgccaccgagaccatcgtgcaaagcgaggacggcgtgatcaccaacatcatcgaccgcaaacagtgccagctcgcccgcgccccgcagtgcttccgcctcggcgagctgcatgacgcacaccacaaggccgtggaagaagggctcggcgacttcatcgactctgcgtccctcatgtcgtactacggccacaaactgtacgaggtggaaggcgccaactcgaacatcaagatcaccacgccatcggacttctacatcatgcgcgccatcatggacgcggaggaaagctcccagatcttcggtctgtgacacgaacacggaggacaacgaccatcatgtttgatctgcaagaggaatatgcgtcactggcgcagcatctcgatatcgactgggatgcgctcgccggccggcatgtgctcgtcaccggcgccacgggccttatcggctcgctgtgcgcccgcacgctgctggaacgcaaccgcttgacgggggcgggcatcatcgtggacgcgctggtgcgagacccggccagggcacaggccatgctggggcagtacacggccgacgacgggctcgtgctgcatcagggatcgctcgaagatgtcgactcgctcgacctgccggcggactatgtcatccacaccgcctgtccgaccgcatcgtcgttcttcatgtcccatccggtcgagacgttctccgcgatcgtagacggcaccaggtcgatgctggaactggcgcgacaccgcggcgcggcctccttcgtctacgtctccagcatggagatctacggcatgggcaacaagcagcgcggcacggaacacctgcttgacgagagcgccgtcggctacatcgacccctgctcggtgcgcagctgctactccgaaggcaagcgcgccgccgaaaacctgtgcgtctcataccattccgaataccaggtgccggtcaaggccgtccgcctggcgcagaccttcggcccgggcatccctcgcgacgacgtccgcctgttcgcggcgctcgcacgcaacgccgtggccggcaaggacttcgtcatgaagacgaccggcgaaagcacacgaatgtactcatacaccgccgacgcggtgtccgccatcctcaccgtgctggtcgcgggggagaacggcgtctcgtacaacgtggccaatccctccacctactcgtcaatccgcgagatggccgatatggtgtaccgcgaattcggtacgggcgacgcgcacgtcatcatcgacgtcgacccgaacgcgccctacccgccggagcaccacctgccactcgacgtgtcacgccttgaggcgctcggctggaggccgcaggtaggtctcgaagacatgtaccgcaagctcatcgcatacatgggctgacctcgcgggagaccgcacctgaccatgagaagacaagcagatttggaagaacattgtttgcaacactgaagcaagtcgtcggcgagaactggcattggcgacggcaggtctggaatctggcgaagatcgatctggtgaagacgtaccgcggtgccgcgctcggcaagatctggctgttcgccaaaccggccgtgtacatcctggttttctgggtggcactgaaattcggtctgcgcagctcgtccgacgtcaacggcaagccgttcctgctgtggctcgccgccggtgtgttcccgtggttcttcatgtccgacatgattactaccggcagtgacgtataccgtcgatacccgtatctggtgaaccgcatcaaattcccgctgtcgctgatctccacgttctacacgctgtcgctgctcatcatcttcgcgtgcatgatggcgttcaccatcgtggtggcgctgctcaccggcgtgcatcttggccgctacatgctgcaattgccgctggtcatggtgttcatgttcctgttctgggtggcgtggtccatggctttgtcgcctttgagcgcgatatcgcgcgatttctcgaacctgctcaagacgctcggcaccccgttcttctggctgtccggcatcctgttcgacatcagcggctggccgcgcaccgcccgtctggtggcgtccttcaacccggtcacatgggtcgtgcagtcggtgcgtgactgctttatctacaacaaatggttcttcacggattgggagtcgttcctgccgttcctgttcgtgctgctgatcttcgtcgtgctcgcgttgcacaactaccaccgtctgtacatggaggtgccggatgtcctctaagctcccatcgaatgtcacgcgaatgggcgatgccacggtcatccgcgacgaggacgcgagcaatcccgtcgccgtgcgcttcgaccacgtcaccaagcagtacaagctgttcaagaacgacaagctgcgcctgttgtccaccttctccaagcgcattccgcacgatacggtcaacgcgagcgatgacctgagtttcaccgtgaaccgcggcgaatccctggcgctgctcggcgacaacggcgccggcaagtccacggcgctcaagatgatcaccggcgtgtgcttcccgacgtccggcaccgtcgaggtgcacgggcgcgtgtccgcgctgctggagctttccgcgggcttcgacatgaagctgtcgggcatggagaacatcgacatgcgctgccagctgtggggtttgtcgaaagaggagtccaaggagctcattcccgagatcgtggagttctcggaactcggcaagtacatcgaccagccgatgcgcacgtattcgagcggtatgcgcgcccgtctgggcttcgcgttcgtgtcgtcgatccgcccggacatcctggtggtggacgaggcgctgtccgtcggcgaccgcaagttcgcgaagaagtgccgcgagcgggtcaacagcatcatcgccaacgagaacgtgaccgtgctgttcgtcacccactcgaccggcaccgcgaaggagttctgccacaggggcatcgtcatccagaagggcaaagccatgttcagcggtggcatcgaggaggccgtcgacttctacaccgcctcgtgacgcttcgaccgttccgctgacggcgttgccggcaaacggcacggccgacgtccattgaccgcgttcggtcggatggtcgggacaactcccgcgcttcgcgattttgcggccgttgtcctgcggacgataacgcgggcatgtcccggatggccggaatttcgtggttttatgctggacaactgctgcaaagggctgttttgcggcagttgtatcgtgttcgttctggacaactcccgcatttcgtgattgtgcggccgttgtccacgttcctgtcggcggatcgaggcgaatcgcgcattatgcaccgctgaccccagtctcccccgccctatcccgccggcagggcggttgttatgcttgaagacatgtcctataccatccgcgcggccgttgacgccgacgttccggccatcgccgacatctacaacgaggcggtgatccgtgggggagcgtccgccgaccttgaaccggtgtctctggaaagccgtcgtgcgtgggtcgactcccatcagccacgtgccaagtatccggtcgtcgtcatcaaaggtcccgaaggcgccgtcgtggggttcggctcgctttcgaaattccatcagcgggccggatacgacggcatcgccgaactgagctactacatcgccggcgaccaccaacgccagggactcggcaccatgatggtgcgatggctgatcgatgccgcggcagagcgcggattcacgcatgtcacggcgatcatctacgccgacaacgccggctccgtcgcgctcatgcggcggttcggattcatccggttcggcctgcttcccgccgcggtgggcgcgctcgacggcaagctgcatgacatgagctattgggtcaaggcgttggcgggtggggtacaatccttaaggttgaagacaggagagtaacacatggcatccgatttctggctgatcgtggggctgggcaatcccggcaagaagtacgagggcacccgtcacaacatgggcttcatgaccgccgacatattggccgaacgctggtccgtcgccttttccgaccacaaggggctcgcgatgctcggcaagggcgcgatgaatctgcagggtcgcaacgtcaagttcttcctcgccaagccgctgacctacatgaacgactcgggcaacgcggtcgcctcgatcagcgcgtactatcagatccagccggatcacgtcgtcgtcatccatgacgacatggatctcgaattcggccgcataaaggtcaaggcgggcggatccgccggcgggcacaacggcatcaaatcaatcgacaaggccctgagcaccccgaagtacgcgcgcgtgcgcatgggcgtcggccacgctcagcgcggagcccacgcgcacgacaacaccgtcaactgggtgctcggcggtttcggacccgaccagcgcaagcagctgccggaattcctcgcagacggcgccgacgcggccgaaaccatcatcttcgacggactcgccgccacccaggagaagttcaatggccgctgagcagggacgcgcgcgcggcaaagcgtccgctgccacggccacacgcgtccagaacgcgctgatcgacggctccctgtgcggcatcctcgaacggctcgatgaggatccgacatttcatcggctcgtcagcggcggcatgagcatcgccgacgacaaggacatcgccccgatcatcactgtgggcgccccggacgggttgcgcccggccatcgccgcagcgcaggcggaacacacccccgtcgtcctggtcgtggcctccagccgcgaggccgaggacaccgtgaacgcgctgcggtcgtggtacgacggcgacccgaacgacatcgcacaactggaggcctgggagacgctgccccacgagcggctcagtccccgtgccgacaccgtggcgagccgcatggccgtattccgcaggctcacgcaccccagcgacaccaatccgatgttcggaccgatccgcatactcgtcatgccggtgcgttcgctgatccagcccgttgtcaaggggctcggcgacgtcgatccgctcgtcttcacgcaaggcgaggagctgcctctcgacgacgtgtcgcgtcgactggttgagaacgcctacacgcgcgtcgacctggtgatggaccgtggcgagttcgcggtgcgcggcggcatcatcgacgtctttcccccaaccgcgccacatccggtgcgcatcgagttcttcggtgacgagatcgactccatccgagaattccacgcgtccgaccagcgcacctacggcgagggcgtccgcacgatctgggcgacgccctgccgtgaactgcagctcaccgacgccgtgcgggaccgggcgaaacggctcatcgggcagattccgaatgccgacgacatgctggagtccatcgcgaacgcgattcccatcgaaggcatggaatccctgatgcccgcgctcatcgacgacatggaacccgtgaccggcatgctcgacaggcatgccatcatcatgctcgccgactcggaaaagctgcgccgcgcggcggacgacctctcgaaaaccgcgaacgagttcctcgccgccagctggcatgtcgccgcggccgggcacggtgccggagctcccatcagcttcgaccaggccagcttcctcgactacgaggagaccatcaactcgctcgcatactccagccacgacgtgtggaacctcaccagtttcggcgtggacgccagccgcccgaaccacgtgcagctcgccgccggcaacccgggcgaataccgcggtgacgagacgaaggccgcggccggcatcgaggggctcatcgacgcggggtaccaggtcaccgtcaccgcggccgcgcagggcacgctcgcacgattgaagcgagccatcaacgagaccggcatcgcctcgttcgacgtcatccgctcccaggccatcgacgggttcatcgacacggcggcgaagaccgcgctgctcaccgaacgcgacctgaccggacggtccagtgcggccggtcaggcgaagacccccaagcgccgccgcaaggcaatcgacctgatggagctcaaagccggagactacgtggtccatgagcagcacggcatcggccgtttcctggagatgcggcagcgcaccatcggcaccggggcgaacaagaccacgcgcgaataccttgtcatcgaatacgcgcccagcaagcgcggcgccccggccgacaagctgttcatccccaccgatcagctggatctgatcagcaaatacatcggcgcggaggcccccaagctcaacaagctcggcggctccgactgggccgcaaccaaggcgaaggcgcgcaagcacgtgcacgagatcgccgaggacctggtgaagctgtactctgccaggcagcgcaccaaggggttcgcgttcagccccgacacgccatggcagaaggagctggaggacgcgttcccgtatcaggagacgacggaccagctcaccaccatcgacgatgtcaagtccgacatggagaaaccagtgccgatggatcgcctcatctgcggcgacgtcggcttcggcaagaccgagatcgccgtgagagcagcgttcaaggccatacaggacggcaagcaggtggccgtcctcgtgccgaccacgctgctcgtgcagcagcatcacgagacgttcaccgaacggtacgagggcttcccggtcaccgttgcggccatgagccgcttccagacgaccaaggagatcaacgagaccatcgagggactggagacgggtggcgtcgacgtcgtcatcggcacccacaagctgctcaaccccaagatcaagttcaaggatctcggccttgtcatcatcgacgaggagcagcggttcggcgtcgagcacaaggagacgctcaaggcgctgcgcaccaatgtggacgtgctctcgctgtccgccacgcctatcccgcgcacgctggagatggcggtgaccggcatccgcgagatgtctacgctcgccaccccgcccgaggaccggcttcccgtgctcacctacgtgggcgcgtacgaggacgctcaggtcacggccgcggtccggcgcgaactgctgcgcggcggacaggtgttctacgtgcacaaccgcgtgcaggacatcgcgaagacagccgcgaagatccacgagctcgtccccgaggcgcgagtcggcatcgctcacggcaagatgggggagaagcagctcgacggcgtaatccgcgacttctggcatcgcgacatcgacgtgctcgtatgcacgacgatcatcgagaccggactcgacatctccaacgcgaacacgctgatcgtagaccacgccgaccggttcggcctctcccagctgcaccagctgcgcgggcgcgtcggccgtggccgcgaacgcgcgtacgcctacttcctgtacgacccgtccaagccgatgacccagcagtcgcacgaccgcctcgccaccatcgcgcagaacacggcgctcggaagcggcttcgacgtcgccatgaaggatctcgaactgcgcggcaccggcaacctgctgggcgacgaacagtccgggcacatcgagggcgtcggcttcgacctgtacgtgcgcatggtctcggaagccgtcgaacagtacaaggagccggagcggaccgagccggtcgcggtcaccatcgacctgcccatcgaagcgtccatcccggtggactacatcgattccgacaagctgcggctcgaagcataccggaaactggccgcttcgcgcaccgatgaggacctcaaggaactcgccgacgaactcacggatcgctacggcaaactgccggaggagttcgagacgctgttcggcgtggcccacctgcgcatgaaggcgcgggaactcggcatatcggagatcgtcgctcagggcaagaacgtgcgcgtcggcaagatcgacccgcccgaatcgatgcagatgcgcatcaaccgcatctaccgcggggcgcaataccggccggtcacgcacacatacctgatccccgcgccgttcgcgggcacgctcggcggcaaaccgatgccgggcgatcaggtcatggactgggtgagcgacctgctgcacgacttcgcatggaagccgcaaccgaggaaggcatgatgggctccggatccccgttcgaaggcatgcccggaggcatcggggagcggaacggcatgatccggctgccgtaccatcccctgacttcgctgatccggcatttcgacaatggccaggccctgacgctcctgcactcggggcggggcggacggtattcggtgctcggactgcacgcctaccatcggctcatgcaatacggcgatgacgtgatggaaggcaccctcgccgtctgcggagacgacgatgtctggcgggaccggctgctccccggccaagacgcgctcatgctgctgcacgaccggctgcgtgacgagcccggcgtgctcggattcatgtcatatgatgacggccgacgccgggaaggcgcgcgatcccggttcgacggcggcccgcaggcggcagagcgaaagacgccgccggacgccgcatggtggagtttcgacgacatcctcatcgaagaccggcagcggcgctcgctgaccctgctcagccatcatcgccacccgaacagtgcccggaacatcgccgccatacgatccgtctgccagtccgcccccgctggcgggggctgtcgcgaagcgactgtgggtggttatccagactccccgcacacctcagcctcccaccgcggcgcatggcgctgcgaccacgatcgcgcctcatactgcgaggccgtggaacgactcaaatcgcacatgcacgacggcgaagcctacgtagtgaactactcgttgcgtctcgacgtcaccagtcccgtgacgcccctggacatgttcctgcgtctgaacgacgacaatcccgcgccgttctccgcatatgtcaacggcggcggatggcagatcgtcagctcgtcgccggaacggttcctcgaatgctgcagcggccatgtcgtcacccgccccatcaaaggaacgcggccacgtggcctcaccgtgcaggaggacgcggccaaccgcgccgcccttgagcaatccggcaaggaccatgatgagctgctcatggtcaccgacctcgaacgcaatgatctgagccgcgcggcgattcccggaaccgtgcaggtcacggggttcgccgaactggagacacacccgcacgtgttccatctggtgtccaccgtcgaggccgaattgcccgatgcccgcgatctgtccgaactgcttgccgtcatgtcgccgggtggatcgatcacgggggctcccaagcgccgcgtcatgcaactcatcgaccggtatgaacggtcgcctcgcggcgtgtacaccggttctctcggctacatcaccgccgatggcgactgcgatctgagcattctgatccgctgcgcgacgcacgtcgggcgatgtgacaaggctggcctgtaccggatcggcgcgggcggcggcatcaccatcgaatccgacccggacgccgaatacgacgaggccatgcagaaagcacaggcgctgctcgacgcgctggactgtgacgtgtcggacagtgacgtgcatgacggaagacaaggacaatggcatgactaatagcaatggcacgcctggcggcgaaggcacggccgtcacattcgccctggatgagggataccagttcggcctcggcgtattcgagaccatcaacctgaccggcgggcgactcgtcatgctcgaccgtcatctcgaccggcttcggcgcggagcgcgggcattggatatcgacgcgccggacgatgatacgctgcgggctcatatcgccgaacatctcgacgcggcagaattgcctgacggtaggtcgttcgcggtcaagctcatggtgtcgtccgcgaacgtcatcgtcacgcatcggccgaacccgtatgcggattgggcgcaggaccgcggtctcaggcttggctggtgccgcgcctggcgcaacgagtgttcgccgctcacggcgcacaagacgctgaatcagggagacaacatactcgaatcgcgttcggctcggcggctcggcttcgattccgccgtgtacctcaacacgcgcggcgacatctgcgagaccaccaacgcgaacctgttcttcgtgcgcgacgggcggctgtacacgccggacgagcgatgcgggctgctacccggcaccgtgcgggcgtggctgtgcgaacgatacgaggccgagcaggggaccttccgacaggattcgctggacagctgggatgaggtcttcgccaccaacgccctgatgggcgtgcgcccggtcgtcgagctgggggatgcgggctatggaatcgggccggtgacgcgggcgatccagcgcgaataccgtcggcttgagctcggtatcctctgaccgccctcagtcggctccgccgccagtcctcgacagtggcggcggagccgactgagggcggtcagatgtacggaatctgtctatatccagccgaatgttagcgctcatattatttttccgagaaattctggcactcgtccacaaaaggcattattcttaagtctgtcatcacaacctaacagtcttaaggagtagttgtggcagctattgaaagcgtttacgcgcgtcagatccttgattcccgtggcaacccgaccgttgaggtcatcctcgacaccgaagacggcgccgaaggccgcggcctggttccgtccggcgcttccaccggtgaggccgaggcttgggagcgccgcgatggcgacaagtccgtctacggcggcaagggtgtgctgaacgcggtcaaggccgtgaacgaggtcatcgctccgaaggtcatcggcatggatgccaccgaccagcgcgccctcgacgacctgatgatcgagctcgacggcaccccgaacaagggcaagctgggcgccaacgccatcctcggcgtctccctggccgccctgtacgcctccgccgagtccgccgaactgccgctgtaccgctacatcggcggcaccaacggccacatcctgccggtcccgaacatgaacatcatgaacggcggcgcccacgccgacttcgccaccgacatccaggagtacatgatctccccgtacggcttcgacacctacagcgaggccctgcgcgccggcgtcgaggtctaccacaccctcaagaacgtcctgaagaaggaaggcctgaacaccggcctcggcgacgaaggcggcttcgccccgaagatgaagtccaacgaggactccctcaagtacatcatggacgccatctccgccgccggctacgagcccggcaagcagatcggcatctgcctcgacgtcgcctcctccgagttctacaacaaggagaccggcaagtaccgcttcgacggcgaagagcgcgactccgcctacatgctcgactactacgagaacctcatcaacgagtacccgatcgtctccatcgaggatccgttcaacgaggaaggctgggaagactgggccgagatcacccgtcgcctcggcgaccgcctgcagttcgtcggcgacgacctgctggtcaccaacccggcccgcctgcgcaaggccatcgacatgggtgccgcgaactccctgctggtcaagctgaaccagatcggttccgtcaccgagaccctcgacgccatcgagctggccaccgagaacggctacacctccatggtctcccaccgctccggcgagaccccggacaccaccatctccgacctcgcggtcgccaagaacacccgccagatcaagaccggtgccccggcccgtggcgagcgcgtcgccaagtacaaccgcctgctggagatcgaggaggagctcggctccaccgctcagtacgccggctacagcgccttcaaggcctgcaagaagtacatcgccaagtgattgtcgcggccgtaaggccgagacaatgctagcgtcgtgacaatgcccggcatattcgccaagtcgaatgtgccgggtatttttgttgccatgaacgactcgacccggaacatgcgaccacgcggcaaacgaagcaaacggcacggcaccggaccgatcgcgttcttcgtgtcgctgttcatcatcgcgctcggagccatccaactggtctccacgttccacacgtacgcgctgaacctcgcccagctcaacgacctcaagaatcaggaagccgcgcttatcaccaagaagcaggatctcgaaaacgacatcgaacgctggaacgatgacagctatgtggcgacgcaggcgagggagcggctcggcttcgtcttccccggtgagaaggcggtgcgcgtgcagcacccggaagcggtgacgggcacgagcgagggggccgcgaagaccaaaagcggtacatccgacgggaaggtgctgccctggtacagcgagctcgaatattcgttcaagaaagccgatgagcggccatcgaaaacggcctctggcagccaatcgggcgataccggcaaagccgacggcaactccggcagcgcaaccgacacgaactcgggcgacaagcagtagacgcggccggcggcagcgtcattcatccgactgcataagccattcgaccagttattcgataagccattcgataaggagccaagctggtgaccgaaccagaatcacaagacgaatccaccacacgagatgtcgcgaaactcgccgaccgattcctgcagcagcgtgcagatgagcgtgacatcgccattgtcgaacggcagctcggacgatacccgcgcggcatggtggcggtcggcgcccgctgcgcatgcggccggccgctcgccgtggtcacccggcccatgctgcccggcggcataccgttccccaccacctgctatctgaccagccccgaggcggtgaaggcggtgtcgcacatcgaagcggaaggccgcatgcgggcgtacaacgagctgctgcacgacgatgagacggtggccggcgagtaccgcggggcgcaccgcctgtacgtggcgttccgccatgagctggcggtgcggctcggcgatgacgaaagccgcatcgccaacgtcagcgcggggggcatgcccgaacgcgtgaaatgcctgcatgcgctgctggcgcagaccctggtcatgggggagggcgtcaaccccatcggcgatcgtgtgctggaggcggtgacggaggagttcagtccatccgtctgccggtgcggttcgctcgacgactgagcggacagacgaaaaaccgaacggccaaaagactggaaacggccgctgaacgcaatgattgcgccgagcgagacgatcatgccgggcgaacgcccccgatgatcgcggtcgcccggccggcgagacagcgggaaacaaaggagatagagatgaaatccgttaccgttgcgggcatcgactgcggcacgaactcgatccggctgaagattgcgcgtgtggacgatcagggcatgcacgagatcgtgccgaggatcctgcgcgtgattcgcttgggacaagacgtggacaagacgcaccggttcgctcaggacgcgcttgaccgggcgtacacggccgccgcggaattcgccggggtccttgcccagcacccggtggacgcgatccgattcgtagccacatcggcgacccgcgatgccgtcaaccgcgacacattcgaggatggcatcgagcagatactcggcgtgcgccccgaagtcatcccgggaacggaggaggccgatctgagcttcctcggggcgaccagcgtcgtgagccgcggcgagctcgaacccccgtatctggtggtggacctgggtggcggctccacagaacttgtgctgggcggcgacggcatcgacgcgccctccacgcaggtacaggccgcgttctcgatggacattggatccgtgcgcatgaccgagcgccacctgcgccacgatcctcccagcgaaaccgaaatcgccgaagcgatcgcggacatcgacgagcacatcgacgaggcgttccgcacggtgccggcgggacgcacccgcacgatcatcggcgtgtccggcacggtgaccacgatgagcgcgctggctctggggctcaaggaatacgatcaccgacgcgtggacggcgtgcgcatccccgtggacgacgcctacgccgtggacgacaggtttctgcgcatgacgcgtgagcagcgctgcgcctacaagaccatccatccggggcgtatcgacgtggtgggcggcggtgccgtcgtatggaaccgtgtgctcgcgaaggttgcccaggcggccgcggccgatcatggcggagtcatcgactcgtatgtggccagcgaacacggcctgctcgacggcatcgtgctcgactgcggacggcggttgcttgcagaacgctgaacaagcatgacataatggttctgccggcatatttgccggcacagcccccgtggcggaatcggtagacgcagcggacttaaaatccgtcgcttttggcttgtgggttcgagtcccaccgggggcaccttatcgcaacattctgggatggctgctttacatacagctgggtttgcggcccgacactgacgaaaggtgcaagatggcgaactggacgaacgtgacgcgcgagcccgagaccgggttgccgacgatgctggtgcaggcggtctccatcgcctttgtcatgtgcgtgtgcgagctggtcagcgcaccggtgatggtgagcgccgcgggaggcgcgttcgccctgatgccgtggttcctcgtcgcctgcctgttcgccgtcgcattcgtgtatacggtcggattcgtgctgctgtgggcggctgattcgttcgccgcccggctgaaacgccgcgatgcgctgatgccgctgatatatgccgtgatcggatgcgtcgggttcggcatctgggggtattgcgtgtatccggcgacgatgaactcgatcatcacccgagccggtctggccaccctttcgcagggcgactcgctgatgatcggcatcaactgcgccgtggtgggcctcgccgcgttcttcctgggaaccgccgccatgccgcgcgtcatgaagtccaagggcaggatcgccgtcacggccgcagccgtcatcgcgctcgccgtgttcggcggcgtcgtcctggcgatgacgtggtcgcatctggcgtgagaccagccattgcggaacgctgtcgtcgagctgacctgattcggcggttcgacggggcagcggagatggcgacggcccggccgtgcgcatgtgcgtggcggaggatatgatatcgcgatggtatcagccgtgaaagcgtgcataacagtgtgaagggattcgtcagtcatgttcagtgttctcgacatgttcaccatcggtgtgggccccagctcgtcgcacaccgtcggcccgatgtgcgcggcgcaggcgttcgcctcgtcactggaggaatctggcgccgtgtcgcgcgtcggccgtatccgcgtcgtcctgtacgggtcactgtcgctgaccggactcggccacggcaccgaccgcgcgattctcgccggattggaaggcaacgtacccgccacagttgatacggattacctgctttcagtccgagaacgctgcgcgcacgacggaaccatccatgtcaacggcacgaacgccatcgcatacgatgacgacggcgacatggtcttcgaccggtggaagcggctcgccccgcatcccaatggcatgcggttccaggcgttcgacgcccagggcaacatcatcgacgagcaggtctggtattcgataggcggagggttcatccgccgcggacggatcgacgacgcgctgatctcgaaccacgagcagacgccggcgtcgtcgcagtcgccggaggactccgggaacgacgaggctgccgaatacggcgacggcgtgccatatcccttcgtatcatgcgacggcctgatcgacctgtgtcggaagcaccatctgagcatcgccgacgtcgtctgggcgaacgaaacggcccggcgctcgccgcaggaggtgcgtgaccggctcacgcgaatctggaacgtgatgagccactgtatcgacgccgggtgcgccagtgcgacgccgacgctgccgggaggtctggacgtgccccgccgcgccccgctgatgtaccggcgtctcgcggccaacagcgacgtgctcagacgcgatcgccgcatctcttcggcgctggaatcctccgattccgcatgggtggcgttgttcgccatgtcggtgagcgaggagaacgccggcggcggccgggtcgtcaccgcgcctaccaacggttcggccggcatcattccggccgtgctggaatactactggcactttgtcgagtccgccgacgacgagggcgtcaggacgttcctgctgaccgccggcgcggtcggatacctgttcaagcgcaacgcctcgatctccggagcggaagtgggatgccaaggcgaggtcggcgtcgcctgctcgatggcggccgccggtctggccgcggtgatgggcggcactccggagcaggtggagaacgcggcggagatcggcatcgagcacaatctcggcctcacctgcgatccggtgggcggtctggtgcagattccgtgcatcgagcgtaacgcgatggccgcgaacactgcgatcaacgccgtgcgtatggccatgctcggagacggctcccacatcgtcagcctggatcaggccatcgccacgatgaagcagaccggcgaggacatgatgtcgaaatacaaggagacctcgaagggcggtctggcggtcaacgtcgtcgaatgctaggccgtcgccgtgccgaatatggcgaatatggcgatttgcgttgaaaaatacgctgcgagctgtgcaaccggggcttggggtgctagtgtgagtggcactgtctttttacgacttgcggccatgccatgaacggcatggcattattgataggaggtaggccatggcgaacatgcctgaggtcaatgccgtgtttggcgcggcgccggagatcgctttcccgtcggacgaggcgccgaagggattgaaggccgtggagatcgtcgagggtgacgggccgatggtccgccgcggcgacacggtgaccgtgaactatcacggtgtggtctggggcaagaacacgcccttcgattcgagcttcgcccgccaccagccggcaagcttcggcatcggcgtcggccaggtgattcgcggctgggatcagaccgttcccggccacaacgtcggctcccgtctggtcgtgtcgattccgccggagtatggctatggcagccagggcatgccggcggccggcatcggcggcggcgacacactcgtattcgtcatcgacatcatctcgacccgctgaccgtatgatggcggtcatctgacgcatcgattggatatcactgatacaggaggaacccatgggtgaggaaaaatccgttctgctgacgcaggaggctttcgacacgctgaaggatgagctggcgcatcgacagggccagtaccgcgaggaaatcaccaagcgcatcgcggcagcccgcgccgagggcgatttgtcggagaacggcggttaccaggccgcgcgcgaggagcaggcgaagaacgagggccgcatcaacgagctcaccgtcaagctgcgcaacgccaccatcgtcgaagctcccaaggccggcaaggtcggcaatgggtcgctggtgacgctggagctcgccggccgcgagatgacgtatgcgctgggctcgcgcgacatcaaggtcgcgacgaagtacgacgtgatcagccccgagtctcccatcggcgccgccattctgggcgccaacgagggagatacggtgagctacaaggcccccaacggccgtgagatttccgtcgtcatcaaggaagcgaagcctctgagctgaccatatgcgcgtcctcgctgaccggggactggtgattgttgcgccatcagggtcgacatgactcacttcgggctgtacggttttatgccgtgcagccctttccaatacaaactacgttgtcagagccgtctcacttgactatcattgagccataggttgttgtgttggcctatatatcgcagatgccaattcaatggagaagacatgaatgggaaaatgctctctgccgtcggcaaccgttataagtacgttgtcgccgagcttcctcccatctcaggcaatggctgcctcctgtcttacgcgcggtatgggatgtgtgtgcctaaaactccatacagtgcgaatttctgacatagcatatgtgaggagttgtttctgatgagacgttcaacgaagatttcaatcggcgttacgacggtggttatcgtagttgctgctgtcatctgatgatggtacgtacacgcccatcaatcccgccagcggcatgctcggagtcggtggacagcaggtcgctgctctctcatccgacggacgatccgccactggcgccacgcttcaggcctatgccgaggctgtggactagaaaagcgtttctaagtgcgcgccgaaacgatgagcgtgcgcacataggcacgcaaatggcccggtttgcgttcttaagtgcgcacggttgtcgtttcgacgcgcacttaggaacgctctagtgcgttgtatagcggtctcgattttgtttcgaccatcacgtgttacgacgagtgaaggcgatgttcgttgtgggctggtggccttcttcagactcgctccgcgagctggaccgaggacgtccgcaccacgaccggcaaccgcagtttcatggaagagctggccgagtgctcttggaatatgtaagcgtcttcgtgaaagcggaatggtctagggcgtcaattccgcctagagatctccgcccaatctcgtctctttatcggaacagcaaacacggtccatgattgacatgggcgttgacgctgattcatgaggggagtattctagatattacgacagacagttgtctggtaatgtccaaagggggactgtatgaatatcaaaaacaaaaataatggcgatatcgattgccagtatgttggcgctgtctccgttggggatggcgtctgcacatgagacaaccgtcagcgtcgcagacgatgccgcagcaaccacagtagaaccgcggtatggcgagaaaacgacaatgacgttgatatccaccgcgaaaaaaccggcgttaccggttattgcctgcagccgcctagtgctgctcattactatcaggcacgcatcaccaagaattacaccatcaaacattatcgtgttgactactacgagtacggagtcaagaagcgaactttttatcaggacatgtatgagcaggtatctgaagctccatatcttgtctgcgtctcataagttcgcatatcgaagggaatcatcgtgaacacgacgcgtaataaactgctgaactggtatccgatcatggcggtgctggtgctgattgtattcgtgggcggagcctggctctgggcgtaccgcacgactccaagcgcctccgcaatcaccggcgagctcaacgcgattcctgtcaatgtgaccagcgaacagctgatccgtgacggatacattgatctcaccaaagtaggagaatcctctaacgtcgcggtgaatgagtttcttgccgaagcgaaacagcaggaagcccccgtactgaaatacatcaacgtggagaaggggagcctcacggctcacgtcctgtggtatgacccatatgattcgaccccttgggccaaagccaaggatggttcggtcgtgatctaccacaaccagaccgggcgaatccgcgcatgggcgtggcgcaacggtgagattgtccaaaacggtgaacgctacagctccaaagcggtgacggtcacgaaggacggagtcgacaccgtgcttctgccgtggcggccggctgcgcccgatgtggtcccggaagatgacgacggggcatcatcgttggcgctgtattcgtatcgttcgtgattgcatagcagcatgcccccggttctgcgggggggggggcatgggcgcatgtctttgtcgtgcatgcccccgcgcggccattccaggatggcggcgcgatgacgtcttatttggtgtccatggtcggggcatcacctgatgtgcggtgcgccgtcggtgccgcgctccaggtctatgctgaggctgtggactagaaaagcgtttctaagtgcgcgccgaaacgatgagtgcgcgcacataggcacgcaaatggcccggtttgcgttcttaagtgcgcaggattgtcgtttcggcgcgcacttaggaacgctttcatgtgttacttggcggtttgcggggggggggctgattattgcggattatagcgggtgatgatggtcgctgtagcctggtaaccgccctcagtctcgctttgcgcgccagctcccgccagcgggagcataagttgtgtggggctcgctggcggggctgacctgagcggcgatggtcacggccagagatgcacgatcaccatgtagatcgcgaccatgtggcaggcgtagccggcgacggtgccacagtggaagatctcatggaatccgaagacgcgtggccacgggtcaggcttgcgcagcgcgtagacgatggcgccgaggatgtagcaggcgcctcccgaggccagcagcaccacgacggcagggccggcggcgggggagacccagaagaagtacatgaacgccacgccggagactccgaacacgatgtagacgacggtatacagccagcgcggggcgctgatccagatcacatggatgatgagcgccaccagcgtgcagctccatatgccggcgatgatggcgttgcgcatatgcggggcgagcgcgaacgacaccggcgtatatgtgcccgcgatgagcaggaagatgttcacgtggtcgatgcgccgcagcacgtcggtcacgcggggcgaccagtcgccgaggtggtaggcggctgagttgccaaacaggatcagcgagcaggtcatgaacaccacgcaagcccatttcaggggcgcgccgtgggccaggcatatcaggacgatgcctgcggcgagcgacagcggcgtggcgattgcgtgaatccaccctctcatcaatggcttgggtcgtccgtgcacgtcgagacggatcttgcgctccacttccgccggggcgattccctcgatgcgtgcggcgtgggcctcgcccttggcgagggtcctggtggctttttcctcggccttatgtcggatcgcctcggccttcgcgcgggatttcgctctcaccgcgtcggccttcgcctgcaatgcgacttcccgcgccttgatgacagcggctcgcttcgctgccaccgtcgcgtcgtcctgtactgccatatgacctccccgattggttacggaaacgtaacttacgttagcgtaggttatagacttgtccgctcacggatgtgctcatgaagtacggatgacgattgcgtcatgcatcggcatggtattgcgtatcatggtactcatggctgatttcacacacattctggctactcgacctgacttcaccgaaagcgatcgcgaatggctgcaccatctggtcgccgactggcaggtgatcgccgatctgagcttcgccgacctgctgctgatcgtgcaggacggcgacggcaactaccgcatcgtcgagcagtgcaggccctccaccgtgatgaccctgagaatcgatgacgccgtcggcgcgctggtcgccccggaaatggtgggggagctggatgccgccatgcagtcgaagaccgtgttcaggtccactgtgctcagggcggtcggcaaatccacggtctgcaacgtgtacgcccccgtccgtcatgacggcaagacgctggggcttgtcgtgcgtgagaccaacatggccacgcgcgagtcgaacggccggtacgagtccgaaagcatcaacgcgggcaagcagttgtatgagatgattccccgtggccagttcccctacgtcaacgcgatcatgagccagcgccatgtcgcgcgtgtctcggacggcttcatcatgctcacgcaggagggcatcgtacgctacgcctcgcccaacgccatcagctgcttcagaaggctgggatgcctgatgacgatgcaggggcatttcctcagtgaaatcggcaccgacctgctgcgtcgcaacgatccagtccccgaggcgctgccgatggtgctgatgggcaaggatgcagtggattccgaaatcaacgccaaccgatccgcggtatccgtccggtcgctgcccctgtacgacaataacgggcgcaccggggcgatcatcctgtgccgtgacgtcaccgagctgcgcaggcgtgaggtcgaactgcagaccaagaacgccacgatctcggagatccaccatcgtgtcaagaacaacctgcaggcggtctctgcgctgctcaggctccaggcgcgcaagacgaagtccagtgaggtcaaaaaagagcttgaagaggcacagcgccgtgtgcagaccatcgccatggtgcacgagggactgagccagaccgccgatgagatcgtcgatttcgacaaggtcatctccaacctgctgaagatgagcgtcgacttggccacgatgtgcgaccagcacatccacatcgattacgtcggcaagttcggcatgatgcccgcacaggacgcgaccccactgtcactggtgctcaccgagctcatcaccaactgtgtggagcatggtttcgagggacgcaaggaggggcatatcaccatctccgccgggcgcagcggcaacagcctcaatgtcgtggtggaggatgacgggtcggggctcgccaacgaggaacacgacggtctggcacgctcctcgggctccggattgggcacgcagatcatcaacacgttcgtcaccaacgatttcggcggcagcgtgcgctgggagccgcgtcacgaaggcggcacccgggtcatcctcgacatgacgctgcgcgcggcgcagaacgagtgacggccgcttgacggcccgaaaacctgccgaaacatgattgaagggtggcctccctgtgggggagaccacccttttcgtagcatatggagctatgaatcggctgcggcgaggagtcggttgtgacgaggagcgactcagacctgcagctgcatggcctgggagcgacgcgcacgcatcgcgcgacgcttcagggcgcggcgttcgtcttcgctcagaccgccccagacaccataatcctgattggtgtccaacgcgcacttcagacaggcgtcaatcaccttgcaggtgcggcagaccgccttagcttcctcgatctgctggtatgcggctcccgtgtttcccaccgggaaaaacagttccgggtccttgtctcgacatgctgccttggcacgccaatcaaaagcgctgctcatgtgtatcaccctcctcccatcgcctattgccgacgacgagctttcaagtcatacattaggtaaccacgaaacgaatgttttttcaagaggttttcgctctcaagtgtgaagaacttcagattttggccatggcgcactgtatccacagggcgttcccttcgcgcagcagcacggcgcggcccgccgtcatgatgtcatccggcccgcattgcgacagcaggccggcgggtatgccatccatcaggtccacggtacgttcccccgtggggaagactattctcgtgccgcaatgctcggggattcggatgtgcttggaggtctccacggcgaacacgacggtgacgtcgtggtcacccagcgcgtccttgagccgtgcgcatagcgggtccgtgccgaacggatcgaacagtgtgtcggcatcgtccaccagccacagcagatgcggggatacgggaggtggcgattcggaggagaaccgcacccgtctgtgatggcgtaccgtcgacgtgacgaacgcccgtccctcgcggcgtgtccagcgcacgcacaggccgagaatgtcgcgtgaacggtgcgctagcaaggcgagaatcgtggacttgccgcgtcctgcgcttccgatgattccgacattgccggcgtttacggcgagttccgccacatcgatgccgatgccgtcatcggcaagggcgaagggcactgagggaacgtccgatgaccgtgcgggcagcatgtcggcctccacgatgcggggcagcggggccgtgaacagcgccgaggcatggaccagaccatggaatgccgcagctgtgcgcgcggcctcgaccatcgcgccgatgtccgatacaaaggcgcatcggaacggctccacggattcaccgtcgttgcgccatgcgcacccgggagcggacgggctgatggatgccgcccgcccgtctcccagcaattcgatggattgcaggccgtcccggacacgcaggcatatgttcagcgccatgttcgctttcatgtcggcgctgacctgtcccagcgggttctgcgtacaggcgatgacatgcatgcccagggaacgccccagcgaggcgatgcgcaccagccggtccacatagtcgggcagctggttgttcagcgcatggaactcgtcgatgacgacgatcagcgagggtggcggggattgcaactgcccgatcgagccgacacgctccgcggcgaccagatgctccctgcgtcgcagctccagctccagcgccctcaacgcgcgaacggcgtgattcagatcgaggtcgcacacgctgcccacggtatgcggcagccgctcgatgacgctgaacgccgaacctcccttgaaatccaggaacacgaaatgcagccggtcgggcggattgcgcaccgccatggccaggcaccagctttgcaacagcacggatttgccggagcccgtggtgccggcgaccaaggcgtgcggcccttggcggggcagatcgatcgtgaacggccgctgccctgaccccatgcccacggtgacgcacagcgacggggaggcgagccatgttctcgcgatgatgcgccatggcagcggctcggcctgaagccccgtcagctcctccagtgagggcgagtgaatccgtgacggatcctccgattcgtcgccttcatccttgtcccgatcggctccgtccgccgatccatgatggcggccccgggctcctgccatatcggtgggccgacttgggcggccgcccgcagcgtcgtggctcgtcgtcccggattcgtcgcggcgtgacgatccacgacggtcagcaagggatgacgccgccgaagccatgcatcccaccatgcccggcgcgaccatggcggcgaacagccaacgtcgctccagcagaagcatgatgaccatcaacgcctgtgcggcgatgggcgcgaccagcgtgatcatcggcagagcggacgatccgcgcacgcgtcgctcgcgcctgggacgccgcctgcctcggccgcgccgcccgcgcctcgaatccgggttcctgccttcgtccatgccctcagtgtggaacggcgtcgccggtatgcgcaagcttgggggaacaatgtggtcgaaggctaccgagttatccacatttcggcgtgtcgtggccagcgggtggaacacgccaaccggccacgacgaggaatgcggcctgccgcatcattctgcgatcactggttggccagcgtgcccacggcgcccggcttgtggctgcccgaagcgagctctctgaacagttcgaggttcttcgcgtcatccagcagcaccgacgagccgaccccggacacgttgtagccgggattcgtccaatagacgctgccgctgatgccgttgtcggaggtggcgtcgcggaacgcgaacaccatctgtgcgagcgtgtacgggttcgtcttggaatcgacggtgatggacgccaaagcggctttcagcgtcttgttgagtttcgggatgttggtcagcgtcttgccggacatggccttcttcgcgatggctccgatgacctgccgctggcgttcggcgcggccgaaatcgcccttcgggtcggagtagcgcatgcgcgagaacgccagggcggtcgccccatcggccgtgtggcatcccgcggtccagttgagattggacagggcgtcgttcacggtctggtcatagcacaggtcgaccccgcccaacgcgtcgaccacatccttcaatccgttgaacttgatctgcgcgacgtggtcgatcttctggccggtgatggtctcgacctgctggacgagcgccttctcgccggacagctgggcgacggcgttgatcttcatataggtgccgttcacctgcaccagcgaatcgcgcgggatggagatgagcgagcgggtgccggaattgggcttggtcagcacgaggatcgtgtcggtgcggaacccggtgatcgtcttcgcctcttcgccggtgcgctggtcggatccgaggatgagccagctggtgcctgacgtgttggccttgtcggacagccagggctgcttgtcgagctgaccgtcgacccagttccacagtccgaacgtcaccagcatgatgacgaccagcagagccgccaaaacacttgcgacgatacgtcccacggggcgctttctgcgcatggcggtggctgccggcctcccggacatgccacggccgccaccctgtgcggccggcatgccgtaaccgtaagggctctgcgggccctgacgttgtgcggaggcgaacatcgactgcgcacccgcgccctcgcccggacgaggctggttcgaaatagtatgcgtggagcccgctgcacggcggggctggcgtcgggccgcagaagcggcgtcctgcatgggagagaccggttgcaggcgggcgtcctgctcggatgcggaccgcctggtcgacccggatacgcgacgcgatgaattcggcgtgaaactgggaatcacgtcctgtgcggccggcatgctttgcgctccctgagcgcctgccgaggtctgccgacgcgacggcacgcctgcctgcggaccggctccgggcacggcctcgccggcggccgacggacgcggcacctgcccgctggggcgacgcttgcgcgtgccggagggaatgaagctgggaggattgtcctgtgggctgactccactgtttccttcgctcatggttcctccagtgcctcgtgttctcaatcccttttacacgttgtcatgagtcattgtcgtgtccgttgcccattcctctgcagtaacggcacatacgtgaagggctggtggtcggatgtgacagggaatgaggaaggcatgggggtgaaggctgatgtctcttaccacactttcgcccttctgcgctgcattgacacggggcagacttgacaaaggtaagtcgcatgtgtgtaattaccctgatggacgtccatagcagcatcggcaaggaggagcgacacatgtggggagtggtcgacgattccgccgaggatccgatgagtgagctgtggggcctgttcaagtcggacgacgatgtttcctggcagcataaggccctgtgctcccagaccgatccggaagcttttttccccgaaaaaggcgggtcgacgcgtgatgcgaaacaggtgtgcgcccgctgcgaggtgcgcgagcaatgcctgcaatgggccatcgaacacgatgagcgtttcggcatctggggcggtctgagcgaacgcgaacgccgccgctataagaaggaacacaaggaacgtgcgtgacgcggcggccgtgcgtcgcatagactggagattatgagttccacaggcaatagcgatattcagcggattctggccgatgtcatggcgaacaggccatattcgcatcggcagaatgtcgatccgaccgtcgtggcggtggtgaccgttgaagaggacatgcggtttctccccgacaccatgggggcgctgctcagacagacggtgctgccgggcgtgatcgtcatcgccgattgcgccggcggcgacaatcctccggtgcaatcgcagttccaggtcattcctgcgccgtcgggactggtcagctccgttccgcagcccaagactgtcacggtcgagctggtcggcgtcaagggcgcccgttcgttctatcacggcgttgccaaggcgctgcatgacgcgcaactcgactcgtccacccgcgcggtctggctgttgcatgacgattcacggcccgcggacgacacatgcctcgaatcattgctggagacgtggcgtaacgatccgaccgcatcggtgctgggagccaagcagctggactggcaggccgaacacctgcatgacgtcggcgcgtatgcgtaccggcatcgcgtggagtcgctggtggtcgacggcgaaccggatcaggagcagtatgacggccgccgtgacgtgttctcggtgagcctcgcgggcacgctcgtctcgatcgagaccatgcacgagcttggcggtgccgacgactggttcaccacattcgccgaatcggaggatttctgccggcgcgtatgcctgagcggccggcgcgtcgtggtggtgccccaggcgcgtatcgcccatcggcgggcgcgattcgaaggggtgcgcaccaagggcggcgagcccgtggacgaggatcgtcccattgacagttcgatggctcgcatcagggggaggatgcgctactcctatacggacacgcgcctgatgatgtggccgttcgtctgggtgttcggcgtgttcgccgcgattggcaaggcgatcgcgaaactgttcgccaagcgtccgtacgaggcgctgtgtgaactggtcgccccctggacgctgtggggcggcctgcctcgcgccatcgcggcccgtcgccgcgtcagccgccaggagtcggtgccgatcggatgtctcggcgtcctcgtcgccaaccggcagcaggtggcgcagtggcatgaccgcgtacaggcgctgtcggaccagcgccatgtcgtcctgctgtcgccgctggccaaggcccacttgcgccggcgtgcgattcagcgctggctgctcgcggtggcgatggccttggtatgcttcggcgtcgtggcggtgatgcacggcaccacattgcgtgccgttctgtcgggagcgtccctgtactccgattcgctgctgccgaccggcggggacttcggtcagctgtggcgagccgccaccacgtcgtgggtgttcggtgacggcatcgccgccccgcccgcaccgtggctgctggtatggggactggcctcggtgataacggccggcaatgtgtctgccgcgatcgcgttggtgacgtttgccgcggcacccctcatggcgttgtccttctgggcgttcgccggcgtgttcacccgttccgacgcggtccgtgtcgcatgtggactgctgtgggcgtcgttcgcgctcggcctggggctgttctccgcaggcgatgtgccgatgctcaccgtgatggtgttcctgccggccgcgttcgccttcgtgttccgcgcggtgggtctgtatcgcaccgaggaccaggtgacggcccatccttccgttcaggctgcggctcttgcggcgttgtgcttcgtacccccggtcgccgccgagccccagctgatgctgtccctgatcgtggtgttcgtcgtgttcctcgccgtggtgccgcggcatcgcgcgatgctgctgctgattccgctgccgtcagggttcgtgatcgcgccgaccatcatcaacgcggtgcaccatgcttcggaagggtcgtggcgtcagctgttcggtgatgtgatggtgccgttatccgccaggaacggcgctccggatgcttccgggttcgccacgctggccatgcgtgcgttcggtgtcgatgatacggccggcaacggtctggcaggcctgtcggcggccggcgttttcggtatcggcgtcctggtgctgctggccgtggtgacggtgcttgcggtggcgtcgctgttcctgcccttcgcattgcgcgcctcgcgcatgatgtgggtcgtcacgctcagtggtggggcgcttgccgtcgcatcgtcgaggatcgtcgtggccgtcgatgatgacggtcctgtcgcgggttccgtgctgcccggcgtggtgttcgcgttgcttggtctgctcgcctgcgtcggattggtctccggaatggcggtccaccggttctccttgttgcggcaggggaatggctcgcaacccgtgctgacacgtcttgaaggccgtaaggccaaaaacgccaaggtgcatgcggtgttcgcccgtatcgggcgcggcgtgctggtggccgtgctggtggccggtgccgtgtcatgcactgcggcgtcagccatggaaccagggtcgaacggtctgcacgcgtcccgttccgatgacgggctgcccatggtcgccaccgattatctcggcaaggacgacgcgcaccgcgtgctcgccatcaccgccgaatcatccaccggcgtacggtatacgacgatgcgcacgtcacgcggcgatctgatggacagctctccggcattgcgtgcccgagtcgcggatggcggtcatgactcccgcgacgccgtactgtcgtccgcgagcgcccgactgctggtcagcgccgatgccgacgcgatcgccgatatcagcgcgttgggttacggcggcctgtatgtggtccgcccatcggctgacgatggcggctcccaggccacggaacagttgatttcgaacatcacggcgagtgagggtatccaatccgtggtgagtaacacgtcgggtgtctattaccggctcacgctcgtcgacagcgcgacgcagcgcgtgccgcaggacggtatgctgaaacagcggcatcttgcctaccggtatgcatggctcgtgtgcatgggcgtggtgatggggctgtattgtgtcgtcgcgttcccgcgcagccaccgtcgtttcatcgaggaggaccaatgagcagccaagtcaaacgcggaggcaaggtctggaaggctgtggtcggcgtcatttccacggtgatcatcgtcggcctgttcgtcgccctgctggtactgacggcatcgggccgttgggtcgactccgtctcgtcggattcggcgtccgtctcgcacgcggtgagccagaggcggatcaccgcatactgcccgtcccgcatgacattgccggatgcgtcggcgtacggtgacagcgaatatcagccgagtgaaggcgacatctcgtcttcggccggattcgccgcgttcggagcggtgtaccggtctcagttcggcgcgcttggcggctccggcgataccacgcagctcaaggacctcgaccctacggataccgcgaaagtcatcgcagcctcggccgacgtcgaccgtacgtcgctgctgttcgacacgcagctgttggaatcggccgcgggcgtcggcgcttccgcgtccgtggcgtcctgggcgacgaagggcgacctgcgcggcctgtccgcgacatcctgcgatgtcggtgcgctggagcagtcgttcgtgctgcctgacacgcagaccggcaccacccagcagctggtcgtggccaattcgtcttcgaaggccactgtggtggatgttcgggtgtggggtacggaacagtccggtgcgctggcgttgtccacgggaagcacgctgaccgtcgcggcgaacgccgaatccgtgctgagtctttccgcggccgcaagcgggcagaaggggctgtatgtcacggtttcgagccggcaaacgccggtatcggcatcggtgcgcgtgatcaggaccgaagggctgaacccgaagggatcggattacgccgccgcggccggggaggcgtccaaggagctcgtcttcccggccgtcgcggagggagacaaggcgacactcaccgtatacgcggccggttcggggtcgctcaccgccgcatgggtcgccgcggccgggcagtccgtccatcagtattcgggcgaccgcgtcaccaccatcgatctgggcgatgttcccaaagacgcgtcggcgctgaagatcacggcggatacgaaggtgacggcaggtgtgaccgtcagccgtgacgggaacgggaaccagtccgatttcgcgctgatcggcgccgcgcagacagacgaccggtcggccgccgtcattccctccggtcttgacggccgtgtgagcgtggtgaacgcgtctttatccagcaaacagatgcacatgaccggttacgacgacaagggtgccgcggtgggggagaagaccatcacggtggacgccggtgccgcggcgagcttcgacgcgtcggatttgggaaagaacgtcttcgcggtggccgccgacggcaagggactggcatggggtgtccggttgtccagctccgcggtgagtgacgccaagctcgccggcatcgcctacatcggtgccacgccgttgatgccgctgcaggagaggatctgggcgcggtcggatatgaccatcgttcactgacggtcgggcggcggaacgttccgtggtgctccctatgaggggtgctctatgaggtttcgccccgacagagccttacaggctccaatccgggtcgatctcatccggccggcggccatagagctcggcgagccgaagcaccacctcatcgcggatggccagttccagatccatgcggctgcgtgatttgctctgtatcggcatgcggtacagcacgatgcgggcggggatgccgtggctcgcagggaaacactgggacgcgaacgacggctccggctcccaaggagccggctgcgagggcggcacatcctccacggcgaactgcaccggcttgaccagttgcggccaggcaccgttcagacgccggatctgggccgcgaccatgtcgtcgaacgcgccgctgcgggtgcggtagcgcgggagccgcgtgccgaacatcggcgtgcgcatgccccgcccgtgacgattgcgatacgttggtcgttcccatggtgcctgttgcatggactccactgtaggacaagccggcggcaatgcgttaggatacttatcatcgacaaggtttcctggggaggtgtgcagatgccaacagcgaccgtgcacgcttggaatgataccggttggcgacacgacggcgcacatgcgcgtctgatcgccttcgacctggacaacacgctggccgtctccaaacaaccgatgaaaccggatatgaccgttcgcatcgaggcgctgaccgaactgatgccggtggcgattgtgaccggcggcgggcgtgaactggtcatcagtcaggtgctcgacgtgctgggtccccgagctgacctttccaacctgcatgtgatgccggcggggggatcgagctattaccgctggcgcgagggcgcatggcgtctggaatacgagaggacgctgtcggcccgggacagggacgcggccatattgtcgctgactcgacgcgcccgagagctgggcatgtggccggagcacccgtggggggagtccatcgaggatcgtggcagccagatcacgttctcggctctggggcagctcgcgccgatcgaggagaagcgtcgttgggatcccgacgacaccaaaaagcggcggctcgtcgccgcggtggcgggcgacctcggtcatctgcgcgtacgcgcgggcggctacacgagtgtcgatgtgagcgccggaaacaccgacaaggcgttcgccctgcgcgaattggcggtacggctcggcatcagcaccggtgacatcatcttcgtgggcgaccggatgacgcccggcggcaacgactatcctgccgcgcaggcgggggctatcgcgcttcaggtcaccggaccgcaggataccgtgcgtctgtgcgacatcctgctgcctttgctgggtggcgagccggttcggcaggacggatgaaccatgggatggcacggtttcgcgcgaatgctcacagaagtggccggatcgctgcgggacgtgctgctgccgcgtggctgtgcgggatgcgacatgccggacgctgtgctgtgcgatgactgtcgcgcttcgggtggcggcttcatgtcgttcgctatgcctggcacggtttcgggccgggcgattgcctgcggcgcatatcgcgggccgctgcgccgtgcgatactgcgatggaaggatcatggcgacgaggaatgcgatggcccgttcgccgatatgatggccgacgcgctgctttcgtcgggcctgctggcttcggatccgatgccggtgacgacattggtaccggccccatcctccccgcgttcgatgagggagcgcgggcggtggcatatgcgtaacgtgacgaactcattggcgcggtcgctgcggcggcgtggcatggacgtcgatacggccgcgctgctgcggacgacgaagacgagcggcaaatccgtgcagatgcacggcgccgcccagcgttcgcggcgtctgcaggggcatatcgtcatcgctgcgcgcccaccctacccacgcaacgtgatcctggtggacgacatcgtcaccacgggcaccacggcccggcaatgcgcgcaggcgctcaacgccgcgggaatacatgtgacaacggtcatctgcctggcgcgcaccctgcgcgccggcgaaaacacagacgactagccaagtcccctcccgctggcgggaggggacgcgcagcgccggagggtggtcgccacccggtcgagccgcacacccgccatccgcgcagatcaccagcgcaatccagttatttccgtcgcagccgacgctgtggatgaaaactgcccgtgaccacgccccatatcacgacatccccatgttcggaggggacgaaatcggggtagcggggattctccgcgtgcagcatggggcggccgtcgcgcgacagcagtcgcttgaccgtcagctccccatcgagcacggccaccaccacatcgccgtcctcgggcgtcagcgaacggtccacgaccagccaatcgccgtggaaaatgccggccccctccatggagtcgccggcgacggtggcgatgaatgtgtattccgggtgcttgatcacatgagcgtcaaggctgaagccctcctcccgcccgtccaaggcgggggaggggaagccggccgctaccatctcggtgacgatcggcacgggacggtgatccggtcgcgcatgaaccaccgaacgtgccgtgcaggcttcgggagcgcaattccggctcacaacagggcccgcgccgaaccgtcggtcgccggctcgtcatcggcgatatggtatttcggcagcacgatctcgaaatccgcgccgcgcgggtcgtcgaccacccggaccgtgccgccgtgcagctgtgcggcccaacgcgcgatcgacaatccgatgccggtgccgcccgattcggtgccggggccgctgcgccccttgacgaaccggcggaagatgtcggaacgttcctcgacgggaatctgagacccgaaattcaccacattcgtgacgattgtgccggtgtcggcattctcccgagcctcgatcagcacgctggtgccgtccgcggaatgcttgagcgcgttcgcgatgatattggtgaacagctggcgcagccgatcctgatcaccctccatccagatatcggaatccacgtgcagcatgatgtcgtgcgcgtgcccggcgtccgcgatctccagcggctcgatcgtctcgtcgaggaaatcatgcaggcagaaacgttcgatgttcaggctcgccgcgcccgcctccatgcgagacaaatcgagcaggaacgctatcaggtcggatagccggtgcgtctggcccagaatgccctcaagattggccggcgtgggctcgaccaccccgtccgccatgttctccaccatcgcctgcagcgcggagacgggggtgcgcagctcgtggctcacgttcgccaccacatcgcgcctcatctgatcggcgtgctgcagttcctcggccatttcgttgaacgtgcgggccaactggccgatctcgtcgttgctgttggtcgccacgtggacacggacgctgtaatcgccctccgacatcgcctcggccgcgtcacgcagctgcctcagcggcgcgatcagaccccgtgagaagaaataggtgatgcccagtgcgacgatcatggtcagcggcatggcgatccagccgctccacccgtacttgagcaggaaccagaccagcacgaacgcgatggacgtggcgatgacgatcaggacgctcaattccattttcagggacgaaaacagcccgatcggacgatcgaaatccaatcgggcctgtttcctgtcccacttctgacgcggcttcatcactgttccggcggctcgaaagcgtagccgacgccgtgcacggttcggatggtctcggaaccgagcttgtgacgcagcgccttgacatgggagtcgacggtgcgggtgccggatgcatccacccagtcccagacctcttcgagcagcttctcgcgggtgagcaccgacttgggtttgcgcgcgagcgtgaccagcaggtcgaactcggtcggcgtcaggtgcacctgctcgccgttgaccgtgaccagacgctgtgccgggtcgatgaccagcgagccgaagttgaggatcttctcgttctcggagttcttcgcgatgaccttcgcgcgttccacgcggcgcagcagcgccttgcagcgggcgatcagctcgcgcatggagaacggcttggtcatgtaatcgtcggcgcccgcgccgaggccgatgaccttgtccgcctcggcgtcgcgggcggtcaggatgagcaccggcaccgggcggtcggccacgatgcgcttggttgcttcaagaccatccatgaccggcagcatgatgtccatgattaccaggtccgggcgcagctgcttggcggcctgaaccgcgctggcgccgtcggacgccacgcgggcggaccatccctccgcggtgatgcgctgagcgatggcggtggcgagggtcggctcatcctcgaccaccagaatggtccgcggcgtcgtttgacgtgttggagaattaatcatgacgattcacctttcagttttccggtttcaagaataccgcccccaatgccggaatggtgagttttgccgaccaatcacgcgaatggtactcgcccttcaccgcggcgaacgtgccgttgtggatgtcggagccgccgtacttcttgtcgtccgtggtcagcacctcggtccagttgccgccctgcggcagcggaacctgatagtcctgccacgcctcgccggagaagttgaccacgacgacgagctgttcgcccttgctgccgatgcgcaggaagctgagcgtattgtggtcggcgtcatcgctggtcagccactggaatcccgccgggtcgaagtcctggctccagatggccggcgtgtccttgtagaactcgttcaggtcggcgacgagcttctgcacgccgcggtggtcaggccagttgagggcgtcccagtcgaccgaaccgtcatgattccactcgccgtactgcgcgatctcgttgcccatgaaggtgaggttcttgcccgggtgcgcccactggtaggcgaacagggcgcgcacgccggcgtagcgctgccagtcgtcgcccggcatcttgccgaacagcgagcccttgccgtacacgacctcgtcgtggctgatcggcagcacgtaatgctccgaataggcgtacaccatcgagaaggtgatctcgttgtggtgccatttgcggttgatgggggtctcgtgcaggtactgcagcgtgtcgtgcatccagcccatgttccacttgaggccgaatcccagtccgccggcgtcggtcggtgcggtgatgccggggtaggcggtggattcctcggcgatcatcatgacgccgggattgttcttgtacgcggtggcgttggcttccttgaggaagtcgatggcttcgaggttttcgcgacctccgtagatgttcgggcgccactggccgggcttgcggctgtagtccaggtacagcatcgaggacaccgcgtccacgcgcagcgcgtcgatgtggtattcgtcgagccagaagcaggcgttggcgaccaggaagttgcgcacctcgcgcctgccgaagttgaacacgtacgtgccccagtcggggtgctcgccgcgcagcgggtcgggatcctcgtacagcggggtgccgtcgaagcgtccgagcgcgaaatcgtccttcgggaagtgagcgggcacccagtccatgatgacgccgatgccggcacggtggaacttgtccaccaggtacttgaagtcgtccggattgccgagtcgggagtccacggcgtagtagccggtcacctgatatccccacgagcccgagaacgggtgctcggtcagcggcatgaactcgacatgcgtgaagccttccttggccacgtagtccacgagctcgtccgccagctcgcggtagttgccgatgcctttcttccagctgccggcatggacctcgtagatgctgaccgggccggcgtgcgggtcggtgtgcctgcggtggtccatccatgcctcgtcgttccattcgtggtccgattcgatgacgatggagccggtcgccggcggaatctcgtgggagcgttccatcgggtcggccttcatcttccactcgtggttcgcgttgagcagctcgtacttgtagacctcgcccgccttgacgccggggatgaagatctcccagatgcccgaggaaccgagctcgcgcatggcgtggcggcggccgtcccaggagttgaagttgccgaccacgcggaccgcgtgcgcgttgggcgcccagacggtgaacgaggtgcccacgacctggtggccgggagcaccgtcggcgccgcccatcgggtcgtcgtagcggcgaacgcgcgcgcccagggcctcccacaggcgttcgtggcggccttccccgaacaggtaggcgtccatgtcgccgatggagggcaggtaacggtacgggtcgtcctccatgacggacttgccgccctcgtaggtggtgcatacacggtagtcgggcacggcccagccgtccgcggtcttttcggccgcgatgacggtcgcgaagacgccgttgaattcgtgccgggcctcggccgttcccttctgggtgtatatggtgacgctcttggccagtggcctgagcactcggatggtgacggttccggcgtggtctccggaaccgaggtgaccgcccagcacttcgtgcgggttgtagaacgttgcattgctcaccgcgctcaaatcactttgattcactggcacgggagcgatatcttcattgatgttcgtgtaagtagccataacacagagggtaataccttcggggtactattgcgagattttggcaagtcgtgtccggagtgttcccatcgtcccggctgtatggcacaatacgtaaggttaagtatattgttgtcacggaggattcatggggtacaaggtcggcgatatggtcgtctatccgcgtcatggagcggcaagggtcgaggccattaccgaacgggtggtcaagggcgtgaagcgggaatacttgcaactcaccgtgctgtcttccgacggtctggtcatcaatgttcccgtcgagaacgcgcagaaggtcggagtgcgtgacatcgtcgacgccaatgaggtcgccaaggtcttcgagatcctgcgtacgcccatcgtcgagaaggagatgaactggtcccgccggtacaagctgaacgtcgagaagctggcgaccggtgacgtcaacaagatcgccgaggtcgtccgcgacctcgcccagcgcgacgtggacgagcacggcctgtccgccggcgagaagcggatgctcacccgcgcccgcagcatcctgacctccgagatcgccctgtccgaagaccttgacgaggccgagatccagcgtctgctcgacgtcaacctcggtttctccgagccgaagccgggcgacgagaagcatcacagcgaggcacccgccgagcctgccgaccggaccctggcccgcatcgaatccgaaagcaagaagtcccggcgcaagtagccggcgacgagcatgtccatgaacgctgttccagcgattggtcaagggtttgacgcgcatcgtttcgccgaggatccagcccggcagctatggctcgccgggcttttatgggatggcgtcggtatcgagggggattcggacggcgatgtggccgcccacgccctgatcgatgcgctgttgtccgccgctgggctgggagacatcggcggactgttcggcgtgggagccgatgctccgggagccggcatgcacggctgcgatatgttgcgaagaaccgtcgatgtattgcgatcgcatggaaggatgccatccagcgccagcgtggtcatcatcggcaatcgtccgaagatcgggcgacgccgggaggaagccgagcgcgcgctgtcggatgccgtcggatgccgggtgacggtgaccgccacgaccaccgaccatatgggattcaccggccggggcgagggaatcgccgccatcgccaatgcgctggtgatgtaatcgagcggaatcatgcgaatctcagcggggattcgcatgattccgctggataacgcccgcattcgcccgattcgcgggcgtcgtccagagtaatcagcgatgacgcagcgacgtcacgcccttggcgatcgcccagaacagcgtcgacaacgtgacgatgatgaagctcgggggagcggggaacatcgcggacagcaccagaccgccccagatcgacatcaggcacagcaccgtcgcgatcaccatcgccttgaacggcgaggcgacgatggcgttcgccgtggcggccggggtgatgaccagcgcaaagatcagcagcgtacccaccgcggggaccgcgatggtgatgacgccggccatgatcgccatgaacgcaacgttcatcagcccgataggcacgcccttggcctgcgccacctgttcgtcgacggagctgaacagcagtggccggtacacgatggccagcacggcgagcaggatcacgtcgaacacggcgaagccaaggatctgatcggtggttatagtcaggatcgagccgaacagaatggactgcatctgctgtgacgcggacgacgagagtcgggcgaagaacagtccgaggccggtggcgaaggcgagcacggtgccggtggcgatctcccgctgcgtggcgcgcttgcccaacgctccgatgaccagcgcgccgcccagcgcgaacactcccatgccgagcgagaccggcagccccagcagcaccgcgccggtggcgccgggcagtccgatatgggccagcgcgtgcgcggcgaacgtcgaatggcgtgcgatggtgaaatatcccatcacgcccgcggcgagcgagatgcacaggcccgcgaggaaggcgttggtcatgaacggggcggacagggtgtacatccagtcgggatcgaaggagaaactgatgccggtcattgtgcccgccctttccgctcgtggtattcgtgatggtggaattgtgcgacctcgctggtgtcatgcgtgtcgggaacgacgtcatccgcctcgtcgggggtgggggtgacgaacatgtccccctgcggcgtggtgacgacctgaactttggtgccgtacaggtgcgtgagcagcttggaatccagcacgtcgttcatcgccgcgtagtgaggatgcccgtccagcagatagacggcgccggtcaggatcggcagcagcatattgagatcgtgcgcgacgacttggatcgtcatgccgagctccttgttgagccgtgccagcacatgcaccacggcgcgctggctggccaggtcgagattcgcgagcggctcgtcgagcatgagcagtttcgggtcgcataccaaggcctgcgcgatggcgacgcgctggcgcagaccgcccgaaagctcggacagccggtagtgggccttgtcggcgatgccggtgaaggtcatggcctccttcaccttcgcgcgttgcgccttggtgacgaagtggacgccgaaacgggtgccggtcaggccgagcagcaccgactgctcggcggtgagattggagtcgatatccgaagtgtagctttgcggtacgtacccgatctggcggttcatctcgcctgccgggcgtccgagcacgtgcacggtgcccccggcgagtgggaggaggccgagctccgttttcatcatcgtggttttgccggtgccgttcgtgccgactatggcggtgaccgaacccgccggtatggagaagtcgccgtgttgccagatcagccgttcgccgcgtttcaccgaggcgttgctgaacacgatgcagtcgggccgttgttcctggtcgccgctgttgctgtgcatatgattcatcgtcctgtctgtacggggccggcatcacgtccgccggtgcgacatgtacggcaacgcattatcgcaaaggactatgacaatcattctcattagcggtggcggactcattagcggcgggggagacggcaatggtaacggtctggagcgggcgggcgaactcagttgctgctgccggcgccggtatcgcttttgtcgtcagcactgttgccggcatcgttcttggcgctggcgccgtctttgccgtcggaactgccgctttcgtcgctgtcgtcgatgatggcgcgggagacggtcttgtcaagccgggccaccagatcggcgatccaatcagtcagcgtcgtgtacgcctgcggcatctgctcactgacgtcgaacacggggacgccggcccgtccggccgtccctgtcagcatgttggtggcgtcgctggattcctgcgtgttgttgaccagcacgctgatgccttgtgattcgatcagcgactggaattcctgcaggtcggccggggcaggttcgccgcccgaggccgcggatcgggcgaaccccttgggagtgtcgtcctggaagcccatgtccgacatcaggtagtacgccacggcctccgtcgcaccgtacgtggcgttcttgcggttggcggcgaactcgcccatcgacttctcgatggccttttcctccttttgccatgccttgaggcgcgactggaacgccttcttcttggcggggagcgccttggaaaatgcctccgtcagttcggtcgccatgccgttgcgggcgtccttggagaaccataggtgggggttgtcgccttccatagctccgaccgtctcggcggccgagacgatggtcgagttgcggcctacggacttggtcgcccatgagtcgtatccggcgccgttcgacacgatgatctgcgctttctgcagcttggcgacatcggatgttttcggttcgaaatcatgcgcgtccacattcgtggagctgaggatggaggtgacgttcacgtcggtgccgccgatctgctcggcgagggagccccactggttgatggacgcgacgacggtgatcggtccggtcggctccttcgcggagggccgctcggattgcgagccgccgccggtgccgcaggcgctcgacgccatcagcatgcctgtggcgaggatggcggcaatgccggtgaccagacgatgcgggtgaatgttcatatcgctgccttcttcgaatatgccgtcgacggtccgccgtcggattgtcattgacctgagtccacgatagcctaacgctacgaagaatgaacgaactctagggaaggacgcacatgaccatcaaactcgatggcaagcgggtcgcggccgaggtcaaggcgaacctggcggaacgtgtttcgacgctgaaggagcacggcatcgtccccggtctgggaacgttgctggtcggggaggatcccggttcgatgaaatacgtcgcgggcaagcatgccgactgtgcggaggtcggcatccgttccatccggcgcgaccttcccgccgacgcgagtttcgatgacatcgccgctgcggtgcgcgacctgaacgaggatccggcctgcaccggctacatcgtgcagctgccgctgccgcgcggcgtcgacgagaacgcgatcatcggcctgatcgatccctcgaaggatgccgatggcatgcacccatacaatctcggcgaactcgtgctgcatgtgcagggcgacatcacgaccccgctgccgtgcacgccgcgcggcgtcatcgaactgctcgacgcctacgacatcgacctgaacggcaaggaggtgtgcgtgctcgggcgcggcatcaccatcggccgcacgatcggtctgctgctgacgcgcaaggcggtcaacgccacggtcaccctgtgccacaccggcacgcgcaacatcgccgaccacatgcgtcgcgccgatgtcatcgtcgcggccatggggtcagccgggttcgtcaagcccgaaaacgtcaaggacggcgccgtgctgatggacgtcggcgtctcccgcgtgttcgatgagcagactggccgtttccgcattaggggagacgtcgacaaggcctgttatgacaaggtttccgcatactctccaaaccccggcggcgtcggtccgatgacccgcgccatgctgctcgccaacgtcgtggagatggccgagaggaaaatgtagccgaattcgggcgtgtcgcgctggtttttccgcccattttgggcatggctgtaggtatcctgataacttgtgtgtgctcatatgggtgcacacgtataactgaatatcgagtaattattcatccactattagaaaccatatatttacatggcagagaacaacactgaagtcaccaaggtcgccatcaacgacattggcaccgaagaggacttcatcaaggcagtcgattccaccatcaagaacttcgacgatggtgatctggtcgaaggtaccgtcgtcaagatcgatcacgacgaggtcctcctggatatcggctacaagaccgagggcgtcatcccctcccgcgaactttccatcaagaaggacgtcgatcctgacgaggtcgtcgaggtcggcgacaccatcgaggcccttgtcgtcaccaaggaagacaaggaaggtcgtctgatcctgtccaagaagcgtgcccagtacgagcgcgcctggggcgacatcgagaagatcaaggaagctgacggcgtcgtcgagggcaccgtcatcgaagctgtcaagggcggcctcatcgtcgacatcggtcttcgtggcttcctgcccgcgtccctcgtcgaaatgcgtcgcgttcgcgacctctccccgtacatcggccagaagatcaaggccaagatcctggagctcgacaagaaccgcaacaacgtggtcctgtcccgccgccagtacctggaggagactcagtccgaagtgcgcgagaccttcctgtcccagctcaagaagggccagatccgcgagggtgtcgtgtcctccatcgtcaacttcggcgcgttcgtcgatctgggcggtgtcgacggcctgatccacgtctccgagctgtcctggaagcacatcgaccatccgtccgaggtcgtcaaggtcggcgacaaggtcaccgtcgaggtgctcgacgtcgatctcgaccgtgagcgcatctccctgtccctcaaggcgacccaggaggatccgtggcagcgcttcgctcgcacccacgttccgggccagatcgtcaagggcaaggtcaccaagatcgtccagttcggtgtcttcatctccgtcgaggatggcatcgagggcctggtgcacatctccgagctggcgaaccgccacgtggagaacccggagaccgtcgtcaagtccggcgaagaggtcttcgtcaaggtgattgacgtcgatctcgatcgtcgccgcatctccctgtccctcaagcaggccaacgactccgtcgacccggcttccgaggacttcgatccggctctgtacggcatgccggcagagtacgacgagcagggcaactacaagtaccccgaaggcttcgacccgaacaccaacgagtggatcgccggttacgagaagcagcgcgaggaatgggaatcccagtacgccgccgcccacgaactgtgggaggagcacaaggcgttcgtcgccaaggagctggagaacgccgcggcttccgctgccgaggatggccaggctccgaaggaagagaaggtcgaggagacctccaactactcttccgacaactcctccacgggtactctcgccgactccgaccagctcgccgctctgcgcgatcagctgctcggcaagtgagtcatcacatcccgagaagaagtagaatgccggtaggatttgccggcagataggaaaacgggaatcgccccacacgggtggttcccgtttttcatattccgctcccgccggcgggagcggtcgagcatagcgagactgagggtggtctttgcgcgatgccggtcatcctcacttcccggctgccttgaacaaccgcgacacgcccggatatccagcaagcctgccatgcgcgaatcagtgaaatggcggaatgctgcgagagtccaaaaaatcgccttccatctctgccacgaaaccgggcgtgtcgcgaatagcatgatgtcatgagcattcgtatcggactgaccggaggcatcgccgcgggcaagagcaccgtcgccgcccggatgcgggaactcggcgcgctggtcatcgactatgacggacttgcgcatgagatcgtggcgcccgggggagtggcgttgccacggatcgccgccgtgttcggcccggacgcgctgctggccgacggatcgctcaatcgggcgtggctcgccgagcgtgtgttcggccgtgacgccgctcccggcgcacgcgaacggttggacgacatcgagcatcctctgatatatgccgaagccgcacggctggagcgacggaatcccggcgcgaaggtcatcgtccatgacgtgccgctgctcacagaggtgatccggtcgattccgttccaattcgatcacatcgtcacggtggaggcgccggaacagatgcgcatcaggcgcatggtcgcgacgcgcggcatgaccgaacggcaggccgcagaccgtatccgcagccaatcgagcacagccgagcgccgggagcttgccgacatcgtcatcgattccacccgcccgatccccgacatgctggcgcaggtcgatgggctgtatcgccggtggaaggctcactgaatcattcgcccgtgaaaaggtgtgagcccggcagcgccgcaaaacgcacatgaaacccgccaaatcactgtatttccaagacatgcatgttttgtgcgattgtgctgtcttgtgcgttatcctcgcacttttcttattgagaaccgttcgctgaacggatggcggtaagctggaagccatgggattcaacatcgagcgcgcagacaagccattcgtcgtcaaatcaccgtacaagccgtccggcgaccagccgcaggccattgaggagctggccacccgcatcgagaacggcgagaacgacgtggtgctcatgggagccaccggtacgggcaagaccgcgacgaccgcatggctcatcgaacggctgcagcggccgacgctcatcatcgagccgaacaagacactcgccgcgcagctatgcgccgaattccgcgaactcatgcccgacaacgcggtcagctacttcgtcagctactacgactactaccagcccgaggcgtatataccgcagaccgacacgtacatcgagaaggattccaacatcaacgacgatgtggagcggttgcgccatcaggccaccgcgaacctgctcacgcggcgtgactgcgtggtcgtcgccaccgtttcgtgcatctacggcctcggtacgccggaggagtacgccggccgcatgctgttcctccaggaaggccagcagattgaccgcgatcagctgcttcgcaagttcgtcggcatgcagtacaagcgcaacgacatcgcgttcacgcgcggcacgttccgcgtgcgtggcgacaccgtcgagatcataccggtatatgaggagctggctatccgcatcgagttcttcggcgacgagatcgaccgcatctccacgttgcatccgctcaccggtgacgtgatcgaccacgagacctccgtgcacatcttccccgcctcgcattacgtcgccggccccgagcgcatggagcatgcgttgaagaccatcaaggaggagctggaccagcgcgtggccgaactcaagaagcagggcaaggagctggaggcgcagcgcctgaccatgcgcaccacatacgacctggagatgctgacacaggtcggcgtgtgctcaggcgtggagaactattcgcggcatttcgacaaccgcgcacccggtacgccgccgcacacgctgctcgacttcttcccggatgacttcctgctggtcatcgacgagtcgcatgtcaccgtgccgcagatcggcgcgatgtacgagggcgacgcgtcccgcaagcgcacgctggtcgaacatgggttccgtctgccgtccgcgatggacaaccgcccgctcaaatggccagagttcctggaccgcgtcgggcagaccgtatacctgtcggcgacgcccggcgactatgagctcggtctgtcggacggcgtggtcgagcagatcatccgaccgaccggtctggtcgacccgaagatcgacgtgcgcccgaccaaggggcagatcgacgacctgctcgccgagatcaaggaccgcgtcgacaaaaacgagcgcacgctggtgacgacactgaccaagaagatggccgaggatctgaccgactacctgctggaacgcggcatcaaggtcgaatacctgcattccgacgtcgacacgctgcggcgcgtcgaactgctgcgcgaactgcgcgaaggcaagatcgacgtcatcgtaggcatcaacctgctgcgagagggactggacctgcccgaggtatcgttggtggccatcctcgacgccgacaaggaggggttcctgcgctcgtaccgctcgctgatccagaccatcggtcgcgcggcccgcaacgtatcgggcacggtcatcatgtacgccgacgagaccaccgacgcgatgcgcaaggccatcgacgagaccgaccgtcgccgtgtgcggcagatcgcctacaacaaggagcacggcatcgacccgaagccgctcatcaagaagatcagcgacgtcaacgacatgctcgccaaggaggacgtggacacggccacgctgctcgaaggcggctaccgcaacgcgggcaaggccggcaacacccatctgggtgtgccctccctcgacgctgcggaggccgacaagcgacatgaggagatactcaaggcggggcttcccgcgcaggatctcgccgaccttatccgtcagctgagcgagcagatgcacaccgccgccgaacagctccagttcgagctcgcagcacgcctgcgcgacgagatccgcgacctcaagaaggaactgcgccagatgacggaagcgaacaagtgagcatttcgtgacagagagcgtcacagccctttcctatgctggtagacatgtctgaaacccctgtcgcttttatgatcgccacctttgcggtgctgatcgcatttttcgttgtggatctgttcgtcatcggccgcaagccgcatgtgcccagcaccaaggagtgcgtgcagcacatcgcctttttcgtggtcatggcgctgattttcggcggactggtatggtgctttgccggttcgaagcccgcgatcgaattctattcgggatggctcaccgagtactcgctgagcatcgacaacctgttcgtcttcgtcatcatcatgtcgaacttcgccgtgccgaaagtgctccagaagtacgtgctgtccgtcggcatcaccgtcgcgctgattctgcgcggctgcttcatcctggtcggcgcggccattattcagcggttcacgtgggtgttcttcctgttcggcgccttcctgatctatacggcgatcaagctggtcgtcggaggcgatgatgatgaggaataccatgagaacggcctgatccgcatgctgcgcaaggtgattcgcatcaccgacgattatgacggcgagaagctgcgcaccgagaaggacggcaagtcgtactggactccgatgctgatcgtgttcctgaccatcggcacgacggacgtcatgttcgcgtttgattccattcccgcgatcttcggcctgacgaaggatccgttcatcgtcttcacgtcgaacgtgttcgctctgctgggcctgcagcagctgtacttcctgctgggcgcactgctcgacaagctcgtctacctgccggtcgggctcgcgttcgtgctcggcttcatcggcatcaaactggtgatggaggcgttgagcggcaatacgctgccgttcatcaacggcggtcacccggtctcttgggtgcccgaggtaccgacgtgggtgtcgctggtcgtgatcgtcgtcgccatcggatcgtcggccatcgcgagcgtcatgaagatgaagtcggtcgaggccgcgaagagcgaagcctgagccgcccaaaaaaatgtgagcgctcacaacacgcccgtgaaaacagtggctcacgtcgcccaaacctagtacacttgcctgtggcagtggaagtcgcaagacttcttcctagaagaaatcacataagaataggtaggcattcatgcgtaaagccaagatcgtagacaccatcggtccttccaccgagtctcccgaaggcatcaccaagctgattgaggccggtatggacgtggcccgtctgaaccgttcccacggcactccggaggatcacctcaaggtctacaacaacgtgcgcgcggcctccaaggcgaccggtcgtaacgtcgccgccatggtcgatctccagggcccgaagatccgctgcggctggttcaagaagaacgccgagggcgaggacaaggtccagcttgaggaaggccaggagttcatcatcaccaccgacgatgtcgaaggcgacgagcacatcacctccaccaccttcaagggcctgcccggcgactgccaccccggcgacccgatcctgatcgacgacggcaaggttcgtctggaggtcaccaaggtcgagggcaacaacgtgcacaccaaggtcgtcgttgccggcccggtctcctcccacaagggcatcaacctgcccggcgtggccgtgagcctgcccgccctgaccgagaaggatgaggccgatctgcgttgggccatccgcaccggcgccgacatcatcgccatgtccttcgtgcgtttcgccaccgacatcgaccgcgcccacgagatcatggacgaggaaggccgtcgtatcccgatcgtcgccaagatcgagaagccgcaggctctggagaaccttgaggacatcgtcaagacgttcgacggtgtcatggccgcccgtggcgacatggccgtcgagtgcccgctggaagaggtcccgctggccaccaagcgcatcatcgagctggctcgtcagtacgccaaggacaggttcttagcgacgggtcccttgagctcgccgtcctcggtgaaggacacgtaggcgaggcccttggcgccgcgctgcttggcccactcctgccatgcgtcgaactgacgacgcggggtggcggcaccgcccttgaagacgacggcgccgacgtagtcggcctggaacacgcggaacggcgtgtccttgaagtattcggtgagctcgacgagcgggttgccgaaacgcaggtccggcttgtcggagccgtacttgtccatggcatcctgccaggtgatgcgctgaatcggcagctgcacgtcgtagccggcggacttccagatggcggcgatgaccttctcggccatggccatcacgtcctcctggtcgacgaacgccatctccatgtcgagctgggtgaactcgggctggcggtcggcgcggaagtcctcgtcacggtagcagcgggcgagctggtagtagcgctcgacgccggagaccatgagcagctgcttcaagagctgcggggactgcggcagcgcgtaccaggagccaggcaccagacgggcgggcacgacgaagtcgcgggcaccttccggggtggacttgatgaaggtcggggtctcgacctcggtgaagtccatctcctccagcgcgtggcgggcggccttggccatgtcggagcgcagcttgaggttgtgctgcatggacggacggcgaaggtcgaggtaacggtacttcagtcgcacgtcttcgccgggcagcttgttctcggactcgttttcgagcgcggtggacacctggaatggcagcgcatcggacttggcgagcacatcgatggtctcgacgacgacttcgatcttgccggtggccagatgcgtgttctcgttgccgtccgggcgcagacgaacctcgccggtgacctggatgacgaactcggagcgcagcgggcgcgccatctcctcgtcgtagatgacgatctgcaccaggccggtgttgtcgcgcaaatcgatgaacgccacgccgccgtgatcgcggcgacgatcgacccaacctgcgagcgtcaccttctgaccgacgagtgcttcggtcacctcggtggcatgatgtgttctgtaagccgtctggctcatgcttcctctttcttatgcaatctatgcaatggtttccctgcaacgcgcgcccgtccccggcagaggacgggcgctgacgaaaatcagtcgattacaacggtttgccgggcatacacagtatccggttgccacgacttgggatcggccggctgctgatcgccggtgacgatgttcttgacctcgtcggatgccgtgtcgtcgccgtccgtcgcgccagccgggaaccacacatacgggatgccaagcttgtcggcatatttgatctgcttgccgagtttggccgcggtgggtgcgacgtccgcggcgatgccgcgggagcgcagcgtgttcgcgatgaggttcgcggcggagcgatcctgctcgttccacacggcgacgagcacggatgccggggagacgcggctggcgtgcgctccggcggagtgcagcatgtacgacacgagacggctcaggccgatggacaggccgacgcccgggtacttgcggttgccctgcgaggcgaggttgtcgtaacggccgccggagcagatcgagccaagcgacgccgccccgtcgaggaaggtctcgtatacggaaccggtgtagtagtcgagtccacgggcgatcttcaggtcggcgatcaccgcgcccgggcggatgagggcggcttcgtcgacgatcatcgcgagcgtgtccagtccctgccgggccagcatgtacgcgtcggaatcgtccgcgatgccgtgcgcggcgcacagcgcgtcgaacttgtcggcgagctccttgccgtcggcggcggtgagttcggccagttccaggcaggcgcgggcctgcgcttcatcggcgccgcacgtgtcgacgagcagcttcgccacttcgtccgcgccgatcttgtcgagcttgtcgatctcgcgaagcactccctcgatgtcggtcaggccaagtccgcggtagaagccttcggacagcttgcggttgttcgcgtgcacggtcgccttgggtaggccgaacgcgcgcagctcctcaagagccgacaccatgaccagcggcagctcgacctcgtaatggtcgggcaggtcgccgttgccgatcacgtcgatatcggcctggacgaactcgcggaaacgtccttcctgcggacgttcgccacgccacaccttctgaatctgccaacgcttgaacgggaacgcgaggtcgccggaatgctcgaccacataccggctcagcggcacggtcagatcgaagtgcagacccaaccggtcattgaccggcgtgtcggattcgtgcccgacctcctgcagacgggacagcaggtaaatctccttgctggtctcgcctttcttgagcagactggagccctgttccaccgcgcgtgtctcgatgccgatgaaaccgttgagctcgaaaaccctacggagcgtgtcgatgacacgctgctccacaacacgttcagaggggagccactctggaaatcctgatattgatgcgcctttagccacgattccctataataggggaggttgcggaaaaatccattcggatttttccccagccaacgactaccttcaagcttataaggagctggccatggccgacgagactgccaccatatccgacaacaccaccgaacccaccgagcaggcaacgacgcccacaccggcaccgacccctgcatccgcgccgaaaccccacgccccttcgccggccgcattcgccaagaaagcggtcaagcgccccgcccccgccgcttcggcatccagctattcggacgccgaggtgaagacggccgaagcgttcggccgcgtcgacgacaacggtaccgtgtacgtcagggagggcgactccgagcgtgaggtcgggcagttccccgacgtctccaaggaggaggcgctgtcgctgtacgcccgtcgttaccttgacctcaaggccaagttggatctgctggcgagccgcctgcattccgacacggtgaagtcgcacgagatcgacgagacgctgaagtcccttgagcaggagaccgacaagcccgcggcggtcggcgacatggccgcgctgaagcagcagttcgagcagctgaaggaggccggtgccgcgaagaaggccgagctcaccaaggcccgcaaggcggcgatcgccaaggctgtcgaagaacgcaccaagatcgtcgagaaggccgaggccctcgcatcctcgctggatgacgagatcaactggcgttccaccgccgacaagttccgttccctattcgaccagtggcagcagcatcagcgcacgtccgtgcacatcgacaagccgcaggccgacgcgctgtggaagcgtttctccgccgcacgcaccacgttcaaccaggcccgccgcaagtggtcgcaggcccgcgacgtcgagcgcgcccatgccaaggccgagaaagaggcgatcatcgccgaggcgaaccagctgaaggactcgaccgcatggggcgagacctcgcgccggttcaacgagttgatggaccgttggaagcgggccggccgcgtcggccgcagcgatgacgacgcgctgtgggcgcagttccgcaaagcagccgacgagttcttcaacgcgcgtcaggccgaccgtgaccagatcagcacctccgagaaagagaacctcgccaagaaggaggagctgctgaagaaggccgaggccctggtgcccgtcgccgacgaggccgccgcgaagaaggcgcgtcaggcgctgggagccatccaagacgagtgggatcagatcggctatgtgccgcgcgacgacatgcgccgcatcgaaggccgtctcgacgccgtcgacaagcagatcaaggccgtcgaggacgccgcgtggaagaagaccgatccggaggccgacgcccgcaagtccagcttcgaggagcagctgaccgctcagctcgccgagcttgacgagaagatcgcggccgagtccgacccgaagaagaaggccaagctggaggcggagaaggccaccaaggagcagtggctcaacgctatcaagtaggccgattcgctgtccggcccggtgtgtcggccggccgccgtcgtcaggacggtcggccgacacaccgattaccggctgtcatcgtctcgttggcatgggcgtcagggaattctcccccggcgctctttttttgtattacgacaccgcggacgctacgacagtggtcaggtttgatgcgttagaggcacacgggcatacagcatccaagtgccgtcctcgacctcggtgcgcagcatgccgccgaaatggagcagtctgtcacgatacaggccaagtcccatatgtgtggagaccgccgtctcacttttatcggccggatgagtcacggaattgtactgggtgacttctgcgacgtcatcgtgaagcatcacgctgcaatcgaattcgcaacctgccgggcagtgccggatgatgttatgggcgatttcattgagcggctcgccaagcagcgtcatatgatcgggtcgatgtcttccatgagtccattgtcgtgcagcgcgacccctccatggaatcccttgccggcaagctcttctcgaagagcgtcacatagtcgacgcaaccgatcaacggataccgcgtccgcccgagtcgtgcacctgcgtggcgtaatcgagcgtctgagcgtgatgttcctgacgctcccgctccagcatgcgctcatgcgcctgctcacgggtccgctgccgacgcatcatcatactgagcaacaggccaagcagaccggcgaatacgatgacagcaatcatgaataggccgttcgttacattcaggtatgacaaaccaccggccatatgaattgcatgaagcagctgcttttccggaaatatgtcacggttggcttcagcaggttgttagctgtcgtggtcatgagacttatctcggagccggtcgcctcggcaatctcggcggccttgaattcttcgttcttgagcctgttcttatactcctgcacatactgtgcgggaatgtcggcgctgaccatcctctcagcgtcctgtaccaacacgacggtgaccaactcgttttcgggagaggttccgtctgcatgtgcaattggtatcgcatgtcatagcacaggccaaagtaatgatcgcggccagatactttctgacggccgactgcttcatggcaattcctttctgccaacacttcgttgtgtcggtttccactgcaggatggaatcgcatggtgggagtatgggtgcgggtgatttgccgtcctgaggacggcatgagtgggaggatattgcagaccacccccagtcgcttcgcgacagccccgccagcgggagccaattcacgcccccgctgacggggctgtcgagtgtagcgagactgggggtggtcagtcggcggtcaaccggtacccgatcaggcctcctgcgaggcgggagcggcgttgtcagccgacttgtcagctgactcctccgttgccggctccgcagccggctcgttctcgggcttggcgtcgtcgaactgttcgccgcggaaggtgaactcgccgaggatgccctcgccttcggagtcgaccaccacgcgctgaccgtcttcgagttcgcccatcaggatcttctccgagatggcgtcctcgatgtcgcgctggatcacgcggcgcagcggacgagcaccgagcagcgggtcgaagcccttctgcgcgagcaggtccttagcggccggggtgagctccagcgacatgtgacggtcgaacagacggtcgttgagctgcttgatgtcgaggtcgacaatctgacgcacctgcggctcggtgagctgacggaacacgatgatgtcgtcaagacggttcaggaactcggggcggaactgctgcttgagttcggagctgacctgatccttcatgcgctggtagctggactccgcgttcgagccaaggttgaagccggtgttggcggccttggcgatgtcgcgcgtacccaggttggtggtcaggatgatgatggtgtttttgaagtccaccttgcgtccctgaccatcggtcaggtgaccgtcgtccagcacctgcagcagcgtgttgaagatgtccggatgggccttctcgatctcgtcgaacagcacgacggagaacggcttgcggcgcaccttctcggtgagctcgccaccctcctcgtaaccgacgtatcccggaggagcaccgaacagacgcgatgccgcatacttctcggagaactccgacatgtccacgcgaatcagcgcgtcctcatcgtcgaacaggaactcggccagcgccttggccagctcggtcttgccgacgccggtcgggccggcgaagatgaacgagcccgcaggacgcttcggatccttgaggcccacacgagtgcggcgaatcgaacgggacagcgcggaaaccgcttcgtcctggccgatgatgcgcttgtgcagctcggactccatgccgagcagcttcttcgactcggcctgggtgagcttgaacaccggaatgccggtggtcgaggagatcacctgggcgatcacatcctcgttcacgaccatctcgacatcggactcgccctcgcgccaggaggattccttctccttgcgctccgcttccagcttctcctggttgtcgcgcagctcggcggccttctcgaagtcctggtccttgatggccttgtccttctcggcggcgactttcgcgaccttctggtcaagttccttgagctcgggcggggcagtcaggcgcttgatgcgcagccgcgcgccggcctcgtcgatcaggtcgatggccttgtcgggcaggttgcggtcctggatgtagcgggacgacagctccgcggcggactgcagcgcaccgtcggtgatggtcacgtggtggtggttctcgtagcgcgagcgcaggcccttgaggatttcgatggtctccgcgattgtcggctcatgcacctgaatcggctggaaacgacgttccagcgccgcgtccttctcgatgtacttgcggtactcgtcggtggtggtggcgccgatggtctggagctcaccgcgagccagcatgggcttgagcatgtcagacgcgcccaaggcgccgtccgccgaaccggcaccgacgatcgtgtgaatctcgtcgatgaacagcacgatgtcgccgcgcgtcttgatctccttgagcaccttcttgaggcgttcctcgaaatcgccgcggtagcgcgagccggccaccatggagcccagatccagcgaatagacctgcttgtccttcagcgtctccggcacgtcgccggcgttgatcttctgcgcgaggccttcgacgacggcggtcttgccgacgcccggctcgccgatcagcacggggttgttcttcgtgcggcgcgacagcacgaccatgacacgttcgatctcgttggtgcgcccgatcaccgggtcgagcttgccctcggccgcttcggcggtcaggttgcgcccgaactggtccagaatggccgaaccggtctggctgcgcttgtcctgcacgccgccggcgttggccagatcgcccttgccggaggcgttggcgccgccgctgttgccatggatcatgtcgatagtggccgaacgcagttcgcccaggtcgacatccatcttgatgagcacctgggtgcccacgccctcaccttcgcgaatcaggccgagcaggatgtgctcggtgccgatatagctgtgaccgagctgcagcgcctcgcgcagactcagctccaacacctgcttggcgtgcggagtaaagggaatgtgcccgttgggggcggcattgcctttgccgatcatctcctcgacctgcttgcgggtgtcgtccaaggtcactcccttggatgcgagcgccttggcggcgaccccctcaccttcgcggatcaggccgagcagcaggtgttcggtgccgatgtagttgtgctggagagtacgcgcctcttcctgcgccaacacgatcacgcgccgtgcacggtcggtaaaccgttcgaacatgcttgtccttccatctcgatagtccacaccactctaccgattcgcgatgacgtttatgcctttcctcgcgataattgcgctcataacgcaatgaaaaacgatatgctgaatataacatgccaacaaggaggatgtcatgacgcaaccagatgtgaacatcgagtccgagccgcggacgtcggacggagccggcgacatcgtcgttggggtggacggctccgaggagtcgttcacggccttgcagtgggcgctcagggaggcgtccttgagcggcagggcggtcaacgcggtctatgcgtggacgcattcgtgggatatgggagctcagccggacaatcccgacgcgtgggagaaggcgagcaaggccatcaccgagcaactgctggattgggtgaatgaggcgagcgccggcatcgcattcgacccggataacctgaagctcacctccgtgcacgcctccggcacgactggactgctgcagatcggagcggatgcccaacagatcgtcgtcggccgccgatccctgggtcgcgtgaccagatggttcgtggggtcgctgtcgtcctccctcgccgaatccgccaaggtgccggtgacggtggtcaggatcgccggcaacgaggacaagagcgtgcaggatgatatcgcgcattcgctcgcccccggtatgccgatccaccatgatgatgagctggccgcggccaagggcaaacgtccggtggtcgtcggcgtggacggttccgagacgtcccgtcatgcgttgcggttcgccattgatttcgccgcgctgcatcacgccccactgcaggtcatgttctgctggcagctgaaggatctgggcgaggtgcccggctatgagaacgcgatcgcctcgatcggcgccggtcaggatcacgcgcaggacatcgtccgtcgcatgatcgagcaggccgatattcccgacgggcttcaggtgacgggcaaggcgttccacatcgcggcggccaagggcctgaccacggcatcccggttcgccagccatctggtcgtcggatcccgcggtctgagcggcttggacgcccgtttcctcggttccgtgtcgaggcagatcctgaacttcgcggagtgcacggtcaccatcgtgcactgagcgccatcgcgcgctggcccggatgcgcaaccccggatatagacgaatcgcctgtgacaccgcttcgcgtggtgtcacaggcgattatcgttccatcgtcattccgccattcggtcgccgtgacgttgcccgtgttgcgggcgattcgggtcagcgcgtttcaggcagctgggatttgaggatgatcgtgcccttgggcacgtcgaacggcaggccggcggcaccgagcttctcgatcagctccacttcgccgcgctcgtcccgcggcgcctgcgcgatgacatcgatatgcaggtcgtcgaacgcgggcttggattgaatccacatgtggctcggctcgggcggctcgatttcggaatgttcgccgcatccgtggtcgagcgagacgaccttgccgtcgtccgggctccacttgttcgcgcagacgccgaacatttcgctcagatcgccctgcaacgcgacgaagaacccgcaggtggagcacagattgcccgacgcggtcttggtggacaacgacttggggccgcgagggccctcataccagcgctgcgcggtctgggcgcggcccagcggggacagcacatggcggcgggacagatcgaatgcgctcaccgcgtcatcgacatcctccgcagctgtggtgggctgagcgtcctgggactccacaggttcgctgtcgggcgcctcagaatccgatgctccggtatccgatgcctcatccgcggcatcgaccttgcccggggccccggccgcctccacgtcccgtgcatccgaaacgcgcgtgtcaccggtctcggcttcggcggtcgcccggaaaccttcctccaaccgcggatcatccgggtcggtgccgatggagtcggtcaccgacaggtcggtcggcagcaaacggtccttccatggaatccattccggagggcgcagcgcctgttccatgggaataagcgttgactcgttcaccgtccacgtgtcgcgttcgacatcgtggaacatcgtcacggaccactgccatccctcgtagccgcgcatcagcgagacgaaccggtaatcggtgatgccgtcaccggcgtcgatggcctcgacgaactctccgacgccgttctcgtcctcggcagcctcgacggccatggcacgggcagcgtctttcgggtcgatggaggcgatgggcgaatccgcgataccgggttcgtccacaaccgtctcaggcatggtcgtttcaggcatgtactatcccctgtcccctcattcctgcacgtcgaagctgtcagccacgccacgcagcagtgtggcgagcttccggctgtcggcggcggagggataccgatggcgacgcagctcgttgcccgcggaatccagcaacttgataaggtcctccacgatggcggccatatcatccggcttcgggcgggtcgccttgaccagggacggcacggatgcgaccagcgtcacacccatggcctgtggccccttgcggccgtcgatcacggagaactccacgcgggcgcctttgcgcagggtggtcacgccatccggcagagccgctgcgggcaggaacacgtcctcgccctcgtcgttcgtaatgaatccgaatccctttttcgcgtcgaaccaacgtacgcgcccactgggcatggcacacctcgttactcgtcggaccggcagattctcgatctgctcatgaatacatcaaagtatcagtttacctcaatgcatgaacgcacggcacgcggcagcgcaccggacgcgaatcactcgctcttgtgctgccgcgcctgctgtttctcctgcttggctttgttgcgttcggccttgcgttccgccttggcgtcctgagggggttcgcccacagcgatcttcggctccagcggcgctatgggcagcaccaccgtgagcgtgaggccgccgccctgggagtcggtcgcgcagatgaagcccttgtgcgccttgaccaccgactgcgcgatggccatgccaagcccagtgccgcctttgagacgcgcccgggacgggtccgcggtgtagaaccgctcgaagatcttggagcgggagttctcgggcacgcccggaccatggtcgctgaagcggaccaccgcgtagttcatgcccatctgcatggagcggcttacgtccacggcttcgatgaagtagcgcatcgaggcgtcattcgcggacatgcgggccaacgattcggggctgatcgacgcgggcatgacgccgacggatatctccaccggggagtcggcgggcgtgtagcggtggatgttgccgacgatgttggtgaccacctgccgcagcctcgacccgtcgcctttcaacgtgacatcgggcagcgggccttcgacgaactccagatcggccggctcatccccgttgcgcggctggaatgtcagcgtgccgcggcgaatctcacggcccggatcgagcgcgtgcaggtcttcggtcgcgtccgtgaccagcgtggtcagcggcacctgctgagtgatgtcgatgccacgcccctcgtcgaggcgcgccaacgacagcaggtcctccaccagtaccgtcatgcgggtgctcgaatcctcgatatgcgagatcgactcatcggcgcgtcccagcgcacccggcaggtcacgctgcatcttgtatagctccgcatacccgtggatcgccgcgagcggcgtgcgaagctcatggctggcatcggagacgaatcgtttcatcttcgccgtggtctcctcctgctcgtggaagctctgctctattcgggtgagcatggcgttgagcgagacagacagcgaaccgacctccgtgttctccggcgccgggggcacgcgttgtgtgaggtcgccggcggcgatcttcgcggcggtcttctcgatgcgcttcagcggagacagtgttctctgggtcatcagcgtggccagcagggcgccgagtatgacgatggccacgccgacgatgatgcagtaacgggtcaatgtctttacggtgtcaagctggtcgctcagcgacagaccgatgtagcatacgccgccgggcttgccgtcctcatcggtccacggcagcgccacgacgcgccacggcgattcggcggtggacagcgtggaatggtccacgctccgcccgctcaacgtcacgacggcgttggtggtgaacggctgctggagctgcacgcctccgcggctgccgtccataggcagcaacggcatcgaactgacgccgtccttgagagtggggacgatggcgttgcgcaagatggtgtcgtcgctgtcgcggatctgcacgaagtagctgtacagcaggctgctgctggatttctcggcgttattctgctgacgcatggtatcgatgttgttgaggaccagttgcgcctgacggaacagctgcgtgtccgtcttctccagcatgtagttgccgaccagctggcgcaacgtcagtgatataccggccgtacccacgatcagcaggatgaccgtgcacgccacgatcttggtggccagcggaacggcgtccagacgcccgacgaacatcgatttcagtgtcgcccacacacccttggtatgggtcgcacgcttctggctcgcaggggcggctgtcggcggaggtatctgcgcggttcccggagtcccgaccgtgccggtcggcgcggttcccggtgccggggccgggcctgcggcggttccgtcacccgtcggcggaggtgtctgtgcggtcatcgcgcccgcctcacgccgagactctgggctcgcgaatcatgtagccgatgcctcgcttggtctcgatcagcggggtgaccttgtgctgttcaccgttgtcgtcggtcaccatgatgccgtcgaccttcttgcgcaggtacgagatgtacgactcgacgatcgccgcgtcaccgccccaatcgtattgccagacgtgatcgaggatctgcgccttcgacagcacacggccctcgttgtccatcaggtagcgcagcagcttgtattcggtcgggctcagatcgatcgcatgaccggcgcgggacacatcgtgcgaatcctcgttgatctcaaggtcgccgacgcggatgatcggatcgtcctccacctgctcacgggtgcgacgcagaatcgcgcggatgcgggccacgacctcctccaagctgaagggcttggtcacgtagtcgtcgcctccgacggtcaatcccatcaccttgtcctgcgtgtcgtcgcgggcggtgaggaaaagcacgggggcgccaatgccctcctgccggatgcggcgggtcacggtgaatccgtcgatgtcagggagcatgacgtcgaggacgatcaggtcgggctgggtcttctcgatcacctcgatggcttcggagcccgatgcggcggtggccacatcgaatccggcgaaatgcagggatgcgacgagcagttcacggatggacggttcgtcgtcgacaacaacaatggatgcttcaatcggcttgctcatggttaccagcttgactcgatgttctggatgtttcctgaacaccatctgtgtcttgcgggacaatggacgccagccacgcgtcgaaacgctcccgggagccttcgtcggcggcttcgtcggtgttgcccggcttgggcgcggtggcggccgacgacgttccgaaccgctttccgcgccgggatgcctccctccgttcgcggcgcgtcatgggtacggacggagcggactgctcgtcggattcacttgaagcggactgcggcctgccgtcgtcctccgccggggagtccgactcggctgcatcacccttggagcgccgcttcttggcggacttgcccgtgtctttcttcgtggctttctctgtggattttcctgcgtccttctcggcatccggctgcttgcccttcgtatcgcgacgacggcgaaccaccgtcacgacgccgatgacgatcagaaccaccagcacgccgcacatcacggatatgcccacccatttccacaccgtgccgcgctgcgctgtggtcgtcttgatcgtggcgatggaatccatcatggcgatcgccgagccggaccagtcggggttcctgccgctgaccggcccgtaggcgcttttcagcagctggtccgacgtggtcttgttgtacagccacgattccgagttgccggagacggcgaccacgagcttgccgtcgttgagggccacggccagcagcacggtgttcggtttggggttggtggcgtccaacgcctcctgcgcccattggtcggggtcctctaccccctcgaaatgcagcatgtatgacagcttgaccgacacgccggtgctgtcgtaggtgctggatatggcgtccgtaactttcgtcagattggagccgagcacgttgtagggatcggttatgtcctgggagaacgtggcctgcccctggtccgaggacgacgaatcgtccccggcggcgtatgcgaccgcaccgggcgaagttatccacattgttatgaccagcaccgtcaaaaccgcggaaaacagccgtttccacagagaaaatccgtcgcgcgacacgccgataacccccaaaatggccgagccttcgaccacatcatccgtttttccgtatctcatcgttcgcaatgtcatatcctccacattaccggccggacgcttcaacgtcaccgggcgaaaacagaacaatacaggaaaggaacaaccatgccccaatatcaagtggattccgaacggatccaatcctcctccgccgccgtttcggcgtccatcgccgccatccggcaggcggtcaacggaatgtatacgaacctcaacggtctccaggacgcctggcgtggcggtgccgccacgcagttcacttcggtgagcgcgcagtggcgtgcggcacagcagcagatggaggcgtcgctggaatccatccagcaggcgctcacccaggcatccaccgtctacgccgacgccgaagcgcaggcgtcccgactgttcgcttccggctgaacagtatcacggcggtgatccgctccggtacgcccgcagacatacgaaaagggctccgaccctcaacaggtcgaagcccttcacatcgcggcaaatccgtgttacggcatccgctgctgcaacgcgctaccgcgctgcgatggcggattccgagagcggatcagtagcccatgtcggcgccggcggccggagcggcggccttcggttccggcttgttggcgacaaccgcttcggtggtcaggaacaggccggcgatggacgcggcgttctgcagagcggagcgggtgaccttgaccgggtcggcgacgccggcggccagcagatcctcgtaggtgtcggtggcggcgttgaaaccctgaccctccggcagctcgcgaaccttgttgaacaccacgtcaccggacacgccggagttctcggcgatctgcttgatcggggcctcgatggcgcggaacacgatggcggcaccggtggcctcttcgccggtcagcgaagtgacggcttctgcggactcggccttcttggcagcctggacgagcgccacgccaccgccgggcagcaggccctcttcgatagcggccttggcgttgcgcacggcgtcttcgatgcggtgcttacgctccttggcctcgacctcggtggccgcgccgactttgatgacggcgacgccgccggccagcttggcgagacgctcctgcagcttctcacggtcgtaatcggagtcggtcttctcgatctcggcgcgaatctgagccacgcgagcctcgacgtcggccttgtcgccgccgccggaaacgatggtggtctcgtccttggagacgatgaccttcttggcggtgccgagcacggacatgtcgatggagtcgagcttgagacccagctcgtcggacacgacctgagcaccggtcaggatggccatatcctgcagcatcgccttgcgacggtcgccgaagccgggggccttgacggcgcaggagttgaaggtgccgcggatcttgttcaggatgagggtcggcagcgcctcgccgtcgacgtcctcggcgatgatcagcagcggcttgccggacttcatgacgagctcggcgatgtggacgacgtcctgctggctggaaaccttgccggaggtcaggaggatgtacggatcctcaagaaccgcggtctggtcgtccgcgttggtcacgaagtacggggcgatgtagcccttgtcgaaacgcatgccctcggtgaactcaaggtcaaggccgaagcggttgttgtcctcgacggtcacgacgccgtcctgaccgaccttgtccagagcctcggcgatcttctcgccaacctcggggtcggctgcggagatcgtggcggtggcggcgatctggtccttggtctccacgtccttggcggcggcgaccagttccttgacgatggtgtcggtggccttctcgatgccgcgacgcagcgcgatcgggttggagccggcgacaacgttcttcaggccttcgtgcacgagggactgggccagcacggtggcggtggtggttccgtcgcccgcgacgtcgtcggtcttcttggcgacttccttgaccagctcggcgccgatgcgctcgtacggatcctcaagatcgatttccttggcgatggagacgccatcgttggtgatggtcggtgcgccataggacttgtcgagcaccacattgcggcccttcggacccagagtgaccttcacggtgttggcgagcttgtcgagacccgcaagcatgccctgacgagcttcctcgtcgtatgcaatgatctttgccatggttgtgtatcctccaaatggcttcacggtactgaatctcacctgggggcgaggcgtggccgccgaccgtcagctgccggctgtcactctcactccccgagtgctaattgggagattagcactctcggtgcccgagtgccaacatattcatgaggattgcgctgttggcttgaaatcatcgcgtgatccgcgaaggccggagcatgccgataccgatccggtaaagccgaaagaaaaggaaaaagctccggcactcattgggtaccggagcttcgatgacgcgcaaagcctcgcacgattcagagcttgaccactttcgtggcctgcattcccttcggcccacgttcggcctcgtactcgaccttatcgccctcgttcagcgtcttgaaaccatcggcttgaataaccgagtagtgcacgaacacatcatccccaccagcatcagaggtaatgaatccgtaacccttgccagcgctgaagaacttcacagttccctgtgccattgttatattctttcccttgttcctatgccgcgaacaaacggaagagagctcaaaaccgcaccgcatcccccacctcgcgactccatatcattgtacggtactaggggacattcgcacaaagcctacggggacgcggattctcggccgatgtacggtcactgcatcagcacgacgacgacgggtgcggagatgcccgacatctgccgcacgtcggagatgcccaaggtcacggcgatgtccttcgcggtcgccgcatcggtctcgttctggtaccagaccacggtgctcgcgggcaacgtaccggaggggttggcggagacgacgttcttgtatccggcctgcttgagcgtgtacgcacggctggcggcgtgaccggagatcttggttccgttgatcacgcggacggaagtggccttgttcgcctcggcggtggccggcggcgtcgactgcgcgtcggacgaggcggtggagtccgtcccctgcccgttcgtgtcggtggcatcggtcgaaccgtcgctgctgctcgatgtcgtatcgctctgggcggaatccgtggaggtattggaagccgtgtcggaggaaccgtcagtcgaactagaagtggactgctcgcccgtgccggacttcgtcgtgtcgccggtcttcgagtcgccgctgtcggacgccttgtcgtcggccgcctgcgacgtgccgttgttcccgaagagcacgtcggagaacattcccgacagcacaccccatgtgccgacgcccgccagggccaccacaagcagcacgatcaggaaaggcgtcatgcgcgccccggccgaccgcgcgccccgatgcacgcccaccggacctgccggaggattgtcgaacacgtctttggcatacgaatcgtatgtttccttgtccttggccataatcacccttccgtatcgttcgtcaagtctaccggccatggtgtcccaagtgcgcgacggccgtcagtcatgcaccggatatgcacagcttcgacacgctcgctacagtagagaccatgagtcaacatccagtcaaaccattgtcgcagctcgtggagcccggatgggccgccgcgctgcaggacgtggagccgcaggtccatcacatgggcgatttcctccgctccgaactgcaggcaggacgtcagtacctgcccgcaagccataatatcctcagagccttcacaattccattcgactcgatcaaggtgctgatcgtcgggcaggatccctacccgactccggggcatccggtcggcctgagcttctgcgtggcgcccgacgtccgaccgctgccgaagagcctggtcaacatctaccgcgagctcgtcgacgacatgcacgtgccgatgcccgacaacggtgacctgacaccttggacccagcgcggcgtgatgctgctgaacaggtgcctgaccgtcggcgtgggacgccccaacagccatcagggcaagggatgggagaccatcaccgaggccgccatccgcgcccttaacgcccgggtggacgcggacggcaagccgaagccgctggtggcgatcctctgggggcgaaacgcgcagagcctcgcgccgctgctcaccaacgcgaccatcatcgcctcgccgcatcccagccctctgtccgcatcccgcgggttcttcggctcccacccgttctcccgcgccaaccaagcactggtctccatgggcgcggaaccggtcgactggtcgctgccatcggcgcaggcggatcggcccgatccccactccgcggttgcttcgtcacggtaaggtgggcagcatggctttattcacctcgaaaccttcaatgccgtcccagctcgcgaacgcgatccccacgacgggcgccatgccggccgcccccatgcgcacgcccgtgccggcgccttccgccgcgctgacgcaggatgacctgcgacgcgcacggcaactcaccgaccgcatccgcgccagattcgcccagacgctggtcggacagtccgacttgcgcgaagcgctgatcgccacgatggtcgcaggcggccacatcctcatcgaatccgtgcccggcctggccaagaccaccgcggcccagacgctggccacctcggtctcgggaacgttccgccgagtgcaatgcacgcccgacctcatgccgtccgatctggtgggcacccaggtgtttgacttctccacccagcggttctccacccagatcggcccgatccacgccaatttcgtattgctcgacgagatcaaccgttccaacgccaaaacgcagtcggcgatgcttgaggccatggcggaaggtgccacgacgatcggcggcgaacgcatcgagctgcccaagccgttcatggtaatcgccaccgagaaccccatcgaggaggagggcacgttcaacctgccggaagcccagatggaccgattcatgatgaaggccgtcatgacctatcccaaggccgacgaggagacgagcatgctggcgatgctcacgcgccgcggcaccgacatgttcgatccgaaatcactgccgtccgacacgatcaccattcaggatgtggagtttctgcgcaaatcggcgcggcgcgtccatgtgtcggaggcgatcatgcgctacgccgtcgatctggtggcgacctcgcgcggtgccggaaacaagccgctgaagggcctgagctcgacggtccgcctcggtgcgagcccccgcgcgtcgatcgccctgatccgcagcgggcaggccaacgcgctactcgccggccgggattacgtcatccccgaggatgtgaagatgatggtccacgaagtgctcaggcaccgtgtgatcctgaccttcgaggcgctggctgacggcgtgaccagcgaccaggtgatcgatcggatcgtggaaacggttcacgtcccatgatcgatggctcacacccctcacactcctcatcttccgacgaccggatccgcaggaagatcgaggcgttgggcaattcgctgagccttccgaccgttcgcaaggcgctgggcgtcctggagggcgagcacgcctcgaaccggcgtggaggcaatgacgacccgatggacatccgcgtctacgggccgggggacgaggcgcgtctcatcgattggaaagccagcgcccgtctcggccgcccgatggtcgtgcagcatgcgcgccaggcgaccagccaggtatggctgctgtgcgatgtcggcgaggagatgaccggaggatgcgcgtcaggcgagccggcctacgcggtcgcaggcaacgcgctgcgcatgttcgccgcgctgtcgctgcggcgcagcgatgacgtctccctggtgttcgccgacgcccacagcatcacgcgcatgccgttcaacggcgggttcgcgcagttcgagcgcacgctggacgacgccttgcggcgggattggtcatacggccgcaacatcgacgctctgctggattacgcgcgccgcatacgcgaccgtcaggcgctcatcgtgcttgccaccgacgagctggccctgcgcaagcgtcacatcgacgtcatcggcgccatagccgccacccaccccgtggtgctgatcaccgtggcgacggccaaccccttcgacccgtccgaggccgcccgcgaatggtatgacggaaaatccgggcgccgcatccccgccctgctgcgcaacgcgaaggccgcggaagaggtggcgctgcatcgcagatacgtgtgcgccgctctggagcacgaactcgccaaacgtggttcgcgaatgatccgcgccgcgtcgagcgacatgatgttcgatgccttcgtgcggctggtgtcgcgttcgctcggccgttccatccgcaatcagctgcgtgtgccgccatcgctgaacctgacgtcggaggtgcctgcatgaacgtcatgaacggtttcgtgacctcgtcgacgctggccgcagccgtggacgtgaacgacctgcatcccgtgacagacgtgcccgtcgcgtctctgctgcccatagtgacgatggcgtgcttcatcgcgttgctgatcctgattgtggcgatcgtcatcatgtcccgtcctcgacgtgcgaaacgcgtagccgctccccgagggtcccacaacgccttcgcccccgtctcgcaatggaaaagccgcgtgcacgacatcgtggagcgcaacggggccgggaagctttcgcgcgaggacgccttcgtcgagctcgccgccgtggcgagggacttcgcgtcgcaggccagcagcgcggagctcggttcgacgacgctgcaggagatcgcgtcacgttccgcaggctctctggcaagtgattcgggagtccacggtttcacgctgctgcgccagaccatagccgcgctgtatccgccggagttcgcgaacgccgagttcaacgcgcaggcgaaggacgccaccgtggaacaggccgccgactgggtgctgaacctcgtggaaaggtggcgctgatgaccacgaacgacatgagcatccattggctgtggccgtatgccgccgtggcggccgtgctcgtcgcggcagtgctggtggccgtcatcgcgatcttccgaggccgcaggcgtcccccgcgggacggcatgccggtatacagtcttgacgacgacctcaataccgagcatgcatcgcatctgttccatctgtggcgattgctggggcggatcgccgtggcggcgctggtggcggcgctggccatctgcacggttcttatcgccagaccggcgcatgtggaccgtgacgcggaacgctccagcagtcgcgacatcgtgttgtgcctcgacgtgtcaggttcggcgctcccctatgaccgggcggtcatcgaaacatatctggaactggtgagccatttccagggagaacgcatcgccctgagcatcttcaactcgacatcgcgcacggtgttccccctgaccgacgactacgacctggtctccagccagctgaccaaggcggcggacgcgctccgtggcgtcgaatcgcaggacgacatcgacaagatgagcgacaaggactaccaaaagatcgccgattggctggaaggcacgcagaaccgcaagaactcgacatcactgatcggggacgggctggtcagctgcgccgcgatgatacccggcttcgcctatggcgacacgtccggcgccgcacggcagcgccccgcctcgatcgtgctcgccaccgacaacgtggcgtccggcacgccgacgtattcactcgcccaggcgctcgatatggctgaagcctcgcatatcagcgtggacggcctgttctccgggccacgccagagcgagggcgacgccacaaccaccgagatgaagcagcagatcgagtcccgcggcggaacgttcctcacccagtcgggctcatccgacatcaacgagctggtgaggcagattgacagccggcgtaccagcgaaagccgacggtcaagccaggccgcgctgatcgacgcgccgggatggtggacgctgatgctggtcgtgctgcttgcgatatggatgatactggcatggaggttgagacgatgagaccgatgacattcgccccggctctgggttggatcgcgggcggcgcgatcgcggcgctcatgctggcgttcgcggtcgcggtggtcgtcgtgcatgtgcggcgcaggcgctccagcgatgagacgctgaccgcctgcatacgcagggtgataatgttcctgctcgccgccgtgatgatgctgacgcccagcatcgtgacgaccaccaccagccgggctatcaatgccaccgatgtcatggtggcggtcgacgtcaccggatcgatggcggtcaaggacgcggaatacggctcctcgggcacaatcagccgtcttgacgcggccaagcgcatcgtgaagggcatcacgtcgacgtacgccgattccagtttcgccgcattgcgcttcggcgcgagcggcaccctggatgtgccgttgactccggactccatcgccattgacggctgggccgacacgctggccgtcgaatccacgtccacatcggccggatcgagtctcgacacgccgctcgaccagctgatgctgtcgctcaaatcaatcagggatcaacatcccgatgacatcatcgtgctatatgtgatcacggacggcgagcagacctccgacaccgcacgccgcagctattctgcgctgaggcggtaccttgacgactcgttcaccatcggcgtgggctctgatgcgggtggcaagataccgatggccagcgacggcacagcaacgggacagcaatccgacgggcagtgggtgaccgacccgacgaccggcaagccaggaatatccaagctcgacgaggccacgctggaatccatcgccgatgagatgggcggctcatacctgcacgtggacgcctcgcacaccatcgaacaggccgtgtccgccaaggcatcaagacagtggaggctcacccagacggtcaaacggcgggagcgtacgattcccgtgatatggccgttcgccgtggcgctgggcctgctgctcgcctgggagatcggcgcatggatcgccatgtcacggaggatgctatgaaatcccggaaatcaacgaatcgtgcgatgaaaagcaacacagtgaagaagcgtgaggcgaacggccgcgaggcgaaagaccgcgcagtagcgcgcactccgctatggtcgcgcatcctgatcggcatcgtcgcgatggcctgcctgtgcgcgggcatcgcggccggcgcgaacctcatcgctgtcaccgcattcgacgatgccacctcgcagctgaacggcaatctgaaggccgcttccaaggatgacgccgacctgtcgacgctcagcgcactccagcaaaaagccgacgccaggttcgcagacgcggccgcatggtccgcgttgctactgccgcaagtcaaggacgtgatcgacaccaacgcgtcagtctccgccacgctgaccgaacgcatcaacgcgcagctccagaagcagcaaaacaccgaaacctccaacgcgcagaccgcgcccggatcggacggcaacgccaagcagagcggcggtctgacgcaggagcagcgcaagcaagtggacgacctgctgaagtcgaatcagcagtccaactcgcagaacggctccaaaggcggtaagggcaaaagctcctccaacacaaactccaccaccaagccatggtgattggccccgggcgccgcctggttccagctgtccggttccggttgtccgtgtaccacaccacacgattttcgacggtttttgggctggtgtggcaacgccgatatcagagcgttttcccgaatcattggaaaatggcggtttctgtgattcgctttctgccataccacgtaatgagaaggctcacattccattgtgtggcacaacaaaagccacacaatgcatttttcccatgtttttcccctggtgtgccatcccggcacggcatccttagcacggcaatcggcggcgaagtcaggccgattctcccctgatggaaagacgggccacggcacaagtggcgctgcggatgagaggcacccgggaccgccccaggcggcttcgcatgcagacagcccctctactcgcttcacggctcagtccgccagcgagggcgccattgcgcatcactccattcagtgctccgcgacggcgccggtctcgtcgtccacatttgctgtggatgacacgccgagtgtgtggataagtcgggagccttcgaccacatgttccgctccgcttgcgcgcggatggccgtgcatgcgttcatggaaccatgaacacctgcactatcttcaacggcgcgttcccgatatgggggaacgcgatggcgtcgatcgccggcgccgactgcccttgccgcaccgctgtcgggtccagccgggagcgcatcggctccctgcaacggctgacctccaacgcgctggaacagtccagaaccgcgatggccgccgccaagaacctggattggaccggcaatgcggcgacactgtgcgcacgaacattggaccgcgatacgaggttggcggcatccatcgacgaccgcgtgcggcagaccgggcaactcgcctggagcggaggctcatcatgaactggatggtcacttcgtcgatacacggaggcacgcaatacgccccggcaacccgtgaacgatatacggccgccgtggcatcgctgcgcaatcaggcgaaggagatgaagggcgcggggttcttctggtcggtggtccacgaccagctccgaaaggaccgtgcgggcgcggcgttctgccctgcgctggccggcagcggcggcgatggagaacctggtcacgtctccatgccatatgcgcgtctgctggagcaatgcgtcacccacgcgcgggagtgcgccacgctcgccggggacctggaacaggtcgccgatctgatcgtccgcgcccacagcctgtatgacgaagcggagaccaaggcggagacgaaacttcgcaaggccgcgcagatcatgacgaccgtgctgcccagcgtcggatggaacacgctggggatgctgtcgctctacggattcgtctcgggctccatcaaggacggcaagctcaaccccgtgcgggcgctcgatgccacatcgaaaatggatgaggagctgctggcatcgctggcgggacgcatcacgaacaaccgcatcgcgcacatcctcggcggtacccaggtcgccggcgccgcggaacgcatcgcaaagtacacgtcgaagttcaagaacgccatgcagggcaacaaactcaccgtgcgtgaggtgcaatccacgtctcaggtggccggggcctcgcattccgtggcctcgtccatggaaaacctccgacggctcgccgaggaacgcctaggcaagatcacccttaacagcggactcagttatgcgacgatagcggtccagcgataccgccgttccgatgggacgacaggctggctaatcctgataccgggcacggacgggcaggacgattcgccgttcggatgggagcagaacctcgaactcatgagctccaacgccaaccgacgcaggaacgcggacagcttccgcatggtcgaggaagccatgagacaagccggcatcggcaaggacgagccggtggcattggtggggcattcccagggcggcatcgtggccgcggccctggcctccgacctgaaggactcctacgccatcgatcacgtggtgaccgccggctctcctgtcgccaatcatccgataccgcccaagacctgggtgaccagcatagagatcgaggacgagctcgtcgcctcgctcgatggcggccgcaacccttcgaccgaacaatggctcactgtaaggggcaaagtcatgcagaccaccggcgtcacgccgccgacggtgaacgccaacgggtcgtgcacgcccggccagaacaccggttcggtcgagtcgaactacgccggagcactggtggccgacgcgccgaagactaaggagatatcccattggctcaaataccatcaggccgcgtaccgcaacgccaccgatctcggctcgcccgccgtggacgcgcacgaacggcatttccagcagatcatcgacggcgaactcatcgacacccgatactacgagggacgcatgtcgcatgactgacgggcgtgcacgcaccggaaacacgggaaaacagcagtcagcagacgaaaacgagaggagaacgacatgccgggacgaagaaggcatcaggaacgggggagaaacgaacatgcatcggtttcgcatcaggtttacggctggaagtaatctgggatgctatgaagcttactgacatcacccccgcaattgcattgaccccgctcgacggacgctaccacaagcagaccgcacctctcgtcgaatatctgagcgagccggcgctgaaccgcgagcgcatgcgcgtcgaagtcgaatggatgatcctgctggccaacggcttcgacggcaacggcaaccagccgatcgtcgaaggcgtggagccgttcaccgacgccgagatcgccttcctgcgggccatccccgaggacttcggcgccgaaggcatcaagcagcatgccgcgcacgaggccgtcacccaccatgacgtgaaggccgtggaatactacatcgacgaccagctcgacaaagcgccggccgagctcacccacatcaacgacgcgctcaagacccttgtgcacttcgcctgcacctccgaggacatcaacaacctgtccaccgcccgttgcgtgaagaacgcgatggagcaggtatggacgccggcgttcaaggagatcatcgaccacctcgccgccaaggccgaggaatacaaggacaaggccctgctctccctcacccacggccagccggccacaccgaccacgctcggcaaggagctcgccgtctacgtctaccgtctgaaccgtcagctgaggcacatcgagaaccaggagtacctgggcaagatcaacggcgcgaccggcaccttcggcgcgcatctggccgcctgcccggacgtcgactggatcgccgtctcccgcgagttcgtcaccaaccgcatgggcctgacctggaacccgctgaccacgcagatcgaaagccacgactggcaggccgagctctactcgaccgtctcccacgcgaaccgcatcatgcacaacctgtgcgtggacgtgtggatgtacatctcgcgcggcgtgttcgcccaggtgcccgtcaagggcgccaccggctcctccacgatgccgcacaaggtcaacccgatccgcttcgagaacgccgaggccaacttcgaactgtcctgctcgctgctcgacacgctctccgccacgctggtggagtcccgttggcagcgcgacctgaccgattcgaccacccagcgcaacatcggttcggcgctcggctactcgcagctcgccctgtacaacctgatgggaggactcaagtccatccacccgaacaacatcgtcatcgaacgcgaactcgactccaactgggaggtgctcggcgagccgatccagaccgcgatgcgcgcctgcgagctcaagggcctgcccggcatggacaagccatacgagaaggtcaaggaactcatgcgcggccatgagatcagcaaggaggtggtcgagcgcttcatcgaccagcagtccttcgaccccgccacggccgcgcggctcaaggcgctgacccccgccacctacacgggcgtcgccggcgcgctggtcgacttcgaccgctgagccgtccgataattcccatttccatcgacgatcaatcagcacaggaacggtgatgaacgatcagacgataaccgcaacgtccggcgatgacgattccaaggcgtcgccggacgcgcgtccgatgagcgacgacgtatccggcaccacggcccacccggtcatcgaggacgtcgcaccgcgccgcatccacgatttcggcgatctggtccacgccatctccgccgtgctgctcgcagcggtggccatactgtcctccatctacctgagcggtttcgtcacgggagtcgagtccgatgcccacagcgccggacgtgcactgaactggatggtcgatcttccgacctcgatgctgcagcagctgaccatcgtgaccatcgccgttatggccatcgtccagctgctggtgggacgggagtggctgcaatcggcgttggccctactcgccatgttcggtggcctagcgaccgtctggggcatatcgatggccgtgtcgaccttcgggaacttcacacttatcaccgcgctgtgttcgccgagctcgatcatcggaacgggactgctgccggacttctacgcgggttccgcggcattgttgaccgtcgcggggcctcggcgtacacgatcgacggtcaaatggggatggaacatcctctacatctcgtcggccatcctgatcctgctgtcgatcaactccgtgaccggagttatcgtgtccctgtccgtaggccggctggtcggcatgctgatccggttcgcagccggcaccaagaaccagggcgcatggggcgaggatctcgtgcaggcgctcaacggcatcggactgcatatcacctcgctgaagcgccgcatggacgtcgacctgtcccatggctccctcgcctcgaccctcgacgacgatctggtcgaaggatctcgactgtacgacgccgtggatgattggggacgggccttcgtcgtctccgctctggacagccaggcgcgcacggcgggctacgtcaaacagctgtggcagtgggtccggttcaccggcgtcgccatgcggcgcgaccgctcgccgagagaggcgacccagcaccatatggcgatgatcctgggattgcgcaatgcgggcctgcccacccccaaggtctacggcgtggccgacaccggcgagacttcgattctggtgctgcacggcgacgacatcatgcacgagtgcaacctcaacacgttgtccgacaaggacgccatcgcattgctgcgtttcctgtcggtggcgaacaagcgcgggtacacgcatcgccgcatcacgccggacaccctcgcgcgactggaatccggcacgccgatcatagccggatggcagaacggggatgacgccagcgcggccccgaacatcgcactggatcaggtgcaactgctgttgctgctcgccgtgctcatcggccccgaacgcgcggtcaccgcaggccgtgacgtgctcggcgacgacacgatgatctcgctgaccccattcatccagaaggcggccgttcccgccggcacgcgggccctgccgggctggaacaagcacatcgtggacgacatgcgcgccgagatgcgcgcgctggccccgcaggagaccgccgaggccatggagccggtgtccctgtcccggttcagcccgcgctcctttatcggcatggtgctgctgatcgtcgccgtcgtggtgatcttcacccaactgaagcccgacgaggtcatctccgcggtgaagaacgccaacccggtgatggcgatcgtctgcctgatcttcgaactcatcgccctgctcggctccgcgctggagctcggggccttcatcgaacgcgacaagcgcaacccgctcggcatcttcatgtcacaggtcgcgcaaggattcgcgatggtgtccatgcccgccggcgtcggacccgcattcgtgaacctacagttcctgcgcaaaagcggctaccgcaatacgaccgccaccgcgatcatgagcgccgtcatggccgtgtattatggcggcacagtgctcatgctgttcgtcatcggcatattcacaggcagcgacgcgcttagcagcatgattccgacgaacaccctgatcgtcatcgtcggcatcgtgctgatggcgcttgccgtggcgatgatgatcccgcccatccggcattacgcgacggacaggctgctgcccctggtcaaggcctacgcacggcagctgatcgacgtgctcaccaatcccaaggagctgtcgttcagcgtgctgggcatgctgatcctcaacgtggccaccggactggaattctgggcggcgctgctggcgttcggacagatgaccaatccgctggagacgctgttcatcttcctggtcgccaatgccatcggctccgcggtgccgacccccggcggcctcggtggcgtcgaagcggcgctgacgttctcgttcggcgcggcaggcgtgcccgcgggcatcgcgctctccgcgacgttgctgtaccgtgcgctgttctactggctgcgaatccccctcggtgcgctgtccatgcgctggctcgacaaacacaatctcatataaccgcccaacaaccggaaaaagtgtggaaaacccttaaaaaatgcggcgtttgcctacatcatgcgctatcatcattgatgaacaccggggattcggcaatcgaagcccccagatcaaagaaggatgctttatggcatacaacaagtctgatctcgtttcgaagatcgcccagaagtccaatctgaccaaggctcaggctgaggccgccgttaacgctttccaggacgtgttcgtcgaggccatgcagtccggcgaaggcctgaagctcaccggcctgttctccgctgagcgcgtcaagcgcgctgcccgcaccggccgcaacccgcgcaccggcgaaatcatcgagatcccggcgacctacggcgtgcgcatctccgccggctccctgctgaagaaggccgtgaccgagtaagtccggttcgtgccattgtcaccgatttcgatatcatggtgaacaaatacagcccctgaccaatgaagagtcaggggctttttcgtatctgggcttgggctggggcgcctccggtcggcacctacctccccccccccggtcgacttcgccgacggctcagccgccagcggggcgttatagcaggttcatcaggtgttggacgtcggcattcgcctggtattcgaaagggtccagcagcacgacttcgctgcgttcgggagccatgacggacaatcgcgtccagtcgcaggagaaccggcattgcgtggacagcgccttggcgacgaaggccccacgcaacgcggcacgggtatcggccggcggttccgagacggcatgctccacctgccggggcgtggccagctgccgcatcacgcctcgacgcagcattgacggatacagcgaaccgttgacgatgtcatggtaatccatgtccagccgttcgcgcatggcgtccgtcacttcgcccttgcggcgtttcagcgcctggaacaggcggtatttcgccgcccagtcgacgcggtccgacaacgcttccacatcgccggcctccaactggtcaagaaccagcgaccatgcggaaagaatctgatccacgtccgtgcgcggcagtgcgtcgtcaacggcatcatgatgacgttccatgaaatcacggacgacggcctggtacctgcgctgcatctgcacggcggacaccggctcggagccgtcagcaagacgaagccgggcggtcacgcatgtcagatcggcgctgaccgcacggttcgcggcaccgggatcagccaatgcgcacgacgcgaaaccggaatcctcaccgagccgggcggcctcctcgatgacgcagataatcagatgcgtcacggcgagtttcatccatgtcgcccattgcgaacgattggagtcgccgatgatgacatgcagccggcggaattcatccggatccgagtgcggttcgtcacgtgtgttgaccatggggcgcgaccgcgtcgtcgccgatgacaccgcctcatccagatagtccgcccgctgcgtgatctcgaatccctgatcggtgacccgcccggctccggtgtacagctgcctcgttatcaggaacggcagcagctcgtgttcgacggtttccagaggcacatatcggcgtacgagatagttctcgtgacacccgaacgagtggcccgccgagtccgcgttgttcttgaacacgtgcacgttcacgccgtccccgtacctggcacgaagccgggcctgcgcgtcgagggccaatccggccatgacccgctcccccgccagatcctgcagcaaggcgtccatcggatcgcgggcctcggcggtcgcatactccgggtgggagccgacgtcgagatacagccgcgaaccattggtcaggtacgtgttcgtggaacgcgcgcgggacacgacaggctggaacatcatcatcgcgacctgcgccgcgtcgaccggatggtccgaacccgtcaccgatacgccgtactccgtctccacgccgaaaatgcggacgaatccctggaactgcgaagacctccgcgcttcctgccaactcccgtgattgccgctgtcacgcagctgcggcatcattcgccgcctttttgcacgaagctgttcacgtactcctcggcgttggattccagcgtggattcgatgtcatccagcaccgcgtcgagagcgtccacggccgcgtcggtctcggcctgtgccgccatcgacacgtcattcagctgttcgtcggtatcctgcttctgcgaggacgactgcgtgtgagcgaattcctgaggcatatccgtccctccctttccttccggttttcttcttccgccgatgccggcacaggccggacatccggcatgccgtcaccgaatcgcagacatctgccacgcacgcacgtattcgtcaccgccggcagacgcctgcatatgtctgtatgcgcccgatcactgcagatacggctgcagctcgtcgccgatcaggccgttcgacgccacgacatcgttctcgcgacgccaatggatcagctcgccgttccactgtctcagacgcccctgcgcctcccataccacgacggcgccggccgagacggccggaacatcccacttgtgcaggtgaggctcgaaataggcgtcgtacgtgccgtcggccaccttgcacaaatccatcgaagccggacccactcgcttgatatcggccggtttacccgcgatggaggctaccgcggacagggcccgcttggactcctccggcacatacgacatgccgtagctgaccacggagccatccaacgtcgcagtgatcgacggcatgaccttctcgcgcttgtcgccgcccacggggttgcggcgtatcctgatggcgccctggcccttcgccgccatgtacgtgatgcccatggcgggcgcatggaccacacccatgatcgggcgcgcatggcagtgctcgtcgaactcgaacagtgagatggtcacggtccattcggccatgttgcggatgaaattgatggctccgtcgatattgccgacacaccagtacctctcccccggctggttgtcctccggacgctcctcccagaagccctggaacggttcgatttcggacagtcgcgcgcgggtatagcgaatcagccgggtgttgacctcgctagtgaatttcgtctcgccgggcgacaccatcgtcgtggataggtcgtgggggttcacctgctcctgaagggcgtgcctgccggcatgccgcgccacttgggcgacggcctgtgtcatttctcgcaaatccatgtctgcatcaacctcgtctgtcggtcgttgtctctggtcgtggcgttcgcgcctttgatcgtcatcgctcgccatcatggctgccccatgatgcgcatcggccagtggtgcgcccacggtaatgccatttcatgcctgtatcgatattaccttccggcggtgatgttccgaccgatttgcgttatcagctcatcggcgtttcgcgtgccgtccacgaacgcggccatgtgcgccttgtcgaaggcgcacggatcggacatgtcgagcgagcacaggtcggacggccggacgatcggacggctcgcattgccgtacgactcctcccccgtctgcggcgcatcatgcctgcggacggtcagatgggaccatgagacagcgaccacctggctcgcataccggttcacgaccgcggcacgcagccatgcgcgcgtggtctgcggcgcattgccagcggcatcggcgacctgccggtcgtcgaccgtgcgctcggtgcgcgacctgaccttctcgaatatcgagcggaccgggtccaaggcggcccaccccaagtcgatcgcccgcagtttcggatcgttccacgacaagccgtgcctgcggcgcagacgctccagcagctgccatttcatcagccattccacccgcgacgcctcgggttgcatattcagtctcgtatcgtcgtcggcatgccggatggcggccacgtcggcgagtgcctgcccccacagcgccatgatgccggtggtgggcttgtccggccacagcggctcgccgcgcgtgtcggtgccgtacaccagcgcccccatctcgtacacggcggcccgcagcctcacctgcatgatccacgcgttggtgacgcccccgtcgcgcagcggcagctcggcctgcagcgtcaggtcgtgcgacaccgtgtgcatggccgacacggggtcgacgagcgccatggagtccagcagcgctgccagatcatagccggtctcgtccgcgtgctcggccagccacagcagcatgctggtggcgcccagcttgagcgtctgcggcacgtccatgcggttggcgtcgccgacgatcacgtgcaggcgacgataatcggatgggctgtgggattcgtcgcgcgtgttgacgatggggcgttcgaaggtggtctgcagtccgaggatcgcgtggatgtagtcggcacgctggctgagctggtatccggcggtctcgctgcgctcccctatgccgacgcggccggatccggcgtagatctgccgtgagacgaaatgggcggtcatcagcgccgccaccgtgtcgaacggcaccgatctgagcatcatgtagttctcatgggtgccccagctggcgcccttgccgtcgacgttgttgcggtgcaggacgatgtcgtgccccgttcccacgctcgccgacgcggccgcccgccgcatcagcaggtcgccggcatggtcgtaccgcaccgcctcgaacgggtcggtggtctccggcgccgagtattcggggtgcgcgtggtctacgtacatgcggccgccgttgggggcgatgacgttgacgatgttgagctgcggctcgtcggtaagcatgtcggggcgggccgcggccctctccagacgggtgccccgcgcgtcgttgacagggtcctcctgacgatagtcccagcgtatgcgcgaacgttcgggatcggcggcagcgccgattacgtcgaacgacagctgcaccggattggcatgtgagacagcgggcgccgagaccgcgtattcggtctccgtgcccatcacccgtcgcacggtcattgcatgttctccttttccttgcgcggaaccggacggatacggaccacgcgcccgttgtccatgccgttgattctcgaccattgcaccggatcgacgtccattaccgaccctcgtgtctccacgaactcgtcctccacggcctctcccagcaactcgacgttcaacgccacgtcgtcgccgccgagaatggacgccttcaccgccttcgtcttggcgcggtcgacgatgttcttgagcatggcaccggacgcgacgtcggagaggaagatggccgaccattgcccctggtcgttgcacgcgtcgcacaggtgccgtcgcgacgagcgcgtgtagatgtcgcgcaccagaacgcgcgacaggccgtcggcgtccagtccgggctgcaggggcaggtcgtcggtcagatagtggcgaatgatggatgccgcctgatccgccccggggcggtccacgcggatcttcacgtccagtcgtcccgggcggagcacggcggggtcgatcatgtccacgcggttcgaggcgccgatcaccataacgttgtcgaggctctccacgccgtcgagttcggagaggaactgcggcacgatcgtggtctccacgtcgctggagacaccggtgccgcgggtgcgcagcagcgaatccatctcgtcgatgaacacgatgaccggccggccgtccgcggcacgttcgcgcgcgcgggtgaagatctgacgcaccagacgctcggattcaccgacgaacttgttgagcagttccggccccttgaccgagaggaacacgccgctgcccctgccgaaaccatccgaaagcgcatgggcgacggccttggcgatcatggtcttgccgttgccgggagggccgtacagcagcacgcccttgggcgccttgagattgtaccgttcgtacaggctgcggtgaaggaacggcagctgcacggcgtcccggatgcgttcgatctggctgtcaagcccgccgatgtcggcgaaggtgacatcgggaacctcctccagcaccaggtcggcatcgttctcgtcgggcagcagttccagggcgagccggcccgacgggtcgacgatgacgcgctgcccgttggcgaacgtctcgtgcgccaacgctcccgagcgccggatcacgctggggttgccgccgccatccgcgacgatcagacgcccgtcatcaagcacctggcggatcgtgcggacagagccgagcatgtcagtgccgcgctgctcgaccaataccatgttctcgttgagcagcacgcaggcgccggccgtcagccgggacgcgttgacgttggcggccacaggcacgaccagccgtctgccgcccgtcaggatctcggccgacgcatgctggacaccgagctcgtcggtcatcgacgagtcgaccttgaccatcgtcgcgaaggtcttcgggggctgggccatctgcgacagctgcgccttcgccttggtgagttccttgcccgcgcgcgacagcgcctgcgcgagcgcatggttcttggccatcagctggtcattggcggccgccagctcacgtgcgacgttctcccgtatcttcctcgcgtcctgtcgtgccgtggcgctttcggcacccgtgcccgacgatgagaccggccctgaatcaggtaggcctgacggatggtcctgcgaattccatatgccatccggagtgccgtcgtgcatgatatcgttcactgttcgcccctttttcgagcacgcttccctatcagattacgcgcccggcgaatcgccgggtccgtgacggccacaatgaccttggaaatggcgccgacagcggagccggagtcgcccgctccgtgcaccgcagcgggcgcgaaggccgatatgcgcagggattcatgcataccggtattgtcccaacgatttccgacaatcgacggtatgcttgacgaaactttgcaaccttctgacgaatcgtatgacgtgcccgacgtggaggtgttcgcggccgcacaccaatcgccctcggacaccatgggtgacggcaccgcggccgcgccgacgctgtcgaagcctggtctgcttgtcatggatgtggattccacgctgatcgacgaggaagtcatcgacgagctcggcgaggcggccggcagcggcgacgagatagcgaagatcaccgaacgtgccatgcgcggggaaatcgaattctgtgatgcgctgcgtgagcgtgtcgcattgctcaagggactgcccgtgagcgtgttcgacaccgtgcacgacaagctgcacttcaccaatggcgcgttggcgctgatcgacgagcttcaccgtcatggttggaaggtcggcgtcgtgtccgggggattccatgaggtcgttgaccgtctcgccgccgaagggcatatcgaccattggctggcgaaccgtctggaagtggtggatggcgcgctgaccggcaaggtgctgggcaatatcgtgtgcaagacggtgaaactgcatgcattgcaggcgtgggccgcccgagacggggttcccatgagccagaccgtggcggtcggcgacggcgcgaacgacatcccgatgattcaggcggccgggctcggcatcgccttctgcgccaagccgaagactcagctcgccgcccacgagtccatcaacgagcgcgacctgaccaaggtgctggacttcctgcgctgacgtcgcacggcgatagcgccaagaccaccctcagtcgcttcgcgacagctcccgccagcgggagcgtgataattgccccgctggcgggccgagccgtaaagcaaagggcagggccatttgcaggcgagggcgagcgacagcgagactgggggtggtttcacttacctccagtccgcaacgcgcacctcgttaccggcagcgcgcggcttcggagagtcgggctcctcgcgcccagtcggcggcgcgcatcgccttcttgccctgcgccttgacctccagcaattccagaggtgtggagcctgtgccgatccagacattcttctttccagctgcgagcgccccagacaccaacgacccgggtacgttcggattggtcatatcggccgggtgcgcccgcagcacgtgcagcgtggacagcccgtcgtcgagcccgagcccgtctgcatccagttcggtccatgccccgggattcggcgtgcacgcgcgaatctgacggtcgaccgcttccaccggcgcactgaaatcgatatgcgcgtcgttgacgcggatcttctccgccaccgggtaatcgccttccgcctgttccacgggatcggcggtaccgtcctcgacggtgcgcagcgcgtcgcgcagcaccagcgctccggattctcccagacgggtcagcaggtcgccggcggtctcatgctcgccgatcggcgtttcggattgcaccagcagcgggccggcatccatcgctcgcgtgatgcggaacacgctggtgccggtcatatcgtcgcccgaccagatggctcgttgcacgggggccgcgccacgccaatgcggcagcagcgagaaatgcaggttgtaccagccgcagggcagcgcgtccagcacggactgcttcaggattcgtccgtatgcgatgaccgcggcggcctgtgcgccggtgaccttcagctcgtcaaggaacgtcggctcggccgggtcggattccagtaccggcaatcccagttccagcgcggcagtcttgaccgggctgggcgtgagcttgcgtccgcgtccggtgggcgcgtccgggcgggtgagcactgcgaccacttcgaagtgctcgctgtccgcggcgagggcgcgcagggacggcaccgcgacatcaggcgtgccggcaaagaggattttcaacatgtgttccgtttccttccacggtattgggacttcaggccatctgccctgtcatcatcgtcgaacgccggacgacgtgcggacgggcggaggtcactgaaccgccgggatatcgatgccctgctcgatcagcagctcgcgcagcttgcgggcgtccgagaagcgaatgccgcggatgccggcctcgttcgcgcccgcgatgttcatcgccttgtcatcgatgaatacgctgctttcggcgctgatgccgaactcctccagggccttctcgtagatgtccttgtgcggcttgcgcatgtgcacgtaccccgacaccagacggccgtcgagccgctgcaggatctcgcagtgcttcagcgcgatcgggaacagttccttctcccagttcgacaggccccatactccaatgccggcggccttcagatcgttgacgagcacgcgggcacccggcacgacgccggtcagggaatcctcgaaattgtcgagatagtagcgcaggatatccgcccacttgtcgccgtaatgctcgcgcatccacgccacgccctcgtcggggcttgcgccgccgtccatgcggtcgttcgcgtcgtagaagccggagatgtcattgtcgaggaactggtcgatggtctcctgcgaatacctgggcagcagcacgacggacggatcccagtagatcagcacgttgccgaagtcgaaaatcacgttgctgatcggcttgccgtcggcggccgcggcgggtccctgcgccaccagcacgtcatgttccatatccggttcgcccggccaacccttcatgatgcctccatccatatgaacgattccaatgaacgattccgcggcgcgcggccgcgcacatccatggttccatgccatcgagacgacgcggcgaatcatccgccgcaccgatgcattccggcatgcaactataagcgccgcgtctgaaagttctcgtccgaatcgtttcggcagccccgaatctacgcggcaaatgtcatatacgccgacatccatcagcgccataatcgccgtgagcaagacaacggtcgccgtgccagcacccgtctgagctagagcattctcggaaagaggaatccttccgcgcctcgccggccatcttggtctccgccagcgaatcaggcccggcctgcatggtggcaccggatgcagtgacggcctggtcaaaacattgccacgagatgcgaaaaacaagcgttctcgacatttcgtgccacacgaccgacacgaaaaaacgatccgaataacagaatcggccattttccaatgattcccagtttcggtctcatggctcgaaacggcatgcaaccggttaaatccgattttgtggcacaagaagtgggccgaatgccgaaaacagcgatttttgacgtttcgtggcaaagaatccccgtctcatctcaccaaccgaaacaaaaggttccgaatgctgattcaatcggcagtcagacatgtcacgccgccgctttcctcgaaacgacacctcgacgcggcggataatctctcggatcagatcaaatccttgggatcgatttggaaccgcagttcgccgggagtgcgcgacgccatgtgacgcgccaccgcggaccgcaggcggacggccaattgggcacgcatgccgaccggcacacggaccagggccttgacccggtcctgcatgctctccagctcgcgttcgctcaccgtcaccggagccgctatcggcaccggccccagcatgccgggtatcggctcccccgcaacatccagcgaggcccaatcgccgcgcagcacgccgatatcgtccaaggcggccatcaccgcatcccgacgcccccatacgcatgcgaccgcgcacaccggaggcatgccggcctgcccacgctccagcaattcgttccgggcgagcgacgccgaatcccacatcatcagcgcatgggccactgcaggatcgcattcaccaatcagcagaccctgtccaccacgagtgcggggcgcacacaacgccatgacccgcatccacgccgtcagcgcgtccacgcgggcgtccacacccggcgcatacagactgttccacgcgtccaggatcgtcacggcacgatattcgccggcatcctgctccgattgacgggatgcaggcagcacgcgaggctccgctcccggcgtggcgatgacgatgcgcggcgcatcatccacgtactcgacgacgcctcgcggctggctcggcgacgatatgacgacggacacaccgcggaacaggccgcccagctcgcgggcggtgccggttgcgccaacccgtatcacgcgcatgcgctcgcagccgcaatgcgggcaatgccagtcgaccgccgccgcagcgcaccaccggcagcgcggcaccccatcacccatgcgccccagcgggccggtgcatttcgcgcaacgagcctgcgcatggcatttcacgcagcccaacgcctcctgcatgccgtccgaggggatggacagcagcactggccctgtctgcaaggccttcgacaacaccgtcaccgcggtatgcggcacgcgggcgcctatgctcgggtcggcgagacgcgccagctcctcgcggttcagccaccgcacccacggcatctgatccctgcgagcggctggcaacggcgtgacggatgcgctcgggccgctcacggcagtcacggccgtgtggtcctcgcattcccattggctcaacgggctacgggcgtacgacagcgccacaaacactcccccgtgcgactcggcgcgcagacgcatgacgccgcgtgcctgcgcgtacggcatcatcccgtcggcctgctggtacgcggcatcatccaccatcatgaacagggccggcccctcgaccggagcatacatggcggcacgcagtccgatgacgcacccgacctgaccggtcgccgccgccagataggcacggtaccgttccgccggcggcagtcctgcggccagcacgacgaagtcaccggagtatccgccgtgctcggcgccgcccggcgcgaaacgggacagtcccagtccctccagggcaacggcgagatcctcgcactgtcttatcccgggcaggaccaccacggcggcacggttctgcctcatcgcgacagcgatcatccacgcggcgtcacgagcccacgcacgcgctcccggacgcgcatccatcaccagggcggcgaacgagctgctctccagggatgagcgcagcatggcggcgccgtcatatgaagcctgtatcgtgtcgaagcaccgttgcatcagttcgtccgagatgtgcgagaatctgggccttcccacccatagcgaacgcgcggccagttgctgttcgccgtcgatgcgcgccacgcgcgggggaaccgccaggcgaagtatgttggcccgcgtgccgccataggcgtcggcgatgcgcgtgatatcgtcacgcatggattcggataccagcacgtgcgggctgatcacccgttcaagaaatctcagcgcggagcggggcgtggcgctggctgccgcgcgcttccagatcacgccgttgaggagcctgcccccgaaccggacccgcaccatgacgccgggccgtgcggcctgcgaccaccgctcctccacgagatagtcgaatgtctggcccagatgggtcgcctgcacgtccagcaccacctgcgcgatcgggtcttccgcggccacaatcttctcggcgggcgcgcgcttgcggcgtttgcgcggcgccatgccgtcaaacgccaactgctgcgcgtcattcgtactcatggttcatttgtatcacgccaccggtgaagtccgccgcaggcggcaaccttctcggggtgtccggcggcttttttgtgtatgcatgttgtgtgtatagacaagaccacccccggtttcgcttcgcggcagccccgctggcggggacgttacgaagtgaaaccgagggtgatcgttgtgatctgccagtcagcgtatggcggccttgagctcttcgaccttgtcggtgcgctcccacgggaactcgacgtcgacgcggccgaagtggccgtatgcggcggtcttcgcgtaaatcgggcgcttgaggtcaagctcgtcgatgatcgcggcgggacgcaggtcgaacaccttgcgcacggcctgctggatctgctcgcgggtcacgccgatttcggtgccgaacgtctcgacgttgaccgacaccggttcggccacgccaatcgcgtaggcgacctgcagctcgacacggtgcgccagccccgcggcgacgatgttcttcgccacccagcgggtcgcgtacgcggcggaacggtcgaccttggacgggtccttgccgctgaacgcgccgccgccatggtgggcggcgccgccgtacgtgtcgacgatgatcttgcggccggtcaggccggcgtcggcggccggacctccgaggacgaacgagccggtcgggttgacgagctgacggtaatcgtcatgcttgacgccgtcgccgagcacctcgtccagcatcgggtcgatgacatgctccttgagctgggcggccagccattcctgactcgcctccgggtcgtgctgcgtggagatcagcacggtgtcgacgcgcaacggcttgtcgttctcgtcgtattcgatggtcacctgggtcttgccgtccgggcgcaggtgcggcacttcgccggacttgcgcacttcggtcaggcggaaggccagacggtgggccagatagatcggcagcggcatcagcacgtcggtctcgtcggtggcgtaaccgaacatcacgccctggtcgccggcgccctgggcctcgtaccgctcctcgcggctggcctcggtctccttctcgccggtgaggcgcgccacaccctgattgatctcggcgctctggccggtgatggcgacgatcacgccgcaggagtcggcgtcgaggccgacctcggaagacgtgtagccgatgcggcgcagcgtctcgcgcacggtggactggacgtcgacatacccctttgacgtcacctcaccgaacacgaggaacacaccggtcgcggcggaggtctcgacggcgacgtgcgattgcggatcctgccgaagcagttcgtcgaggatttcgtcggaaatctggtcgcataccttgtcggggtggccttcggtcacagattcggccgagatgagcttgcgctcctgattggtcatatcatccctctttcggacttatcgccctacccgccttttgcggataaggcacaatgatacgttggttcattctgttgttgcaggacctgaacaggctacgaaaagggcccgtgccagaccttcggtcggcgcgagccccaagtcgttcgctcctgacgctcagttgtacacgtcaccgccgtcaagggcaagagtgtcgccccagaaaaagcaaataccgcgtacagcgaaccggacggattcagacgaatcagttgccttcgctcagatcatcctcgcccagagtctcctccagcaggccctcgtcgatctcgcggaaagcgatcgacagcggcttctcctggttctggtattcgaccagcgggccgacgttctgcagcaggccctcgttgagctgggtgaagtaagagttgatctgacgggcgcgcttggcggcgaagatggccagcgcgtacttggaatcggcgtgcttcatcagatcgtcgatcggcgggttcgcgaaaccctcgggcacgggcgcggtgccgaactcctcgttgcccttgacctcggtatccttggtttcttctgccatttttgcaagtctccgaatcacatgatggaaatctatctcaaccgcagcgattatagcctcacgcagcgaccggagcgggtccggtggattctgccagttcgttgccgacttgcagacaacataaaaggctacataggctccactgtgagttttgtaacacttatgaaaattccatattccgactcttgacatgtcgcgtgtcccttgcaagagcttgaatagaaccatgactgaaatgcgatctgcaaaaatcatgaacgggcgcgtcttcgcaggtgcccgagccctctaccgtgcagctggcgtcaaaggtgacgacatgggcaagaagcccatcatcgccatcgccaactcgttcgacgagtttctgcccggccacgtccacctcaacaaggtcggccgcatcgtctccgaggccatcaaggaggccggcggcatcccgcgcgagttcaacaccatggccgtcgacgacggcatcgccatgggccacaccggcatgctgtactccctgcccagccgcgacatcatcgccgacaccgtcgaataccagtgcaacgcgcactgcgccgacgcactgatctgcatcccgaactgcgacaaggtcgtccccggcatgctcatggctgcgctgcgcctcaacatccccaccgtgttcgtctccggcggcccgatggaggccggcaccacgatcctcgccgacggcaccgtcaagagcaccgacctcatcgacgtgatgtacgccaccgccgacgattccgtctccgacgaggagctgctcaactacgagaagaccgtctgcccgacctgcggctcctgcgccggcatgttcaccgccaactcgatgaactgcctgaccgaggccatcggcttggcgctgcccggcaacggcacgatcctcgcctcccactcctaccgcaaggacctgttcaagcgcgccgcgcagcaggtcgtcaagatcgcccaccagtactatgacgattccgacgactccgtactgccgcgctccatcgccaccaaggaggcgttcgagaacgccatgaccatggacgtcgctatgggcggttccaccaacaccgtgctgcacatcctcgccatggcgcagtccgccgacgtggacttcacgcttgacgacatcgagcgcatctcgcacaccgtgccgtgtatctgcaaggcgtcgccgtccggcaagtgggagatctccgacattcaccgcgctggcggcatcaccggcatcctcggcgagctcgaccgcgccggcaagctgcacaccaacgtgcactccatcgactacccgacgctggaagccaagctggcggactgggacatcatgcgtcccacctgcaccgaagaagcccagcagatgtacaaggcggctcccggccacatcatctctcccgaaccgtggacgcacaccacgctgttcgactcgctggaccgcgaccgtgccaacggcgccatccacgacatcgaccatccggagatccacgagggcggtctcgccgtgctgcgcggcaacctcgctcccgacggctgcgtcgtcaagaccgcgggcgtgccgcaggagatctggaagttccgcggaccggcactggtggtcgattcgcaggagcaggccatcgaggtgatcctcgacgacacgctgaagcccggcatggcgctggtgattcgttacgaaggtccgaagggcggcccgggcatgcaggagatgctgtacccgacgtccttcgttaagggcaagggcatcggcaagcaggtcgccatgctcaccgacggtcgctactccggcggctcctcgggtctggccatcgggcacatggctcccgaggcggcgaacaagggcccggtggcgctcatcaagaacggcgacatcatcgacatcgacatcgaggcccgttccgtgaacgtcgagctgaccgacgagcagctggccgagcgccgccgcgaactggaggccggcgatggctacgtggcgcaccgcgaccgcaaggtgagccaggccctcaaggcgtacgccgccttcgcgcgctccgccgacaagggcgccacgcgagaccccgagctcatcaacaagctctccggcctcgcgtgacgggatcgtccgttactactcgagaaccgtttcgccggcgtaagcgaaacggttcttctttatcccgttccgaggacttctcccacatcctgccggccgtctctcttccatctgttctatgccccctcaactgtgttcccgactttctctcttcaagtttccctctttcctcgatacaccggtgttcccataacacgacacgcccggattgcgcagcacaatcgttgtgtccggagtccagaacgggtttataccgttacctcgcagcgactattcatcggtcgtgctgcgcactccgggcgtgtcgtatcacgacgactgccatccctgtctcggaccatataccaatcggtcgctcctacgtcaaaacggttccagcagctccggattgccgctcaacgtccacagatccatgcgcggatgcagaaaatcgacggcaccggcatgctccaaagcggcggccacctgactgaagtatcgatgcagttcggcctggtcaagcaccgtactctgccaggccggaagcaccacccaattcttggccgccaatgcgttcatgcgcctcgtgtccgctacatactgttccagatgctgctgcccatgaaattccatcgccacgcgatacttctcgtatgccatgtcaagccatgccaatccagaccccaaatcgaccggatggttcgcctccggattcggcaatccccatttcatcgcatccagacgcagctcccgttcccaccgggaatcggtgttaggacgagacaaacgcaacgcccggcgtgcggccttgccgccatagaccttccgctcatcaaggaaatccatcagttcctgtttggtcgcgcgcctcagccgctcgtcacggcatgtcagccgatccgccaatatgattgtttcctcgaaccagttgaaccgcacgaattgggcgaacgtcgcggcgggtgacgtgcagtacagatcaaagatgcggattacgatacggtcgtccagcaatgaccacgcgtgacatgcgacattggcgggatgaccgcgtcgcgcgtcacgattccgaacgacgatatgttccttgcccaaatcaaggacggcggtctcgggcggtgcaatgcccatcagtcccagcgccgacgacaacgcgaataccggctcatgctccagcgtatccctgaccgcccggcaacgcttcaggtaatagcgctggatgagccacgcctgatgccgcatgtattggttcggtggcggttcgtttcgcatctcaaacatggacgaacggtaacaggttttccggcccggtcttcaggttttcgggcaatgtggtcgaaggctcgattgtgacacgcccggactgcgccgcacaatagtcatgccacgttgtcgaaacattgcaatacagccgttctatggagatgctaccgaggattgtgcaatgcagtccgggcgtgtcgcgcctgtggataactcccggaaagaggaaaggaagagggaaaaggtaaaggaagagaaggaggggaagaaagaaaaaaagaagtcccttgaccatggggtcaagggacttcgggccgcttacttcatgaggttgcgcaggacgtactgaaggatgccgccgttgcgatagtagtccgcctctccgggcgtatcgatgcggaccaccgcgtcgaactcggtggtggagccgtcggtgtgcgtggcggtgacgtgcacggtcttcggggtgacgccgctgttgagctcgtccacgccggcgatgtcgtaggtctcggtgccgtcaagacccagggactcataggactcccccgccgggaactgcaatggcagcacgcccatgccgatgaggttggaacggtggatgcgctcgaagctctcggtgatgacggccttgacgccgagcatcaccgtacccttggcggcccagtcacgcgacgagccagtgccgtactccttgccggccagcacgacgagcggaatatcggcggccttgtagttgagcgaggcgtcaaagatcgtcgaaggctttccagtcgtgaaatcgtaagtgaacccgcccggcgtgacctcctcgccgacggaggcgagcagctggttgcgcaggcggatgttgccgaaggtaccacgcaccataatctcgtggttgcctcgacgcgagccataggagttgaagttcttcggctccacgccgcgctcggtcaggtacttgccagccgggctggacgccttgaacgcgcccgccggggagatgtggtcggtggtgaccgagtcgccgagcaacgccagcacgcgggcgccgtggatgtcggcgactggctccggcgtggccttcatgccgtcgaagaaggtctgcttgcgcacgtacgtcgaatgctcgtcccatgcgaacagctcgccttcgggcacgtcgaggcccttccagcggtggtcgccgtcgaacacggaggcgtagtccttgaggaacatctcgcggctgacggtaccgtcaaccacggccgcgacctcctcgttggtcggccagatgtccttcagatacacgtcattgccgtctgcgtcggtaccgagcggctgggtctcgaagtcgaagtccatcgtgccggcgagcgcgtaggcgatgaccagcggcggggaggccaggtagttcatcttgacgtccgggctgatgcggccttcgaagttgcggtttccggacagcacggcggtgacggtcaggtcgttggcgttgatggcttcggagatctcgggcagcagcggtccggagttgccgatgcaggtggcgcagccgaagccgaccagctggtagccgagcgcgtcgagatcgtcctggaggcccgcggccttgaggtagtcggccacgacctgcgagccgggggcgagcgaggtcttgacccacggcttggggctcaatcccttggcgtgcgcgttgcgggcgatcaggccggcggcgatcatcacggacgggttggaggtgttggtgcacgaggtgatcgaggcgatggccacgtcgccgttttcgatgtcgaaatcgccacggaagtcggtggacacggccaccgggtccttgacggtcttgtcggtctcgtaggcgggtgcggtcttctcgaacatgtccttcgcctcggacagcaggatgcggtcctgcgggcgcttcgggccggcgatggacggcacgaccgtgccgaggtcgagctcctcgtattcggagtactgcggctcgacatagtccgggtcggaggcgtcgccccacagcttgttggccttggcgtacgcctcgacaagcgcgacctgctcctcggaacgtccggtcaggcgcaggtagtcgagcgtgacgccgtcaatcgggaagatgccgcaggtggagccgaactcaggtcccatgttgccgatggtggcgcggttggccagtggcaccgaggcgatgccctcgccgtagaactcgacgaacttgccgaccacgccgtgcttgcgcagcatgtcggtgatggtcaggaccacgtcggtggcggtgacgccctcggggatcgaaccggtgagcttgaagccgacgacgcgcggcacgagcatggagatcggctggccgagcatggccgcctcggcctcgatgccgcccacgccccagccgagcacgcccaggccgttctcggtggtggtgtgcgagtcggtgccgacgcaggagtcgaggtaggcgagctcgcggccatcatccaagccggaggtcttcgtcatgacgaccttcgccaggtattcgatgttgacctggtgaatgatgccggttcccggcggcaccacgcggaagttgcggaacgcctgctggccccagcgcaggaactggtagcgttcgccgttgcgctggtattcgatgtccatgttctgctggaccgcgtcagccacgccgtacttgtcgatctgcacggaatggtcgatgaccatgtcggactggacttgcgggttgatgacctcagggtcgccgccgagatccttgaccgcgtcgcgcatggtggcgaggtccacgatgcagggcacgccggtgaagtcctgcatgatcacacgcgagggcgtgaactggatttcatggctgggctgggcctgcggggcccagttcagcagcgccttgacgtgttcgtccgtgatgttcgcgccgtcgatgttgcgtaccagattctcgacgaggaccttgagcgagtacggcagatggtcgacgccgggcaggtcggcgatgcggtagtagtcatagtccttgccggccacgttcagtgtcgccaactggtcgtctcgcacagacatgcttcctccgagatcaaatgaaatgctattccacaagagattatccgctaccaacgataccgatacgttactttagctctggcgtgtcggcttgatatgtgggaaaattcgcgtcaccgaggcgaggatgacgtgacagaccgcgaacaggaccgtggaaatcagcagcgccgccaccgtggcgatcaatacccgcccggtcggcagatgcaggtcgaagaacctcgccacgaacggaatgaacatgccgatgacgccggccgcggcgaatacggcaaccagcacgccgcgccacgaattgagcggctgcgccacgcgggcgagcatgaacacgcccagcacgaacacgatgatcgcgcaggtggtgcgcaacgcggacaaatcggcggcgttgttcacatcccagcccatcacatcgggcaacagccacgacgacagcagcacggacaatgcgatcgcgacgcctcccggcagcgcgaaatacacgacacgccgcaggaagccggggatgtaacgccgcgtgttcggcgcgagcgcgaggatgaacgccggcatgccgatagtcagcgcgccgacgtacgtgatatgccggggcaggtacgggaacgggatcgcagtgagtaccacgcccagcgaaatcagcgccgagtagacggtcttgacgaggaacaggctggcgacgcgctccatgttcgccatgacctgacggccgcgggccacaacgtcgggcaggtgcgagaacttcgaatcgacgagcacgacctgtgccacggctttggtggcgggcgcggcgttgcccatcgcgatgccgagatcggcctccttgatggcgagcgaatcgttgacgccgtctccggtcatggcgaccacgtgatcactggtgtgcagcgcctggacgatcgccttcttctggtcgggcagcacgcggccgatcacatcgacgttctccagcacgcgggcgagctcgttgatgtcctgcggcagcgtgcgcgcgtcgatggcgtgcggctcgcggtctcctgtaagtcgcactttggccgcgatcgcgccgacggtgaccgggttgtcgccggagatgatgcggcagcgcacgccctgatcgcggaaccatgccagtgtgggctgcgcgtcgtcgcgcacgcactccgaacacaatacgagcgcgaccggctcggcgtccggcagcagttcgggcgactgcgtgaaccatgacgaatctgttgcggcatcgccctcgctcttccgtatgagcgtcgcccgcgcgatgagcagcacgcggttgccggaattcgcgtaatcattgaccgcttcgagcacatcgccgtgctctccggaaagcgcggagagcatcacttccggcgcgcccatataccagacggtcggcggctcgcggtcggcggccgattccgtttccgcggctgcggccggggtgacgatggcgctccatttgcgggccgacgagaacggcacgcgcgctcgcaccgggccggcatggtaaccgcgttcccccagcccgtcgagcacggcctgacccgtgccgttcggctgctcctcgttcgacaggtcatacagcgcctgagtcgccgcgctctccacgcgatcgtcgccgtccatgcgttccagcatgaccagacggtcgaacatgatgccgccatcggtgatcgtgccggtcttgtcgagattgaggcagtccacgcgagccagcgtctccaccgattcgagttcctgcacgagcgtgttcttgcgggcgagccgcatcgccgcgaccgcgaagttgagcgaggtgagcaataccaggccttcgggaatcatgccgacaacgcccgctacagctgacacgatggcctgccgccactcccccgaagctatcgcggcgttccatccgcccacggtcctcatctgcgaccagaccagcagcacgcacagcggcaccaccaggaacgtcatgaacttcaggatcgtgttgatgcccttgttcaggtcggacaccgtcttcttgtataccttggcctgtgcggtcaacgtcgccgcgtaactgtgctcgcccaccgcgttcacccgcgcgagcgccacgccggacaccgccgtcgacccggagtacacctggtcgccgtcctccttgcgcacggtgcgcgattcgccggtcagcatcgattcgtcgagttcgagcccgtatgatgacaggacctgcgcgtcagccggcacctgctccccggaacgtatccacagcaggtcgccgagtacgatgtcgcgcgaaggaacctccgtgttctcgccgtcgcggcgcaccgcataatccgatgtgacgagaatcgacagccgatccaacgtacgcttggccttgagctcggtgacgatgccgataccggtgttgatgaggatgacgaagccgaacaccgcgtccttccatgacccggtgatcagcaccagtaccatcgcggcgaagatgatgccgttgaacagcgtgaagacgttggcccgcacgatgtcgagtatcgaacgcgacgtggtgctcttcaccgcgttcgtctgaccgctctcctcgcaggcgcgcacttgcgaggcggtcaggccgttttcctcgacttcaggcagattcagggttgcattcatacgtactagcctacccgtggcagcataacgggggcaccattcccaggcggtattttcacacacgtcccccatcgagcgcagcaggatgaggtgtggctctcggctgatcaccgcagccacctacgcctccacacctcccgccggcgggaggtggcgcgcagcgccggagggtggtcagacggaatagccggcaggcgatgaaacgccaagccgcccccagtcgctccgcgacagccccgccagcggggcgaaaatacggactaccgctcccgcggaagagctccggatatcggaaggtcaggacaggttgtcggtgacgttcatcgtgcgggggtggggtttgtcgtcgacgatggtgacgacggcgtcgtcgagggcggtcacgccgtctcccttgccggtaagcgtgaacgtgacggcgaataacgtatcgtcgtcgggcggggcgaccggatccaggaggatgacgggaacgcccgccttgcgcgcggactgcaacgcggcatcccagtcttcggcgttcttctcgttgacggcaatgccgtcgatcatgatgacggaggccttgcgcgtgaccatgaaccgcactccgcgctgcgcggcggcatccggatcgtcgaccatgctggtggatacgtagggtgccttcaacccggccttgttgaaggcgttcagcacatcagagtccaggccggtgtccacggagccgatgacgccgacgacgatatcctgccgttggacgccctcatgggcgatctccggttcgctctcctgcgtatcgccgaccgccttgccctgcggcacgcaggaggtgagcgacatcaccgcggccgcggcgcacgcgatgccaatcccacggcgccacatgcgccgcaggaacccgcaatcatgatcgccgcgtacccgacccatcgcctcaccgtccgatgcgtgtgaaccaggccaccgtctcaacatggtgggtcatcgggtagatgtcgtacgcccgaatgtccgacaggcggtacccgagcgagatcagcgtcgccgtgtcgcgggcgaggctggtcgggtcacaggcgacatagatgacgtccttcgcgcctgcctgcgcgatctgacggcacaccttggcgtgcgcaccggcgcggggaggatcgagcacgactagatcgggtcgtgacagatgggccggcacgtgcgcgagcgtggcggacacatcgccgcaacgggcgtccacatcaggcaggttcaacgcgcggaggttgcgttgcgcgttcttcaccgcggtcttgccgccctccacgctgagcatgcgcgtgcgttcggcgatcatcgtggccagcggcagcgtgaacagtccggcaccggaatacaagtcccatatgcaggcggaggtcatgccgtcaagcgccttgttcgctaggtcgatcacatggccggcgagcatgaccggtgcctgacggtgcacctgccagaagccgttcgcgtcgaccatgtattggaagtcacggccgttcacggtgacggtctccatcagatgccggtttccggcgcgcagttcgccgtccacgagcacggcgtaattgccctcgatgggctgcttcctcggttcgggcacagacaggcgaatttgggatccgggttcgaacccgccatcccacacgtgttcgcgatcggcgacggcaagcaggttgtctgtcgcgagcggcatcgtgtccagcggcacgcgcttgtgcgagccgcgccgacgcatcgacggcctgccgtcgtcatcggcgatcatctcgatgcgggtgcgccagtgcaggccgccgttctcagtgtcgccttcggcccgttccaccggcacggtgacgtccacgtgcccgagacggctcatctgatcgctgatggtggcggccttccagcgaagctgcccttccaggctcacgtgcaccagatcggcgccaccgacgccaccacccatggcaagcggcccggccagcggccatgcgggatccacacgatcggggctcggttcgatgacctcgacgacctcgccggtccagtagcggtcgtcgcggtcgtgcggttcatccaatgcgacctgcaccagctcgcccggcagggcgaacctcacgaataccacacggccatcgatatgcccgacgcatcgtccctggtcggcataacgttcgatacgcacttgcgcgttcattgtttcctttcgcaatttgaccggatcaggcctgtccggctgcgttgtcaccttcatcaccgctgttgtggccgtcactgtcaccgtctttgccgccgccggccgccgctttggccgcggcgatgtgccggtgcagcggggtggcgatgatcagatacgacacccatatcgccagcgcccagaacggtatgcccatcagcaggcgcgccgtgcccagcagcgccacggaatcggcgaggtacagcggcacctgcacgatgagacgcagcgcgaacacgccgatccacagcacggtgacgatcgtgtaggcgcgcctgagcggcttgtcgtccagccagccgtgcagccacgcgcggaaatgctcggtggggatggtacggatgaactcgaccatgagccccagaccgggcacgcggatgagcagggtgaaggacagcagcacgatgtacacggcgttggtgaggaagccgaacatgtaatagttgcgcgcttcatgactctgccacgcccatatcaggcagatgccgacggcgatcaggccgctgagagcgcccatgaccgactgccgttgcacgagcctgatgacgacctgcagcaccgccagcgccgcggagacaccgatcgtgagattgaggttgctggtgacgacgaacaacacgacgaacaacacgcccggcagcatcgattcgatgacgccgcgcggcccgccgatggcgtcgatgacggagaagtcctccccctcgcccgcggcggcgagggacgccatacccgtacgtttcttctggttctgatcggtcatgctcgttccttggctcccggcgtcgagcgccgggattcgtcagcggacttcggagaacatcggtccacgcgacagcgtggtcttgacctcggtctgctgatcggagtcgaacggcccttcgggcttgtccgggatgtcgtcgaggtgctccttgtcgtcagcctggtcattggtcttggccgccgcctgacgctgggcgggggtcaccggcgggtgcatcgggatgagatcacgcggggcgagcggctcgtcgccgcgctccacgacgatgtcggcgaagtacttgttgagcgcttcggtgtcggagttgccgtcatcgttcgcggccttgccggagaagatgccgcgcagcatccaacgcgggccatccacgccgacgatgcgcgtgttcacagtcttgccgcccttgacggtgaccggcaggtggagttcggtgccgaacacgcccgcgtgttcggatgccttctcgttggcctcaagcaaatcggcgcgcacgtcgtcccacagacccatggtcttgggcgccgcgaacgcctcgatctccaggctggacgcgccgtagctgatggtcgcgccgaggatctcctgggtgctgcggttcgccttgatgcgcagctgcaagcccgcgagatacggcaggtagtaggagcccatgtcgaggtactcgtcgtaatccggcacgttctcgtcatcgacgtcccacggtccgtaggattcgccgcggccttcgtacgtgtccgccacgtcggtcggggcggcggtctcctcggtgtcgacggcggcctcgtcctcgcgattctcggccttcgcttcggcttcctcgcgttcacgcttcttcttgccgaatccaaacagtcccatgggttcctcatttcgttgtacaggttgcaaccgtgactagcgtagcactagggcttgtgattggcttggaagacgccgccggattgtcgccggtccgaacggccgccgcatggcccagagcgcgtcatggattgcacgatcacacgtcatacgtgacggtcagcggcgcatggtcggaccagcgggcgtcatagctgggcgccttgtcgatgacgaagcctcgtgccgtctcggcgagttccggagtggcgaactgatagtcgatgcgccagccaacgttgttgtcgaacgccctgccgcgctgactccaccacgtgtacggcccctggatgtcgccggcgagcgagcgtatgacgtccacgaactcgtactcccccagccagcggtcgatgtaggcgcgttcggcgggcaggaacccggcatgcttgatgttggccttggcgttcttgatgtcgagcggcgtgtgcgcgatgttgaagtcgccgcacagcacggcctgcctgccgccgcgcgaggcctcgtcccgcagctcgcccatgcgcgtgagcatggtgtcgaggaagcggtatttctgcgccattttcaccggatcgtcgctgttgcccgcgtgcacgtacacgcatgcgacggtgattccatagccctgtggcgtcgtcacgtcggcctcgatccatcggccggaatccacatcctcgtccagcccggacaaaccgtatcgccgggctgtcacgggcaggtcggtcagcagcccgacgccggcgcgtcccttgacgcggcagacctcgttcatcgccgtcagctcgctctggtcggcgatcttgccggcggtggcgtattcgaacccgaactcgccgaatatcggatcgagctcgtcctgcggggcacggacctcctgcatgcaccagatgtccggggcgtgctcgcccgcccatgtctcgatgcccttgcgcttggcggcgcggatgccgttcacgttggatgtggtgatggtgatcatggggccatcctatatccgtcccgttgacagtgcgagccgcagtttcgaccggaatcttccgctccccgctcacacacggcctacgtaggcggagtagactgcttcgtggcagtttttcattccgacaataggaaaggatcatggacatggcttccaaccagcccgacaacctggcactgactgcggaacagctcagggaatactccgcggcgttcaacgcggaccgcgcgaacctcgtggcggcgaacgcggcggtatcgaacggcattctccaggccgcgacctcgtatcgcggcgtgcgcgagctcccccgcacgttctcggtcgaactcaagcagggttcgatcacctcgcaggagcattccggccgctgctggatgttcgcatcgctgaacacgctgcgctacgagctgatgcacaagtggaacctcgacgatttcgagttctccgaaagctatctgttcttctacgacaagctggagaagtcgaacttctaccttgagaacgtgctcaagacgctcgacaagaccacggacagccgcatcttcgaggcggtcaacgaaggcccggctgacgatggcggctggtggcagatgttcgtcgcgctggtcaagaagtacggtctggtgccgaaggaggcctacccggagtcgtcgaactcccgcgattcctcggcgttcgagcagtacctgaacacgaagctgcgcgagttcgccgccgaattgcgcgacgcccatcaggccggcaagtcggttgaggagctgcgctcgctcaagaccgggcagatgtcggtcgtgtaccgtatctgcgctatcgcaatgggcgagccaccgacgagcttcgatctgctgctgcgcgtcaaggacgagggcaaggacgacgccaaggatgacgccaaggcgtccgagtccggcacgaagtccggcatcgactcgcgcaggcagatcgtcgaacacggcatcacgccgcaggagttctacgcgaagtacgtgggcgaggatttggatgatttcgtgagcctgacgaactccccgctcgcctctaccccgtattaccgccgctatcagctggcgttcgtgggcaacgtggcggaggccgctccgatggacttcatcaacgtgccgctcgacgtgttccgcaaggccgccgtcgaccagctgaccgcaggccacccaatctggttcgcctgcgactgcgcgcagttctcactgcgcaaggccggcatcttcgatcgtggcaccgtgcgcgtggatgagctgttcggcaccgagttcgcatcggacaaggcgcacggtctggaatacaacgattcgcgcagcaaccacgccatgacgctcaccggcgtcaacctcgacaaggccggtgagccggaccgttggaaggtggagaacagctggggcaaggacaacggcaaggacggctactatgtcgcctccggcgcgtggttcgaccgctatgttcaggagctcatcatccgcaaggaatacctggacgagcgcacgctcgccgcggtggattccgaaccggtgaccctgcagccctggcagccgatctccaaggtctgccgctgagcggggtataaccccgctcagccagcgtgaccacctccagtcagtcatgccggcagcctccgctatcgggggctgccggcatggccggctgggggtggtccagcatcgtccacacatacgagaagtcccccgtgactttgcagccacgggggacttctatatcgctatctcaatgagatcgatgaatcagacgactcacttctcccagccgaggttctcggggtgaacggtcaccatgacacgcgcgccggaggagtagcctgcaggaccgtagttcgcaagacccttcttgacggcgacagtgatctggccgttctcgaacgggatctgagcgtacagcttctgggcttccttctcagccttgttgaactgagcaatggccttggtgctgtccttgatgcccgggatggactcgagctccttgtcgatctcgtcggtgccggtgaaggagaagttggactcggacttggagccgtagagctggtaagcggaggacgcgtagccgaacgggtcgctagcggaccagccgaggccgatcatgtcccagttaccagagctgacggtgtcggagaaggtgttcgacgccttgatgtcgatgctcaccttgatgccgacggtcttggccatcttctggatggcggttgccttggccttggtggaggcggagtcggagaacgtcgtgtacgtaatggccgcgaccttgccgcccttctcgtagtagccgtcgctgttcttcttgtagccggcgtcctcaagggtcttggtggcgttggcggtggagaacttcgactcagcgggcatgttgtcctcgtagccgtcctggaactgaggcagaatcagggagcccggggtcttctcggtccattcgataccctggaagtcgatcttctgcagctggctgcggtcgacgccctggacgaaggccttgcggacctccagcgggatgttcttggtgttgatggtcagcgtgtacacaccggagtcgtaggaacgacgcaggtaagcgtccttcacggtcttcgcgctcgtcatggactcggcgtcggaagcgccgacggcgtcaatctcaccgttcttgaaggcgttcatggcagcggacggctccatctgcttgagcacgaccttgtccagcagcggcttgtcgccccaccacttcgggttcggggtgaaggtcacttcggagtcggagctcttggagacgacgaacgggccggcgccccacttgtcggagtgagagtcgttcgaccaacccttggagaaggtgtcgccgtccttggtgtcgtcgccggtgagggcttcagacgggtacagcaggttgaacagggactggtaggggtagaagtccttctcgaacgtcacgacggcctgcttgtcggtgtcgcccttggtgacgctcttgatctggtcgtaaccagtggtgagggccggggtgaacttgtcgctcttgccgctctggaccttccaggtggactcgaagtccttccaggtgatcggggtgccgtcgttccaggaggccttgtcgttgatcgtgaagacaacggtctcagggctgtcggaggtctgctcgaccttggtcacgtagttggtgttcggcttgatgttctccagggaaccatccgccgggtactcccagatgcacggcatgtagaagcgccacaggccgctcatgtacacggtgttgccgttgacgtcaatggcgttccagttcgggccgatctcggtgatcggcagggtgagggtgccaccctgcttcagctcgccgcggtccttcgggttgttgtaggccttgcccggatccggcatcgggaacgaaccggtgtagttggtgggaacaccttcctgcggttcggaagtggacttggcgccgttgttgccggcgctgccgttgttgctgttgccgcaagcaccaagcgccagaagcgtggctgcagcggcggcgaaggcggtgaccttacgcgcggtagatgcaaaactcatactttgcattcctctcctgaacagcacgagttgcgcgtgccgttctctccttcaaaatatctcgcaactagaaccgtgatgatacaccacgttttgttaacattggcgtcacttttcacttttcggcgaaaccaatgcaatcgggccggtcatatgaccggcccgaaagactttagaacggcgcggattcgtcgttcacatccagcgggaagtgacaggcgaattcggtcgctatctggtcatccgacgtcaaaaccgggcgtttcgtctcgcacatcttctgctgctcgggagtgagccgcagcttgacggggcagcgggacgcaaaacggcatcccgggtgcttctcggacggagacggcaggtctcccttgaggatgatgcgctggcgggtgcgctcgaccacggggtcgggcacggggatggccgacagcagcgcctgcgtgtacgggtgacgcggatgggtgaacacgtcctcggtctcgccgagctcgaccacctggccgaggtacatgacggccacgcggtcggagatgtggcggatgaccgccagatcgtgcgcgacgaacaggtatgagatcttcagcttggcctgcaggtcctcaagcaggttgatgatgcccgcctgaatcgacacgtcgagggacgcgatcggctcgtcgagcagcagcaccttcggatcggtggcgagggcgcgggcgatggagatgcgctgacgctgcccaccggagaactgcgccgggaagcgatccacgtagtcggggttcaggccgaccagctccatcagctcgccgatgcggcggttgatcttctccttgctccacttgtgcaccttgagcggctccgcgagcacgtcgtagatgggcatgcgcgggtcgagcgagctcatcggatcctggaagatgatctgcaggtccttgcgcaacgccttgcgctccgccttcttcttgagttcggcgaggtcatggccgagtacgacgatgcgtccgtcctcgggcttcatgaggttcatgatctccatcagcgtggtggacttgccggagccggactcgccgaccagcgccagggtctccccctgacgaatcttgaacgtcacgtcgtcgacggccgcgacctggccgatggtacggcggaacatgccaccaccggtcagcgggaagtgcttgaccaggtggtcgacctccagcgtcaccgggcgctggtcgcgcgggacgtcggcccagtcggcgggaagcaggtcgggcacggggaacacgtccgtgtacttcatgttcttgtcgatgatctcctgcagtcgacggcaggaggcgagatgaccggagttcgcgtccacgacttccaggttcggctcagacagcgagcactccggggtggcgagcgggcatcgtggcgagaacgggcatcccttcgggatgtcgaccagcgacggcgggttgccctgaatcggcacgagacgctgggaggcggcgatgtgcggcttcggcacggcgccgagcagacccatcgtgtacggcatggaggggtgctggaagatgtcgtcgatgctggcgcgctcgacgggacgaccggcatacatgacgaggatgtcgtcggccgcgccggccaccacgcccagatcgtgggtgatgagcacgacggcggcgccggtctccttctgcgccttggcgagcacgtcgaggatctgcgcctgaatcgtcacgtcgagggccgtggtcggctcgtcggcgatgatgacgtcggggttgttcgcgatggcgatggcgatcatcacgcgctgacgcataccaccggagaactggtgcgggaagctgctgagacgctcctcgggctgcgggatgccgaccagttcgagcagctcgacgcaacggtcgtgaatctgctgcttggacatgtcgggatgatgggtgatgaggccttcggcgatctggtcgccgatggtgaacatcggggtcagggcggacagcggatcctggaacaccatggcgatacgctcgccgcggatctcgctcatctcctcgtcggtcttgccgatgagctcctcgccgttcatgatgatggagccggtgaccttggcgttgtcgtcgagcaggccgatcaggctcaacgcggtcacggacttgccggagccggactcgcccacgatgccgagcgtacgcccgcgccacaggtcgaagttgacgcctcgcaccgcacggcacacgccggcctctgtggcgaaggacacgtgcaggtcgcgcacctgcatgatcggatcgcccttcggcgcgcccttggggccgttgccttcaagcagctcgtactggaggatgtcgtcgcgcacgatctccttgtgctcgcttgagacgctgccctttgacttgttgtttttcatcattgtctttctgaacatcaggcacccaccgttccgctcgcacgtgaattgggatcaagcgcatcgcgcagaccgtcaccgatcagctgcatgctgaacgtcaacaggaccagggcgatggaggggaagaccagcagccagggagcggtctgcatggacacggcgccggactgcaggacggaacccagcgacacgtcgggcgccttgacgcccagaccaaggtacgacagtgcggtctcggagttgacagcgcccacgacgcccagcaccgtgttgatgatgatcatcgaggcgaggttcggcatgaggtgacgcacgatgatcttgaacgatccgacgcccatgaaccgggccgccttgacgtagtcgcgctcgcgcagcgacaacgtcagcgttcgtatgattcgcgcatagccgacccagccgaacgcggtcaggccgatgatcagccagatccatccggtggtggcgttcgcggtgcgcacgatcattgcgatcagcaggaacgacggcacgacgagcagcatatcgagcagccacatgccgacgcgctcgacccagccgccgaagaaggagatggccgttcccagcagcgaggcgatcgccatcgtcgccaccgaggtgatgatgccgatcatcagcgacttgccgagaccacgcaccaccatggcgtacaggtcggagccgccggagtcggttcccagccagtggctggcgctcgggcctgccgacagggcgaggaagtcagggtcgtcatacgcccacttgccgatgttggcgccgaacagcgcgaagaacaccagcaccagaaggatgatcagtccgaccacggcggagcgctgacggaagaaacgacgcgcgatcaggccggcgtaaccgatgtgcttgatatcgcccttcgacgtgctctcgtcggactctttctgtgtcgtttcgttgtttttgacggttgtatcagtcattgtttctcacatcccctgcactcagctcatcttgatgcgcggatcaagccatgcggacacgatgtcggccagcagcgcaccggcgagggtgcacacgccgccgaacgccgcgatggcgaccgaggcattgatgtcgttgtcgagaatggcctggatgaagtaccggcccaagccgttgatggcgaagatagattcggtgatgaccgcgccggtgaacaccgaggcgatggagaatgcgacgttgacggcggtcggaatcagggatgcgcgcaacgcgtggcgacggatggcctggcggcgggtcagacccttcgcacgggcggtgcgcacgtaatcggcgtgcatctcgtcaagcaggtaggtgcgctgcgtcagatggtaggagaccatgcccagaatcgtcagcacgatggtcggcaggatgatgtgctgcccgaaatcagccaatctcaggaaccagttatttcctgtataactggacagacccgtcacatagaacaggcggaagccgctggcgccgttgatgaagatggcgagcatcacgacaagcagagcgaacacggcggtcgggatgacaaggaagaacgtggcagtggtgccgaacaggcggtcctgccacttgtactggcgctgcgcggtgtagatgccgagcgccacgccaagcacgatggaaaggactgtggcgatcgtcaccagctcggtggaggcaacgatacgcggcgcaagcgcaccgttgaccgaccccagatcaggggacagtccccagtcccatctggtgacgacaccggtcagccaacgccaataccgagtgaagatattggtgtgatcattgatattggccagatccaagctgcggttgatggacgctgccggagggcggggagtcctcgactcgtaattcgagcgcggacgcatgaaaccagaagccagaaaatacgtacatgaaatcgccacgaacagcatgacgacgtagttggcgaggcgcttggcgatgaacttcagcattgagccggggccatccttcctccttgttccgaacgacaaaagcgttcactcgactgtcgcctttggatggcggcgttcttgttggtgaccgattatagtcaccccatgtaaacgcaaaacgtgataaggatacgcttccgtcaagatttcgacgttaattgccacattttgttcatatttgtatcacatttcaagattttaaatgatgtgaacgtgcacaattcgcctgttgcaccccggaatcatgcggattgcagggcaatcgaggcgaaatcacgggttgatcgcaagatgaccgcagggtaagcgcagggtaagcgcaggatgaccgcggagttatcgcggagttgtcgacgtaggcaatcgcgggacgatcaagctcggaacgtgacgatgtcaggcccgaggaaacgcctggcggtaccgctccttcagctgctcgatcgacacatgcgtgtaccgctgcgtagtgcgcaacgacgaatggccgagcatctcctgaacctcgcgcaggtccgctcccccgtccagcatgtgcgtcgccgcgctgtgccgcagcgaatgcgggctgatatcgggcaccccgctctcgcgggcggcacgatgcacgacatcgcgcacgatacgctggtcgatgcggcggccgcgcatgccgaggaacaacgcggccgtatcgagagtgcccgcaccggctctgcgcaatatcaatggtcggccatgctccttccagccggccagcgccttctcggcagggtcgccgaagggcaccacgcgctgcttgctgccctttcccgtaacccgtatcgtgcggtgggaccagtcgacatcgccgatgtcgagcccgacgagttccgccacgcggataccggtcgcgtacagcaattccagcatggccgcatcacgtagcgccacgacttcgtcacgctgactcatcccttcgccccgatgggccgaatcaaggcggggcatctcatcatgccgtgtctcgtaacgctgcgatgaggcggcatgcagcgacgcatcgtcatccacacggtccatcaggcgctccgcctgggcctcagtcagcaccgaaggcaacgtgtccggcagtttcggcgtcatcagcacggccgccggatcggcctcgatcctgccatgctcatgcgcccaagcgaaaaacgaacggaccgacacgaccttgcgggccatgctggagcgggcgtggtcgcgggtctcgaacgccatccatccacgcaggtcgtcggtcgtgacctgacgcagatctgcgatgccgcgcgacgccagtgcatgcaggcactccctgacatcggtgccgtacgccttcaccgtattgcccgacaatcccctgttggcccgcagatacgcaaggaacgcggacagatcaccatcgccatccatgcacactcctttctttgccgattctatcccgcaaaaccgcgtttcacccactagaatggaacaaaccgacggcaaaggagtccccatggcaattcccaatgaaatccctgccaacgcgcgagtggtcgtccgagtgtccgaaggggtcgatccgaccgaccatcgcatgaaataccgcgattacgtcggacacgtcacctcatgggacggtcacacgttggatatgatccgcgacgcggcggccaacgggtcacgccccgaacatcgcgtgaccatcgacgccgacaccatcatcaccctcaaacccgtccccgaacgccacttcacccgcccctgagctgtggtgccgtcaagcccctagtcagcccgtggccgactaggggtggtctatcgtcaagtagcccgcagcatcacatcgcgctgcgacgctgcacgcaggcggtatagtcgtcgccgaaacgcaggatatgctcgccgcggcgggcggaatcgagcagtgccgcctgccatccctccgcgggtatcgtcaggtcgaagaccggcccgtccccgtccgcaccgcttctgaccgcggacttgtagtcgcggaacggctgtccatccgcgaaaaacgcggcgatggcacctgcatctgcgccatgcaattcgtccgcgacctcggtaagccgcgccgccatcatgcgcagcagtcgttccacattgtcggcgtcctcttcgaccatcgcacgggtgcggtccggatcggtcagcgcgacgcgcgtcatgtccctccagcttcccgcggcgagcgcagctgcgatgttgcggtccgggtcgtcggtcagctggttgatgagcgccgtggcgacgacgtgcggcatgtgtgagatcagcgcggcagcgcggtcatgggtatcgtcgtcgagcacgatgacgcggttgcccgcatcgtcggtgatcatccgcgcgacggcgagaaaacgacggtaatcggtgtcgccatccacggtcatggcccacagcgcgttgtcgtagagcgccggggcagcggcggcccatcccgagagctcgttgccggccatcgggtgcgcgccgacatagcggcccgccagacccgcgtcccgcacctgatcgcggaccatcatcttgacactgcccacatcggtgagcgtgatgtcctgatacggttcgagcagcggccgcaactcgccgagaatcgccggcatcgccttcagcgggttgcacagcacgatgacctccggctgcgcttcgaccagttcggcgagcgtgcgcatgcagcgtatgccatcggcttcggcctgggcgtatggatgcgggcgatggttccacgcgacgaccgacaccccgcggatggcgagccttcgggccagcgacccgccgatcaggccgagtccgatgactccgaccgtgagccgtacggcggccgcagtatcatgacttcctaccacagcaattcccttcgcgcagtgtcgccttccgtccatgtgccgggcgcggccggctcgcggcgcactcccccgttgggcagcgaccacgcgtagatcggcgggttcggccgttcgcggcgcggatacaccgccagcgtcttcacccaatcgccatggtcgacgacctgtgtcagcacgtcgcgcaggtgttcctgccagggcgctgcatcgatggtcgcgatgaaactgtacgtgccgtcgcgtcccttaatcgggcgagatatgaaactcgtcatgttcagaccggcgtcgcgcagcacgtccagcagattcgcgagcacgccggggcctgtgctcagcggtatgaacgcgatgatcgattcgtattccgaaacggggtcggtcgtcgcccccggagccggcatcgatcccacggtctcatccccggccgtccgtgatgcccgctcgcgcagcacggtgatggcctcgtcccgcggggcgagtgccaggaactcggtgcgcgcgccggcatagtcgcccacggcggaggcgacgcgcgtcagattgtacaaatcgccgcagatgctcggtccgagcgccacctggccgggctcaaggtctcggcaggcggcaccattcgacgatgccggcagctgctgcagctgatggtcggccgtgaaacggcggcattgcgccagcccgtgcggatgggcggtgacggtacggcaatcggcgagtgatgcgccgggcaaggtgaaggcgtcgaatgacacgttcacgccgactcgggcgaatccgaccacattgtcagcgtcgatgagcgcgtcgaggttcggcacgacgtacccttccacgttgttttcccacgcgatgatgccccagtcaccccgacgctgcaccgcgtcaagaatcgtcgggacgtccggctcgggtgtcagcgtcacggatgcgccggatgggcggatcgtcttggcggcctcgatcgccgcctgatgggtgaacgtcccggtcggccccaggaaatgcaacgtatactcggccatcatcggctctccgccagcgtgtcgggagtctgccgggacacggacagctgcgatggctgctgcgaattcttgtcgtcggtcttgtcgtcggtctttccatcggtcttgggcgtgatggcgaaccatcgcgcgggcaggaacatcagcatcagctggacgacgatgcagccgatcagccacaggtatcccacacgctgggaaaaatacggcaccgatgatccgctgaatccgaccggcgtcaacgcgtcgtcggtggattgcacagcgatcagccataccgtgccggacgaggcgatcaggtgcagggcgagaccgacgacgtcaagccgcgagcgtgcacaccacgccgatatgccaagaatcaggaaggcgagcaccagtccatacggaatgttggccgaagcgcccatgcgatgcgcgaacgtgccgacgatgccgcacaggatgccggcaacgacggtgacgagtccgcgcagcacggggctgagccgatgagaccaaggcagaattgaacgatcatccgattgagtcatggtcaccagtataaggagatgcgctgtatcggcgcggtgaaatctcgctccgctggcgcaatgagccgtatggcaaacagcggaagccgtgtccgcaggccatccaattacaggccagaaggcccggcgaactcatatcttgcccccgctggcgggacataacaccatgccgctgccgcagaacatgccacaccagcgtcaaaacaggcaaaaatcgcattgtgtggccaacatattgccacacaatggaatgttagccctaacattcgctggtatggcaacaggcaaaatcatagaaaccgccatttttcaacgatgaacaaacattcgtcccaatcgcaggaatttccgtcgtaccacaccagccctaaaaacgccgaaatcggcctggtgtggcacacagacccgtcagaacagcccctcgaaaaacaaaaacggagagcccaatggactctccgtaatcagaagcaagcagacgggcgcgcaatcagcgcccgcgacggtcgtcagaacggcaacgccgtcaggcgttgttgttctgacgacgctgcttggcacgccacttgtaccagtcctcacggctgaggatgatcttgcgcacgcgaatcgcctcaggggtgacctcgacgcactcgtcctcattcgcgaagtcgagcgactcctcaaggctcatcttgatcggcggagtcagcgtttccagcacgtcggcggtggaggaacgcatgttggtcatgtgcttggccagcgtgatgttcacgtccaactcgtccggcttgttgttgatgccgacgacctggccctcatacacgttggactgcggttcgacgaagaagttgccgcgggcctgcagccgctgcatggcgtacggggtggcaacgccggcgcggtcggaaaccatcgagccgttctggcgggtgacgatggcgccggcccacggcgcgtagccggcggacagcgaggaggcgatgccggtgccgcgcgtggcggacagcagcgcggtgcggaagccgatcaggccacgggacggcacggtgaactgcagacgcacccagccggaaccgtggttgctcatcgagtccatgcggcccttgcggtcggccatgagctgcgtgacggtacccatgtattcctcgggaacgtcgatggtggtgttctccatcggctcgttgatcttgccgtcgatggtcttggtgaccacctgcgggcggccgacggtcagctcgaagccttcgcggcgcatctgctcggcgaggatggccagcgcgagctcgccacggccctggacttcccaggcgtcggggcggtcggtgggcagcaccttgatcgacacgttaccgatgagctcgcggtcgagacgatccttgagcatgcgggcggtaagcttgtggtccttgccttcgcggccggccagcggggagtcgttggtgccgaaggtcatcgagatggccgggtcgtcgacgtggatgagcggcagcggcttcgggtcgttcgggtcgacgatggtctcgccgatcatgatgtcgttgacgcccgcgacggcgacgatgtcaccggggccggcggattcgacgggagtgcgctccaggccctgcgtgcgcagcagttcgacgacgcggaagttctcgatggaaccgtccacgcgggacaggccgtaggtcttgcccttctccagcgtgccgttgtagatacggaccaggccgagtcgtccgaggaagtcggaggagtcgatgttggcgacgtgcgcctgcagcggcgcgccctcctcgtattcgggggcggggatgtacttgatgatgtcctcgaacagaggctcaaggttgtcgttgtccggcaggccgccgttctcgggctggttgacggacgcgtagccggccttcgccgcgcagtagacgaccggcaggtcaagcaggtggtcaaggtcgaggtcgacgccttcctcgatgacgtcctgggcgaggcccagcagcaagtcggtggattcggagacgacctcttcgatacgggcgtccggacgatccaccttgttgacgcacagaatcaccggcagcttggcctcaagggccttgcgcagcacgaaacgggtctgcggcagcgggccttcggaagcgtcgacgagcagcacgacgccgtcgaccatcgagatgccgcgctcgacctcgccaccgaaatcggcgtggccgggggtgtcgatgatgttgagcgtgatgccgtccgggtaaccgtacttggccgccagcggaccggtgtattccacggccgtgttcttggccaggatggtgatgcccttctcgcgctccagatcgttggagtccatcacacgatccggcacctcctcgcgctcgttgaacacgtgggactgctggagcatcgcgtttaccagcgtggtcttgccgtgatcgacgtgtgccacgatagccacattacgaatatcaccgcgaaccgccatagaaacctctcttaattgattcttcgcgtaaccgttcggtacttgttttggttcatatctgtacttacacgcaaaccggcacaagcctagcgatacgccttgacacacaaccgaaccgtcctccgacgagtaacagcacacgttgcccccgcagggatcgttgactggagaccatgtgcactaatgcgtcagctcggtgtaggagtcttccaaggccatggagatgcgctcgatttcctcccgtgtgaggggacggcggaatgtcatacgcagggcggatctggcgatctgcggtttcagccccatggcaagcagcgtgccgggaatctcgtgacggccaatggcgcaagcggatccggacgaggcggctatgcctcgggcgtccagatcgacaagcagagcttcgccggtgactccggggaaaatgaatgacgcatgtcccggcagacgactgaccgggtcgccggtgagttcggcgcgaggcaccacccgccgcacggcgtcaatcagcatgtcgcgggaatccgtcagctcccggtactgcgccgccatgcgcgcgttcgactcgttgagccctatggcgagcgccaccgcaccggccacgttctgcgtgccggagcgcagcccgcgctcctgaccgccgccggaaagcaccggctcgatcggggttcgaccgcggaccagcagcgcccccagtcccttgggcgtaccaaacttgtgtccggacacgctcagcgcgtccacatcccaatcgcgcatgcggatgggaatctgcccggccgcctgcacggcgtccacatgaatgggaaccccgtgcgcgtgggcgatgcggaccagctcctccacgggttcgacggtgccgacctcgttgttggccagtatggcggaaaccagcgtggtgcgttcaccggtctcgccgtcgagctcctgttcgagcgtgtcaaggtcgaggtgagcctgaccgtccacgggaatgtgcacgacttcgaagccgaaccattcgtgcagccattgcgccgattgcgcgacggccgggtgctcgatggatgagatgatgatgcgcggacggcggatcgccggatgttcaccggcctgtgcggggtccacgccggacggctcgtcatcgattccggcaagaccgtagaccggctgcaggccgagtgcacgcatacgtgccatggcgatgcccttgatggccagattgtccgactcggtgccgccggaagtgaagatcacgtcgtccgggcgggcgccgagaccggcggcgaacgaggcgcgggcggcatcaagcgccctcgccgccgtcttgccgggttgatgcacgcttgccgggttcgcgtatgcgtcggtcatgaacggcatcatcgcctcgatgacgttcctggtcaccggctcggtggcagcggcgtccagatacagttcgtcgggttcgccggatgcattgggagtgtcagccatggctagttccagtccaatccgaggtcgatgctgcgtacgctgtgcgtcagcgcgcccactgagatcacgtccacaccggtggcggccacggccggcacgcgctccatgctcatgttgccgctggcttccacgatggccttgccgttgatgatatccacgccgcggcgggtgtcatcgagcgagaagttgtcgagcatgatggtgtccgcaccgccggcgagcacggcgggaatctgctcaagccggtcgacttccacttcgatatgcgtggtgtggcccacctgttcgcgcacgtggcggatcgcgccggtcaggtcgatgccgcgtgcggcgagcgccgccagatgattgtccttcatcatcaccgcgtcggacagcccgtaacggtggttgtggcctccgccgcagaccacggcgtatttctcgaacgggcgcaggccgggggtggttttgcgcgtgtcgacgatgcgagtgcgctcgtagcgatgcggccgggtgacggtcccgtcatgtccgtcatcgtagatggcgttgaccgcgtccacgaaggaggcggtcatggtggcgatgccgctcatgcgctgggtgaagttgagggcgatgcgttcggcggcgagcaggtcacgtaccggaccttccacggtggcgaggacctggccgcgctggaatcgctccccgtccgcgatcaggggcgagacgccgataccgggattttgcgccgtgaaggcggccgtgaacacggcgatgccgctcatcacgcctctctcgcgtgcggtgaggtgcgccgagccggtttcgtccgcggggattgtggtctcgcaggtgatgtcgccgtagggcgcgtcttcggcgagcgccgcctcgacggcggtgcggatgatgtgttgcgtaagcatgatcgggtctttcttgatatggactgctgtcgttcttgcgggattaatcgcaatgcatcgggtcagggtaccgagaccactccggcggcgtgcaacgacagtccggtgccaaccgacaagtgagcaaacagcgctaggcgttgatgtaggcgatggattgggcccactcgtcgcatgactcgggatagtcggtgcgggcgtgggcgccgcgcgactcggtgcggcgcagcgcggcgttggcctcgacgtagccgacggtgagcaggttgcggttttccaggcgggtgatcgggtcaggctcacaggccgtggcagcgggttccgtcgcgtcggcatcggccaacgccaggccggtgccgagctggtcgatggcctggcgcaggccgtcgccgtcgcgcaacacgcccacgccggcccacatcgtgttctggatgcgggtgcgatcccagatggcaggccggccagtggccccggcacgctcatcgggtgccggcatgctcagctcgaccggtgtgtcgctgacgatgcggccggtggccgagttggagaaccagaccgggttccacacggaaccggccggatcgttcacggcggcgagcccggcgcgacgaccgtacaccagtccttcaagcagcgagttcgacgcgagccggttggatcccatcacgccggtgcgggcgcattcgccggccgcatacaggccggggatgctcgcgcgaccttccagatcggtgcggatgccgcccatgtagtagtgcgcggcgggcgcgaccggaatcggctccttgctccagtcgaagccgagagaacgcgtataggcgtcgatggtcgggaaccggtgacgcaggaactcggccagatccgggttctcgcggcgcatcggagagacgtcgagcatcacgggcttgccgccctgcgcctgcatgacgcggaagttctcgcgggccaccacgtcgcgcggcgcgagttcggcgcgctcgtcgacacgggtcatgtaccgttcgccgtgttcgtcgagcagcaccgcgccctcgccgcgtaccgcctcggaaacgaggaagtgctcgcccacggccatcgcggtggggtggaactggtagaactccacgtcggcgacctgtgcgccggcacgccatgcggccgccagaccgtccgcggtggcgacggccggattggtggtgtacgggtagagacgtccggcgccaccggtggcgaggatgacgcgtgaagcggccatgtcggcgctgcggaatgtctcgccgcccctgacgagcagccgcacgccggcgatggcgccgtcgcgcacaatcaaatcctcaaggaacgcatgctcgatgatgtggatgagcggattggcccgcaccatggcggacacatccagttcgaccaccttgccggtggcgtctcccccggcgtgcacgacacgggcccgcgaatgcgcggcttcgaggccacgcagcatgtggccttgcgcgtcacgatcgaaatgcacgcccgcggcggcgaactgccgcacacggtcggcgccctcgcgggtcagtatctccacggcacggggctcgcacagaccatgccccgcggccatcgtgtcggccgcgtgcagtttcgggtcgtcgtcggcgaagaccgccgcggcgatgccgccctgcgcatggtaggtgttggattccaccaggtcggccttggtgaccagcgtcacgtcctggccggcatcggccaccgccagcgccgcggaaaggcccgcgacgcccgcgccgactacgacgatttcagcgttgctcattgtgctgcttcctcaatattgttgatgtgctcccgttgacgggagcttgcgatcacgggtgcacctggagcatgcgctccagagccacctttgcctcgcgtgcggtgtcgtcgtccacggtgatgcggttgacgatgttgccctgttcgatgttctccagcgcccaggcgaggtacgccgggtggatgcggtacatcgtggagcacgggcagaccaccggatccaggcagaacacggtcttgtcggggtactgcgcggccaggcggttcacgaggttgatctcggtgcccacggcgatggccgatccggccggcgcgttggcgatctccttgacgatgtacgcggtggagccggtgccgtcggccgcgtccacgacctgcatcgagcactccgggtgcacgatcaccttgacgcccgggaacgcggcgcgcgccttctcgatctgttcgacggtgaagcgctggtgcaccgagcagaagcccttccacaggatcatcttggccttggcgtagtcggacgggtcggtcgcgccgccctgcgccttgtacgggtcccacagcggcatctcgctcagcggaatgcccatcgcgcgggcggtgttgcggcccagatgctggtcggggaagaacagtacgcgcttgccgcgcgcgaatgcccattcgagcacggcgtgcgcgttggacgaggtgcacacgatgccgccgttgcgtccgcagaacgccttcaaggccgcggacgagttcatgtaggtgaccgggatgatctgctgcctgccatccgcgtcgggcttggtgccgcagatctcgccgagctggttccaggcctcctcgacctggtcgatgttggccatgtcggccatcgagcagccggcggagaggttcggcagcgtcacggtctgctccggcgtggagaggatgtcggcggtctcggccatgaaatgcacgccgcagaacacgatgtggtcggcgtccgggcactgcgtggcgttcttggccagctggaacgagtcgcccacgtaatcggcgtggcagatgatctcgtcacgctggtagaaatgccccagaatcagtagcttgctgccgagacgggacttggccgagcgaatgcgctcctgcagctcctcgtcggaggcgttgcggtactcctccggcagcacctgctggcgaggcgcgttgtgcggcagcttgtcgagcatggacgcgcccggcccgtagctgggcttggtggtgtcgaaatgccacggatcctgggtcaggccggcgtcgcaggtgctctgcgcaccgaggcgggcgatgatctcatccactgacagggcggacaatgttgcgctcatggtgtgttcctttctctaaggcgtgcgggcacgccaacgtatctgacaaccgggtggccggccaaaatcaatatgcggttatacggcacggacgcgggtcttgccgcccgcctcccgtcatgcgcgtgccgatggcatcaacgcggacagcgcgtcctcgatgcgctggtcctccagctcctcgatggtcggcgcgtcgcgtggcggcccgacgggtggggccgtcgacgcgcgggaacggtcggggttgtaccggtacacggccgccgggcggtggcggccatcgcgcagtttctcgccggtatcctccagctcgccggacaacagcatgcgacgccggaaattcgccacgtcgatggcctcgccggttatggcctcatacacgtgatgcagctggcgcagcgtgaacgtgtcaccgaccagcttggtggcgatatccgggtattcgatcttgttgcgcaggcgccacaacgcatagtcgatgatctgccgatggtcgaaggccagttcgggaagctcgtcctcggggaaccaccggacgttgtccgcctcggtgaaatcatgggcttcggccttgccgaccagcgcccagtagacgatggagaccatcggcaggccaccgtgcgatcgcgcgggatcgccgaacgtatacagctgttcaaggtagcgaggatgcaggtccgtggtggtctccaacgcgtggtaggcggactgctccagcgaacggtcggcgcgcaaatcgccgcccggcagcgcccaccgccccagaaacggctggcgcacgcggcgcaccagcggcagccacagacgcgagggcatcgcgtcacggcaatccgacgcggtctcctccggccccagggccaggatcaccacggagaccccgacggccggcggttgcatccgccgctccgacacgtttccgccgaccatgcatgcccactttccgactggtgtgctctccagttcaagaccagagcatatcacttatagtcaacatgactttaagtggtgtgtcatgcgaggccgcggaggcggcataacctacatacgctgaaacaccgaccaccccagtcggcttacggccgacagccctccggcaactcctattcgccgtcggggacgttggtggtctcgcgttcgggcaggaatggggcgagcgggggcagctggtcgagcgactccaatccgagatgttccaggaacaggccggaggtcaccagcagcgcggcccgggaatcctcgtccacgccatcctcgcgaaccagtccgcgcacggtcagcgaacgaatcacgccgtcggagttcacgccgcggatcgccgcgacctgggcgcgcgtcacaggctgcttgtacgccacgatggccagcgcctccaacgctgcctgcgacaggcgcgcggtctgcccgtcagtcacgaacgccgacaccacctgctcgtattgcgcccggctcgcgaactgccagccacgcgcggtatgccgcagctcgaagccgcgcccctcctcgtcatactgcgagctcagacgctccagcgcggcacgagcctcctgctcgcccacgcccagaacccgcgccaggtcggcggcgtgctgcggctggtcgacgaccatcagaatcgcctccatgcaggccctcagaccacccggaaagtcctccgccgtgaattgcgcatccatcacgtcacctttctcgctcacaaaacgtcgagatataaaaaaccaaaccgctattttccaatacgatgccgcctgtatcttcacgttttgcgagcctcatgcgaagtccccctccgcgatgtcgaccacaccggcgtcctgggcgtcttcgacccagcgcagatgcagcgtctcgaatggcccggcctgccgaaactgcagcacgccttgcttgaagaacaccagaaccgccagaaaacgcgcgaccacctctacacggcggtgtgcgtcacgcgtcaattccgcgaacgtcatcgaaccgccggccggcaacgcctgcaaccggtcgcgcacgaccgccgcctgcgcacgcaggtcgacaagcggcacatgcagctgatgcagcgacacctcgctggccggcgcgttggcgaacacctgtgcggcgatgcgcgccaagtcctctgcgcccagcgaccatgcaagctccggcagcatcgccgcgacacgttcatcgacatatgccggatgcgggaacctgccggcattggcagcgagccgggcgcgaaaatcgccggccgcctgtttgaacgcacgatactgcaacagcctggcgaacagcaggtcacgctcacgcagcgcttcgagactctgctcgtcgcgctccccatccgcctggtcatgcggcagcagcgccgcgctcttcgcctcgacgagcaccgaggcgacatcgaggaacgcgctcgcctcctccatgttgcgcgcgagatccagcgtgcgcacataggcaaggaactcctcggtgatctccgacaacgacacctcggtgagctccagccgccggttcgcgatcatggacagcagcgcgtcgaaaggccccgaatagacctccagttcgacggagaatcccggggagacggcggcatcgcctccgatcccgccgccgtcggcaggttccgtcaactcgctcatcgcatcgcgcttgcgccgctcaccatggccgcgccatcacgcgacgatgccgcgggcgatcagctcgcgcgacacctcgcggtattccttcgcggtcttgtggccgggagcgtagatcgtgatcggggcggcggccacggtggcgtccggcagcttgatggaccgcgagatgaccgaatggaacaccttgtcctggaacgcctcgtagatgcgctgcagcacctcctcgcagtgcagggtgcgcgtgaacatggtgaccagcacgccgtagacctgcaggtcggggttgatgcgcgactgcaccttctcgatggattgcatgagcagcgccacaccgcgcagcgcgaagaactccgcggcgaccgggatgatcacgccgtccgcggcggtcaaggcgttcacggtgagcaggcccagcgacggctggcagtcgacgatgatcacgtcgtattcgctgcggagctttcgcagcacgctggcgaggatctgctcgcgaccgacttcggtgaccagctgcacctcggcggcggacaggtcgatgttcgccggcatgatgtccagattctcgaaatccgtgtgctgtacgatctcgtgcggatcgatcgacgggtcgaacagcgcagtatacacggtgttctcgacagcgttcgcgttgatgccgaggccgactgtcgcggctccttgcgggtcgaagtcgacgatcaggcaacggcgcccgtactggctgagcgcgccggcgatgttgatggaactggtggtcttgcccaccccgcctttctggttgcatatggcgatgatgcgcgcgggaccgtgctgcgacagcggtttcggcgcggggaacgtctcgtattctcgtccaagcagagaccggtgccgaaatccaccaatacggtgcccacctgttccatacttccaccaaacgcgtctgggattacgtcaaccgcttcaccgcattcaccgactatgtgcatcgcgtgtacgccacgcacgacggcgaggtctacccgctgccaatcaatctcggcaccatcaaccagttcttccgggcggcctacacgcccgccgaggcgaggcaactcatcgccgaacaggccggtgaactggccggcaccgacccgacaaacctcaacgacaagggcatccagctgatcggacggccgctgtacgaggcgttcatcaagaactacaccgccaagcaatggcagaccgatccggccgaactgccggcgagcatcatcaagcggctgcccgtgcggttcaactacgacaaccgctacttcaaagacacatgggagggactgccgcgcgacggctacaccgcgtggatggagcgcatgatcgatgacccgcgcatccatgtgacgctcggcaccgacttcttcgacgagagccagccgctcaacaagaaggcgctgcgcgccgccggcacgcccgtggtctacaccgggccgattgaccggtatttcggctatgaactcggcgacctgaaatggcgcacggtggacttcaaggaagtgcgctacgacgaggacgaccacttcggctgcccggtgatgaacttctccgacgcggacgtgccctacacccgcgccatcgagttcaagaacttcaacccggagaggcgtgacgcacagaaccacaacaggacagtggtgtgggaggaatactcccgcttcgccgagcgcggcgacgaaccgtactacccgatcaacacggacgccgacaaggcgctctatgagcggtacgcagccagggcagccgccgagccgaacgtcgtgttcggcgggcgcctgggcacctacaagtactacgacatgcacaacgtgatcgacgccgccctcaccgcatatgaggagcaggtcgcgccgatgctgcgcgcccggtgacaccgactggcgggcacttccgccgccgccttttctcatttcatccggatctcccgcccatctcatccggccacagtctcatacgttcaccggaaagtgggactatgaccggatgaggcaacgccgcaccgctttggccgggcccaaaccagcgaagcattcatacaatcccacaatgcagaatccgactcacattaaggacggtcatgaccgtcaccgtgcgacggtatcgtcgccgtgtgagccctcgcacagtgacgcatccggctaaaacccttattttccaacgtttctcacgataccgtcacgccgagaggctatggttgtggttttgctagatatagacaagcaccaagcacgatatcgacgtttgtaaggattcagaggaaaaccggtgaggaaagcgcgaaaatatgcgcaaaccggttcgcatcatattgcaaggactacggtagaatcatggcttcacatacgcgcactgttaattccagttcaggccgacgcgcggcaggaacgtccggccgtcgggcggccggcgcctcaggccgcaccgcgaccggcacccaagcgggtgcagcgacgggcacaagaaccggcggcaccgccgcaaccaacggttacagcgcgcagcgcaacagcggctcaaggcgtggccgcggcgctaatccgcccgaaggcacacaccgcggcggcggcacccaccgctcccccggctcgaaaggcccgaaagccaaagggcgcaagaagcatctgattctcaagtgggcgctcggcatcatcggcctgttcctcgccgtcggcatcggcgcgttcgcctacctgtacgccaccatcgaaatcccccagccggagaccatcgcgctggccgagaaaaccagcgtgtactatgcggacggcaaaacgaaaatcggcacgttcgccgagcagaaccgtgagatcatcgactgctccgcactgccgaaatacgtgggccaggccgtggtcgcctccgaaaaccgcacgttctacacggaccgcggcatcgacctcaagggcatcgcacgggcgctgatcaacaacgtcaccaagggcacccgccagggcggatccaccatcacccagcagtacgcggaacggtattacctcggcgagaccaccacctacatgggcaagctcaaggaagccatactggcagtcaagatcgcgcagacgcaagacaaagacaccgtcctgtgcaactatctcaacaccatctatctcggccgcagcgcctacggcatccaggccgccgcccaggcgtacttcggcaaggacgcgaaagacctgactgtgcccgaggcagcgatgctcgccggcatcatcccgtcccccagcaactgggatccggccgtcaacgccaagcaggcgaaatcgcgattcgagcgcgtcatcaacatcatgaaagaggacggctacatcaccgccaaacaggcccgtgaagccacgatgccgaaaaccgtcaccaacgcacagcagaacatctacgagggccccaacgggtatctgctgcagatggtccgcagcgaactcatcaactcaaaggcgttcacgcaagacgacctcgacaccggcggctacaccatcgtcaccaccatcgacaaatccaaacaggatctgatgtatcagaccgcgagccccaccaagggcaacgcgggcatgccggacggcgtacagaccggcggcctgtcggtcaacgtcaaagacggttcaatcatctcgctgtacgcgggcgaggattacctgaagaaacagctcaacaacgtcaccgacgcgacctacgaagtcggttccacgatgaaaccgttcacgctgctttcgaccgtccagacgggcgtcagcctcgatactgtgttcaacggcaactcgccgcgcagcttccccgggctgaaacagccgatgtcgaactcgggcggcgctagctacggctacatcaacctgtacaaggcgacggcgaactccgtcaacacggtgtacatggatctgcagcagcatctcggcgcggacacgataatcaagaccgcgcacacggccggcatcaaaggcaagatcaccgatgacggctacgtgacgctcggcaactccggcctgagcatgatcgacatggcgcgcggattctccaccatcgccaaccaaggcaagaagccgacgctgcacatcgtcgccagcgtgaagagcagcaaggggccggaactgtacaaggcgccatccaccgcggagcaggtgttcgacgcgaacgacaccggactggtggtcaaggcgatggaaggcaccatccaatacggtaccggtcgtgcggcgagcgcgatcggcaagacgatggcgggcaagtccggcacggcaaacgacaacaaggccgtgagcttcatcgggttcacaccctcgacgctcaccatgttcgccatctggaatcccggagcgaacggcgaggcgctggaactgccgaccatcaacgggtattacaagggcatgggatatccggccgtgctgttcaccaactacatgtcgagggcgctggagaacgtggcggacgagaagttccccgacgtgaccgacagcggcaagatcggtggacccgatggcacgtggggcaccggttcgcagtactcgtcttggggcaacagcggccagtcgcagagcgggaattcgcagggcggcagcaagagcgacgaccagtcgtcgcagagcggcacgcagtctggcgacgggtcgggctcgcagtcgacgacgccgcagaccggcaacggttcgaatggcaacggcaatggatcgggcggcaacgggtccgatggcaacggcgggaacggcggcaacaacgggaataacggcaacggagggaacaacggcaacaacggcggaggctcggattgcgcgaccgaccccaccgccgccggctgctccaccggcaatgaatccagcaccaacggcatagcgtcgcagtgagggacgaggccggattcgcggttattagcgtgcgttgaccatccccaccggcgggggcacgagggccaggccccgtgcgactggaggtggttccggcctctcacgaccatcaaaaaagggtggctgcaggacgaatcctgcagccaccctttcgtttaccgcgaaatatcagcgctgcgaacggttgatcgcggagatgatcgccttgagcgcgctggtggtaatcgaggagtcgatgccgacgccccagatgatctgggtctcagcgtcctcgcccacctggcattccacgtaggacgcggccatggcgtcggtaccgacggacatggtgtgctccacgtaatccatcacggacgcctcaatgccgaggttggaaaccgcgttgaggaacgccgcaatcgggccgttgccgatgccggagatctcacgctcgtgaggttcgtccacgcccacattcacgccgcggtcgagcacacgcgccttgagcacggtgtctgaaccatcctcgccggaactgacggccaccttgagcagtttgaggcggccccacggagcgagcgtcgcgtcatgcgtatcgccgacgaccacgccggcggccgtcatgccggactgctccaccggcaggtactcgtccttgaagagacgccagatgtcctcgtccttgacttccttcttggtcgtgtcggcgaagttttgcacgatcttgtcgaactccacctgcagacgcttcggcaggtcgaggttgtggttggtcttgagcaggtaggccatgccgcccttgccggactgcgagttgacgcggatgatcgcctcgtaggtgcggccgatgtccttcgggtcgatcggcaggtacggcacgagccacacgaacttgtcgagatcggcgccgactcggtccgcagcgacctcgcgggcttcgaggcccttcttgatggcgtcctgatgggagccggagaacgcggtgaacacgaagttgcccgcgtacggatgacgctcggagatcttgatctggttgcagtactcgacggtcttgcggatctcgggaacgttcgaatagtcgatctgcggatcaatgccctgcgtgagcatgttcagacccagcgtgaccagatccacgttgccggtgcgctcgccgttgcccagcaggcagccctccacgcggtcggcgccggccagcacggccagctcggtggctgccacgcccatgccttcgtcgttgtgcgggtgcagggagagcaccacggcgtcacggtcatcaagatgcgtggacacgtactccacctcatcggcgaacacgttcggcgtagtcatctcgaccgtggccggcaggttgatgatcatcgggtgctcgggggtcggcttgatgacgccgatgaccgcattgcacacctcgaccgcgtattccggctcagtaccggtgaacgattcggggctgtactcgtaatacaggtcgatgcccttggcctcgttttcaaggtccttgcacagctcggccgcgtcggtggcgagcttcttgacctcttccttgttcttgcggaacacgacctcgcgctgcagcacagagaccgagttgtagaagtgcacaatcgcacgcttggcgcccttgagtgcctcgtaagtgcggcgaatcaggtgctcacgacactgggtgagcacgacgatggtcacgtcgtcggggatgagctcgcgttcaataagcatgcggatgaagtcgaaatccgtctccgaggcggacgggaagcccacctcgatttccttgaatcccatggagacgagcaggttccagaagcgcagcttgcgctcggagtccatcgggttgacgagcgcctggttgccgtcgcgaaggtcgacggagcaccagcgcggggcacgctgcagacgcttgcccggccacgtgcgctcgggatagtcgaacggcacctgcttgtcgtaggcgacgtacttggtgtaaggcatatcgctcggcttctgcggctcgccgatgaatcgtgcgggaggcagcagcgggtcgttgttccccccattggacgccgcggcgaccgccgcaagatcaaacactgatgattgatcctgacccatatctcctcctttacttgatgatgccggcgcctgttgcctgccggccgtatgttgtcgtcgcacgataggtcatgcaattaatcagtctagcgtgaagcgccccggtaaaccgccgagatatcaagaatgcggccaatccatgcggccttcggagcgttatctcgcttccgagggggtgatttcaggcccgccgaacatctatctgcgtttcaaggggttggcgttgctcgatattcgaggtattgcatgatggacgccactggaatcatgcggctcccatgccattgatactcggccaccaacccctcgaaatgcagatagatgttccggagcgtccgagtcaccccctcgaaacgtagataccctgccgagataacgtttcggcccctctccggacgcccgttgactgcatggcgacgcccgctccacgcgtggtggcgacttcgcgaagagtatggcgccgcacagggcgactcgctacagtggagggcatgacactgcgttttcacgacgacggcacgttccgcgtgctgcaaatggccgacattcaggacggcccggaagtcaaccgcgacacgatccgcatgatcgaggccgcaatcaacgaggcgaggccggatttggtggtgttcaccggcgatcaaatccgcgggtacgatcccgcgtacatcgacacgttcctgcgccggcgcggcgagaaccccggcgcacgcgtacgtctcgtcaccgaaatcgaggcgaagctacacggcatccacaggcgcatcgcggcgcggcgcgatccggacctgccaccgcaggacgatgtggtcacgatggacgacctgatgaacgacacccggcagaaagtgcgcgacacgttcagcgcgttcctcggaccggtcatcaacgcgggtgtgccgttcgccgcgacctatggcaatcacgacttccagtgcggcatcctgcctgacgagcaggacgacatctaccgcgagttccccggctgcctgaatcccgaggccgatgtggccggcggctcgccgttggccatcgagccgggcacattcgcgctgcccgtgctgtcctccgacggttcggagcatgtggcgatgggcgtgatgctggtcaattccggcgattatgcgggcaatccggaggagaatgacgcccagtacccgcggtatgtggcgcattcgcgcggactcgacctagcggattcggacggctacggcacaccgagcgctgaggcgatcgcatggctgggcgacgtgcagcgcacgctcgccgagcgcaacggcgatggcgaaccggtgccgtcgatcacgttccagcatattccgccgcaggaattctatgactgcctgaccgaggtcccggcatggacgccgaacgccgtggagggcgcccgcaattacgccgggcgctgctacgtgctcaacgacgccgtatgccggccggggtcacggctcggcgaggcgatcggctgcgctgacgagaacgtcggcgaggtggacgcattgcgcgaggcgggcggctatttcgcgttgtactgcgggcacgatcacaagaactcgttcgtcgggcacgtgcatgacctcgatctagggtatgcgccgacgtgcggcttcgaatgctacggtccgaagtctcgcctgcgcggcatccgcctgttcgagttccgcgaggacgacccggccgcgtatgagacccgcatgctcacgtggggcgacctggtcggccgttacagcggcaatgagttgcgcgtgttcttcgaggatcattgcgtgacgggcgccgcgaccctgcgcaacgaactgcgccggccgcaggtgtttgccaccgtcgccctgaccctatccgccggcttcgcggcaatcgtgcgctccatcgcacggcgtctgcgacgatagcgcagcggcggcaaacagacgacaaagggcatggttccggcggcgatatcgtcgacaccatgcctattcatatccgccgtatatccacccggctcgtccccgggccggccctacctctactcggtcaggtacagcacgttctcgtcaaggggggaacgacgttcatgtggtacccctccattttcaggaacggcttggagctgtcaggcttggcatggcctgacacgtcggcaactggtagctcgcgccggccagtccctccagtttgttgctgctgatgccggctggcacatagcaggatttgaatcctttcttgccgccgcagcgatagtcgctatccggccccatgagctcgatgccgacgtccgacggcaccttccaccaaccgtcaccacccgtgtccgtccggcgtgcagcgtgaccgactgcggatcatcggggctcagcatgagcttgcccgagccaaccgaggtggccttgcccttgtcgtccaacgtcaggcaccaactgtcgtctttcaggcagtatttgcctgctatcggctagaaatcgcctttgccgagtgcggtgcgaacatccgtcaggctcatgtccttggtgggcttggccgatgatgcaccgccgtccacgccggcgctgccgcccggctacttgacatcggcgtcgggcagctcaccccaatccaggtcgatggagacggtcagatagtacacggtgtcgtcgctgggagcgggcttcatcttgacgatgtcgcttttgctgccgacgtagccgttgtacggcatgaacgggttggcggagttattggtcatgtccgccgtggtcttgtcgtagagcttcgggtcacggtagatcaggaacggcttggtcgtgttcacggctttctgtttcttggccgcggccagcgcgtccgcgtcaaagtacccgtcgctttcgagcttgttcaggtccgcgccgaccggcacgaccagatagaagtcctgcatgtgatacgtcgcgccggagatattgttgtaatcgccgttttcgaccatcttgccgttgttgcagacgatgccgcctgccgtattcgagtcttcctggctggtgccgcaccagtagttcgtcatactggatcgcgggaacagttcgaacgcgccggtgtcaccggtgagcaggtagtcagctttcgggctggagcagtacggctgctggatggcatcgcaggagctcagcgactcgtattcgccgtattcggtaccgtcgcgacctttcggataggggatgtacgagttgccttcgctgccatcgccgccatccttgaacgtgatgcagtcaccggagttgttgcaccacgttcccgcggccacaccggagacaccgagcagattgtcgccgccggtctccggggaatcgtgaaccgtgtaggcgtccttgacgccgctggcgtcgatgccgtaatacagcgtgaccgcatcgccttccgctactgtggatccgggcatcgggtcggaaccggacactttgccgacgaacttcttcgaggcgaggcgcggcacgagcgtcacgtcatgtccttggctttccagttcggatttcaccgtgtcgacgtcccggccgacgatgtcgatgctgatggcgccgccgtcgctcttcgtggcgacgccgatgtagatgccgtcgtccttgtcgccgtccgacagcgcctgtccttcggcggggtaggtcgccaccacggaaccaattggcttcttcttggtgtcggacaccggtacctgcttgtaatgtaccggcacacccatcgtcttgaacgtggatacgaccttcgtggcctgcttgcccatcgtgttcttgggcacaccggggccacccgactcctggacgattaccgcggcgtccttctggacgcgatcgccgggcttcatgccctcgtatccgaggaacacgcccttcttcttgccggagaagatgatcgccttcgatgccttcacacccttggctttcagctgggtgaccacgtcatcggcggtggcttcgccgccggacgcaccggagatctcttcggcggtaggcagcggggttccgccccagatgcccgcgcgatacgtgaagaacagggcaagaccgatacccaacgcgagggcgatcaccacggccacgatgaggccgatgagcttgcccctggatttgggcttcggcgttttccctggcacggccggcgtcgccgctgatggctgggttgcgggcgcggccggagtcgagactccggcacctgacggctgggcgaactgctgggcttgcggccacgccggttgggcaacaggctggagcggctcctgaggtgcagcaggagccggcgcgaatccgccgcctggcagtggtacagctggagtcgccggctgttgcgccgcagagggctggggcatctgcgatactgcgggctgcgacgccggcgcggcctgtgatacctgttgttgcagcggctgcccgcagttcccacagaatttgctgtccgggctctcgtcattcccgcaatatgggcacttcatgcgtgtccgcctttctcccccgcccaatggcgtctctcatcattgcccgccggcgcgaaagcgctcgcgaacacatcaagaacatcataaaaccgggcgtcgtacaacacagtgtcacatatcaggaaacaccaagcatccatcggtcaccctcgcacagtgacacgtgcggcggcccagcgaaggcgacagacaagcgctccagcgaaattcagtggaacagactcacgccgcgccgggccatgcagtaggcgttacccagccacgtgtgccgcgagttcggccacacggcccccagacgcggcgcgttctggctcatccagatgctgggcacgcgcccgtcggcgctgcgagagccgagcaggttgaacccgttcttgatctcaagccaatcggggtgctgcgtggcaatggcaagaccctcttcaagggtcagtggcgtgcgctcgtcggaatcgatgagcttgcgcgccacgtccggctcgcgattgatgtagcaggtgccggtatgcggctcgacaaccagatagaacggcccttccggcggctcgaacccgtcctgcggcaggaagcttgcgatgtcgcgcggaggcattgtcgtgaaaccggccatgcggttgatgctggttcgggcgatcagcgactcaggcgacaccagctcgcgcgtggggatcagcaggatgttcgagcccagatcggtatgctccaacgcatggatcagcggccgtgcgagcgcgcggaacgcggcggcgctcatgtccgccacgtccgggtagcccagcgccacgatacgatccagctgcttctgcgcttcctgcgatgctattgacatgcttccagagtaccgcgaatcccggccgcagcacccacccatcggcgaacacggccatcattcgggaaagcggcccgtcttgttccgcgcattccgtaccattggataggtgcggccatgtcactgcggccgcttgtataggaaaccgaatcaaacccagaggttgttatgtccgaaaagttgaaggtcggcattcttggcgccacaggtatggtcggccagcgttttgtgacactgctggagaaccacccgtggtttgaggtggtcaaactcgccgcgtccgcgcacagtgcgggaaagacctatgaagaggccgtcggcccccgctggaagatggaaacgccgatgcccgagtacgtcaagggcatgacggtgcatgacgtcgccgatgtggccggcatggccgatggcgtcgatttcgtcttctccgcggtgaacatgtcgaaggacgagattcgcgcaatcgaagaggagtacgcgaagaccgagaccccggtcgtctccaacaacagcgcccaccgttggacgccggatgtgccgatggtcgtgccggagatcaacccggagcatttcgcggtgattgagcaccagcgcaagcggctcggcaccacgcgcggcttcatcgccgtcaagccgaactgctcgatccaggcgtacacgccggcgctggccgcgtggaaggaattcgagccgcgcgaagtcgtcgtcagcacgtatcaggcgatttccggcgcgggcaagaccttcaaggactggcctgagatggtgggcaacatcatcccgttcatctccggcgaggaggcgaagagcgagaaggaaccgctcaaggtgttcggtcacgtggatgccgacaagggcgagatcgtgccgttcgacggcggtctcaagatcacttcgcagtgcatccgcgtgcccgtgctcaacggccacaccgccacggtattcctgaactttggcaagaaggccaccaaggaagagctcgtcgaccgcttggtgaactacacgtccaaggcgtccgagctggggctgccgcacgcgccgaagcacttcatccaatacctcaccgaggatgaccgcccgcaggtcaagttcgatgtggactacgagggcggcatgggcgtgtcaatcggccgtctgcgcgaggattcgatctttgactggaagttcgtggggctggctcacaacacgttgcgcggtgccgccggcggcgcgctcgaatgcgccgaaatgctcaaggcgctcggttatatcagcgcgaagtgacggcagcctgccgctgagactgaaattgcggctggagaccatcgaacggccgggttgaccacggattgattccgcagtcaacccggccgttcggcatatcgggtgtcgtcaccgacgcaggtgacgtgcattgccgcgcggattacggcggaatcgtaccgtaacgatcacggcgactatgaccatggcgagcagcagcagtgtggcggcgaccgtcgctgccacaaggagccgcataattccgttggaacgttccatgtgctcctccttcggctcaggagcgcgaatgaatacggaaggaggaggtaagaacgctcaaaccagataaattgaccacccagccggctcctgctgtcggagatattccgcgtagcgggcggggtggtcaattacgcgattgcgtcaaaaatcagcgaccggtgccgccgtagaccacggcttcgacctgatcggcgtcgaggccgtaggcggtgtgcagcgcgcgcacggcgtcgtcaagctggtcgagcgggacgagcgccgcgatgcggatctcggatgtggagatcatcagcacgttgatgcccttgtcgctcagagcggtgaagaacttggccgccaggccggaatgggtcttcatgccaacgcccacgaccgcgaccttgccgacgctcctgttgatgtcgaacgacttgtagcccagctcgtcatgcttgtcgatcagcacgttctcgacttccttgacggtggattccggcacggtgaaggagatctccgcggtgcccacggacgcgccggcctgcacgatcatgtccacattcacaccggccgtcgccagctcggtgaacactttcgccgccatgccgggctcgttcggaacgccgcgcacggtggccagcgcttcgctgcggtcgtgcgccacaccggagatgaccggggcttccgggccgaggtcggggaacaggtcacccatggatttgctgttgttgtcgctcatgttttttcgcctttatatttgtgtgaacggtaaatcaggtctcgaatatgtcgtatgtcagtggacgacatcagtcgatgttgggcaggctgcgcgggtcgactccgtcgggcacgatcagcgtgccgggacgatgcgagaaggagctgcgcacgtgaagcggcatgttgaaccgctgcgcgtactccacgcagcgcagtgccagcaccttcgaaccgcaactggacatctccagaatctcgtcgtagccgatgaccggaatgcgactggcctttggcacgatgcgcggatcggcggtgaacacgccatccacgtcggtgtagatctcgcagatgtcggcgccgagcgccacggcaagcgccacggccgacgtgtcggagccgccgcggccgagcgtggtggcgtctcccttggcgttgatgccctggaagcctgcgacgatggccacgtctccgagcgacagcgcgttctgcacgcggtcgggcttcacggccttgatgtgcgcggcaccgtaacgggtgtcggtgaagaatccggcctgctgaccggtgaacgaatgcgcacggtccccggcggcgtgaatggccatggcaagaaggctcatggagatgcgctcaccggcggtcatcagcatgtccatctcgcgctcgggcgggttggagtcgatgctcagcgcttggtcgatcaggtcgtcggtcgtgtctcccatggcggagacgaccacggccaccctgttgccctttttcttggtctcgacgacgcgcttggccacgcgcttgatcgattcggtatcggcgaccgacgagccgccgtacttctgcacgatgagagccactgctgtcctatcttctcgcggaatgcatctgcgtcaatactacgcaagcggcacgattataggaatttcggcactgccgcgcacgcgtgcgccgccatgcggacaggaacggccgcgctgcgggcgcaggtatccgggcgatgattcgcgtcggcggcgccgggacgggccgacgctggcagcctcgtttatgcttcgcggcgacctgtgagggcccgaccgagcgtgacctcgtcggcgtattcgaggtcgctgccgacgggcagaccgctggcgagccgggtgaccttgatgccgagcgggctgagcagacgactcaggtatgtcgtcgtcgcctcgccttcgatgttggggtcgagtgcgaggatgacttccttgacctcgtcagtcttgaggcggtcgagaagcttggggatgttgaggtcggccggtccgacgttggccatcggattgatggcgccgccgagcacatggtattggccgcggtattcacgggtgcgctcgatgctcatcacgtccttcggctcttcgaccacgcagatcaccccgtggtcgcgtctcgggtcggcgcataccgggcacggactgacctcgcacacgtttccgcagatgtcgcagaaccgcactttttccttgacttccgtgatggcgtcgaccagcttgcccgtctcctcgtcggaggccgacagcagatagaaagcgatgcgctgcgcccctttcgggccgatgccgggcagtccggcaaatgcgtcgatgagtcgctgtatcgcgccgtcatatgccaaagccattggtgtgctcactccgaatcatgtttgttgacgtgctggatgttcctggggttcttggggtcgtcggggccgtattcctccaccggcttgacgacttcgaagaactgcttgacgtcgtcgagactcatcgtctcgggcgagccaagtgaaacgtcattcatcgaatattcgtcgtcttccggtgccacggtcggcatgggaatgtcctcctgcgcatacgggtcggctccggcgaacggatcggtgtcgtcatacgcagggcgggatgctctctgaccggctgcggcaccgggagtctgctgcagatgcgtcgttcccggttcgactccggggttttccgggcgcccgggcgcagccaagtcgtcggaaggcccttggagagctgccgggaagcctgcgcttggtgcggcgatgctcgacgaagcggaagcgactgatgacggcatgccagcccaggggtcttccgcggacatggactccggcacggcggtggggccagggttggtgcgctcggagtcctctcgcgactgtgactgcgcatgggcaacgttctgaggtgtgccgggcgcgtcgccaccgcgtacaccgtcaacgggcatactgttaccgccgtcgttggcccacgggtcggtgtcgtcgctcaaatccggcacggcgatgtgtttcgcgtgatgaccctcatcttgcggagcattccgtgaaacatcccgtgaaacattgtgagacgcatcgtcagtcggtgaccaagcatcgccagcccccgcttccgggagcgcccacggatccactgccgactgcgcgtccgcacgcgaggtatcctgtgcgaccgcccggttattgtcgcggtcatgagccactgtcgcgtccggcgcgtcgggtacggctcgatggacttcgtccgtatcggccgatgcggtgtcgccgctttcgggaggagtctgcggctccttggcattgttgccgacgctcatcgcccccaatgatgcgctgagactcgctttgacgatctgggcactgatgcgctgctgctcgtctgccggcagctggccgaacggcggcgcgacctgcccgtcggccatcttcttggtgggcgcgagctgcacttggtcgccgaacgccttgcgggtctcagcgcgcatgatctgcaccacgttgcgggttccgccgacttcctcaccagcgacggccttcgcgaaggcatacttgctcagcgccttgtcgaacttgatccacaacgtgccttttccgcctggctcgtgctgttccaagtggatgcgcggcaccttgctgcggttcacgtacgcggcgacgtccgccggcaatccggcgaccagtgcatcccagcgttcgtccggcgtgcggtcgtcgtcctgcggagaggattgcgcggctgtcggctcaccggccggtggtactcgagcggcggacggtgcttgagcggtgggagacggggcaccggcttgcgcatccgctgttgcaggcgcttccgccatagtgggcgcttccgtctggagtgcgcgatcaggttgggtgccggcggttcggcttggtgacgtattcgtctggcttgtcgccgattggcgagcgtccgtctgctggttgcgagcggatccgatgaatcctcccctgcgcggagtcgtcccgcctgaccggctctcggcgatgccgcctgttcgcgcattcactcctgcagctccgcggccagtacctgcagagtccgccccgggcgcagtgcctcccgcggccggcgcgacatccagtccctctcgcccggcaagtaagcgcgcggcaagcaattcgagccgcatgcgcggagaaatcgccccggtcatagaccccagggtggtattgatggtttctgccatcgacgtcaacgcacccaagccaagcgacgacgcctgcctacgcaggtcatccatgtcctcggcctcggcagcatcggaaagcacgctttctgcctgagcgccgcccaatgtcagcaccagcagatcacgcacccgcgccagcagatcctcgacgaaccgacgcgggtcgaatcctcccaccacgactttctgcaccacgccatacagcgcttcgccgttacgcgcgatgacggcgtccacggcctcgccgatcagcgcctccggcgtgaagccgagcagcgccacggcggcgtcgtgggcgatcacgccgtcaaccgcgccgaccatcaactgatcgagcaccgacagggtgtcacgcaccgaaccgccgccggcgcgcatcgccagcttgagcacgccgggttccggcttgatgctttccttggcgcaaatctcctccagatacggtcccatgacctcctggggaaccagccggaacgggtaatgatgggtacgcgaacggatggtgccgatcaccttgtcgggttcggtggtcgcaaagatgaacatcacatggtccggcggttcctcgacaatcttcagcaacgcgttgaaaccctgctgggtgaccatgtgcgcctcgtcaagaatgaaaatcttatagcgatcccgagcgggggcgaatccggcgcgctctcgcagttcacgggcgtcgtcgacgccattgtgactggccgcgtcgatttccaccacgtcgatggaacctggaccgccagtggcgaggtccttgcaactggcgcattccccgcatggatgcgaggtcggccccttggcgcagttgatgcaccgcgcgaggatacgcgcggaactggtcttaccgcagccacgcggcccggaaaacaggtacgcatgcgtgagcttgccgctgtcgagggcccgcatcagcggaacagtgacctgatcctgaccgatgaccccctcaaacgtgtccggtcgataacgtcgatacagtgcaagtgccataagctccaacctatcgcaacccggctatttccgggtgtctttccctattgtccccattacttgcgcacgcatcgggggcttgcccagatggtgccgccgcggcgacgtttgcggactcgtcaacgtcaatcgttggcctgtcggccgaaagccgccggacaggcaggctccgctcaggcggactcgccggtcagatgaattcgccggtcaccgggtcacgcccgtcgcgctcgatcgccgccatgatatgctcctcgctccggctgtcatgccagtgggcgaccgcaggcgggaccaatacgcgcaacgccttggcctgcgcggtgacggtcactggaagatgcccgacgtactccccatcggccatcagcaccggaggctcgtctccctcgtgggcgcgggttatctccacctggcgcacacgcttccagctgaatatctggctggcgagcaacctcccgttataggcgttggacagcgctttggcacattggccgacattcggcttgcagttcagccacaccagatccagcattccgtcatcaagcaaggagtacggagacacctccagtccgcctccgatgtaccgtgcattggcgactgtgagcagaggggcgatgatgtcgtgttcctccaccgtgccgtccgacagcgtggccttgacgtgatagccgtactgtttcatgcgggcgatctccaccagcaccgccgcagcgtatcgcgctgaccctccgggaaggcgcgaatggttggcccgatcgttgatgcttgcgtcaagcccacaattaagcatccccgcatagtatcggtcgatcagcccgttcaccgggcggccttcctcatccaccacgggctcaccggactcgtcatgcaccatgcaggcgatctccgtcgagcgcacgcgtcccatatcgacatccagataggtgccgcatgcgatggcgccgacgatgccttccaccgcggttttgacccggttgacgggcagtttcagacctcgcgcgaaatcattgcccgaaccgaccgccacaatgccgagcgggatgccgctgccgcagacggcgttggcccccaaggcgatcatgccgtcgccgcctacgaccaccaagtagtcgtatagggtgcggttctcgcgagcggccgtcagcgaatcatcaaagctggtgccggtcagatccattacgtcgaatccatgccgctgtccggcttcggccagcatcgtgaatacctgttcgcccacgacggcaccccaccccttgtttgaaacgggattgccgatcaacgccaccattgtcttcgcttcgcccatacgtcaaacataatgcatcaacggcattccccgccagtacaggctccgcaatcggtctcggcatcggcatcaatgctgtccgcccacacccgccgcgagtggccccatcgactattcacagctgatgggcccggcgcgggaacgctggctgacacgtgacatgaatggcaggcgcagcggcacggacaccgtcacgacgatgtcatctccctcgacggcgcacgactccagttgcgcgtcattctctgccgcggcacgccaccctacggcacacggatcggatgcgccaccagaccagtacgccgacgccgccgacaatgccgtggcatcggcagcgctccgcgcacgcgaccggcagagcagcgcgcctccgaccgacgcgacggtcgctatcagtgcggccgcgagcgcgatcagcatcacgcaggccatcgttcccgacccttcatcggattgcatcagccgcgagcaataggctcgcacgggcgatggtctcctaggttgaattcgttgcaccatcgtgttttcctttcgtcgctattccaccgcatcagaggcaagctgcgcaggggaagcttgaccaccccagtagctgcgcgacagcctccgccagcgggagggcaagacggcacagtcgctccgcgacagccctccgggccctgcaattacagacatgctacgcatgccgcccattggattcactgacgttcacccctcgcctacaaacagctctgctgtttgctcacggctcggcccgccagcgagggcaagacggacttaggcatcaccgccatcctgtggccgagccggttactttgacgggtagaacgccgaatggatccggcagcacggggcattgcgccgtcacgcgtatcgaatggccatcatcagcgaccgacaccactgcgccttcgcccgcgatgccactcgccacggcgttgacggacatccccgctcccgataggccgccttccctcgtcaccagttcgcgaactacggccgacgcggcatcctggcatcgcatggacaccgtgaccgttctcgtcaggcagagcaacaccatcgccaccatggccacagcgggaagcaccaccgcgaactccgcagtggcggctccactgtcagcatgtgacatcgtcgccatcgtgaatgcccgtcatcccacactcaacgacttcttgacgatgttggtcagcaacgtcttgatggtgtccgatttgagcaacgcgaccagcacggccgcgaagcccgtggctgcgaccagcaccaccgcgtactccgcggtggtggccccttcctctggctccgcgctcaacgtgcgcagccgtgcatccaacaggcaaatgccccgccgcgccgacgcccccatgttgcccaccgtacgtgtcatcgccgcaataggcccggtacgtccgtcaatggcaatcatcgtctcctcgatattcatgacaatcctttctcgactggccttgcccaactacaaggcactttccactgtgcctcatcaggcccgcccaccatcgggttttcgggcaatgtggtcgaaggctgccgagttatccacaatgcggcgtgtcatccacacattatgtggatgacagacggccgtgcagcattcttcaccgaccatcgggcggcgtcgccaccaagttcatcccacgaacgccatcaccgaggggagtatgcctagaaacacgaacgccggcagcatgcacaatcccgtgggcagcagcagtttcaccgacagagacgccgactcctgctcgatcgcggttcgctcgccttccgtccactgctccgaagccgtcgtcagagggccgatcggcgaaacaccacgagtccacgatggctccaacacgccccgaaggattgccgaggtctccgcataatcaccgaaatcggcggcattccaagcatccttccatgacgatccgcggtgcagagcgtccgcaaccgcacacagcccgccgccaagagcccctccgacagcctcacccacaccctccagagaacgcgtgacggacatgcctgaccgcagcgacaccgacaacagtccaatcagcaacggcaacgacacagcagcacccccttctcccgcaacatcggacggcatgccagtcaagcggcccgaccgtgccgagtccggccatatcatcaatgccatcaacaccatgacggcgcacgccatcgcgttccacatcaccccaccccttaatgttcatgacggcaatcagacggtatcaacgttcgtgccggtgttccgcatcatcgatgacatccacagcagtcccagcgcgtagcctgcgccgcccaccgccaggcacgcattgccctgcgcggagccgaacagtacctgcaccgggcgagcgcccagcagctctcccaaacctatggtgaccaacggcaacgcgcccaacagcgccgccgtcgcgcgcggaaccgcgaaagcactgcgtcgggaatcatgcaacagcctggaaatccgatggttctcgccgaccacatccagacaatcggcaagggagcatcctgaccgctcgcacatcgcacaggccacggcgagttcgaaggcgacatgttcggcctgggcggcgctctcccccggcattcgctgtcgcatcagcagccgtttcaaccggcttgcggtcaacggcacccctgcgaatccgctcccgtcgacatcggcaagaacatctgagatcatgccgccggcccgaacagacgaactcatatgcgcgatcacgccggacagccccatcacacggccattacggacggcatcaccggcaccggtctttcgccctgctcgcggcaccctcgaagagaccggcaacagggcacggccgcgaggggcatacggccacagcatccatgccagcacgaccatcagcgcgacgcatcgcggcaacccacccacgctcatatgtctcacctcacatgcctcattcacatgatccatctcacatgccccatcgcccggtgaaatcatgccagcgcgggcatggcatcatggcgccctcaccgtcccacaacgccaccacgtcgccggacaacactccgtcgcgcatgccgaggcacccgatctgggcgattctccggcgaccatgatgccgctcaagatgcagcatcacgtcgaacgccccctccgccagcatcgtcaacgtatgcgcgtcaaggccggccagcatgcccagcgcgatcaatcgcgccggcacccggtcaatgccatctgcgtgcaatgtggtcataccgccaaggtggcccgaattgaacgcgcgcagcagatcggcgatttcctcgccacggcattcgcccagtaccacccgatccggtctcatgcgcagggtcgccttgaccagctccggcagtcctacggctccggcgccttccacattcgcccctctcaccaccatcgacacatggttgccgcgtccgagatcccccaattcccgaacctcctcaacggtgacgatacggtccaatgaatcgcattccgcaagcagcgctttcagcagcgtggttttgccgctgcccgtgccgccgctaatcagtactcgagcccggttcttcaccagattccgcagcaacgtcaaccagtccggcgggaacatcccagcatcacgcaatccggtcaatccgagcaaccgccgatccggaaaacgaatcgtcaccgccgcgccctgcgcgaccagtggcgcgatcaccgcgtgcacgcgaatcccgtcctcgctcgacgcgtccgcaatcgggcaggcgtcgtcaagacgccgtcccaattgcgcacacagccgcaccgcatattcacgcactattcgcggcgtgcgcaacggcataggcaaccggcactccgtcattcctccgcctcggtccgcccacacccttccctcgcaggtgatcgcgacatcggtgaccgttggatcgcgtgccagcgcatccaacggcccaaattcaatcatgggacatcacctcccaaccccgtctcgatggcaccgacgactgcatccaccgccttgcggctgctcttgccgatagcccggatgcccagcccctccagcacatcgccatgcagcccgcggtccggagccaccaccccggccagctcctcatgcagatactccgatgcctcgtgcgcgtcgaccacgccgccgcggcgcgacagtccgcggggcacgacaccgaccataatcgggcgcgactccccttgacgtatcatcatcgccctcgccgcccgagcacgcgccagaccgagcaccgtcagctcggccaataccacctggcggcactgtcgcagcatcggcagcgaatgcaacgcgctcggagccccgatatcgacgaccaccacatcattggcctgcgccagcgcctcaagtacggcagagaccgtccatggctcgggatccgaaccgttccaaggttgactggcgagcacccccacgcgctcccattgcggcaactcgccattcagcgccgcaccttccgttttcccgagtggtatatcgactgtttgaaatcgcaggcccggctcgttttcgatgcccagcagcacgtcgatgcctccggccgcgaaatcgcagtcgaccagtgcgcactgcaacttgcgctgggccaagcgccatgcgaccatcgccgcgaacacgctggttcccgctcccccggacgcggaagagaacaccactgtattatggcatcctgcatgcgtcagcgtgccgatcgactgattgccgtccacggatgagaccgggctcgggcatacgactcgcggcatggtcatgggcttgcgcgcacgcatccgatggcttgcagcatccgagtcaagccgggaaacctgcgcagccggccttcgccaagcgtccggggaggcccggcgaggcggcatgggaacctgccgcgacgccgctgcacccggcggagcggcggcgccaatcttctgaactgtaacgttgtgtgtcatattccgattgaaacgaatagcgccgcagcggcgcaacgtgagacgacaatgtggtcgaaggcccgcgacttatccacatcacggcgtgttatccacagtttttgtggacagacgacgcctagatgggcatattcgcgtgatatggaaccgtctccacttagcatccagtcgaaagcacccggcagcggagtcgggaggaatccgagccaacctctctgcaaccttcgcccgtgcgcatctcgccgaacgtcgcataccccgcgctcacgaacgcccatcgcgcctccgatcatctctgccggtcagtcggtcacggcaaacattgaccagaacccacccgcccgtcataaccaccggcgtgccacaccagaggaaaaacacacaaaaaatgcattgtgtggcttttccgcaggcctcacaatgaaatgtgaaccctcacatcgcatggtgtggtacagcacaaaccatgagaaccgccattttccaacaatcccagaagcaccccaatatcctccccggccacaccagccccaaaaccgcataaaatcacgtggtgtggtacagcccgccgccaactgccgtccgccaccaccatcgccaccgcaacacgggccgaaatcgccgcaatccgcgattcggcgaaaaaatcgtttcgaaggccaaagcccggtgattgcgagttcggcgccagaaaaggccgggccgaacgatcacactgccccatcaacacaccggcaatacacccgggtaagacacactttcgaccacttaacccaatgattgcacacaggaagtcacgcggaacagcaggagccaacagtccgaaccccaacccgagccaagcccaccctcgccattagaccgccgcacatggaaaaacccgccggagcgggttttcctgcaagtccatcttgagcagatcgctgcacaacctcatcgtcgtaacggtaagtctttccattgcccgttcaacgtaacagtccttcgtgaccatacactattgtgggcctgctcttaagttgtccttgcacttcataatctaggcgcaacaccgcgataccgcaactcacccaactacgttgtgcgattttttgcgcaagtgttcgataccgctcaattatgacggaaaactgtcacctcatgttcctatcggacgggttcgttgttcacttgtgtgcggaaccgacgacccatcggcgtgtcgccgtaccatcacccgacaccccatccgtacgacaatggtaaacaaccgctgaatttcttacacgcagcatagaaaactgccatattctcgcataaagttatatacatggcacaaacatttgacgcaccttcaaaggctatcctgcgcagccaaatcgccgagcacatagccgagacagacaaacccgacaagcgcgagccgcaagccggcgaagagccgctgcccgcggatcgctatttcgaccgagaactcagctggctgaagttcaaccagcgagtcctcgaactcgccgaggacgaagaccagccgctgctggaacgctgcaatttcgccgcgatcttcgcctccaacctcgatgaattcttcatggtccgcgtcgccggcctcaagcgccgtatcgacaccggcatcgccgtcaccgcggccagcggcctgagcccccgccagcagctgcgtgccatcagcgagcaggcgcaccgcttgcagaacgagcacgcgcactacgtcaccgagaagctgctccccgccctcgctgacgagcacatcgtgctgctcagctgggaccggctcactaccaccgagcaggaacgtctctcgcgctactaccgccagcaggtcttccccgtactcacgccgctcgccgtcgaccccgcgcacccgttcccctacatttccggcaactcgctgaacctcgcggtgctggtggagaacccgaactccggcaaatcccacttcgcccgcgtgaagatccccggcaacatgccccgcctcgtccccgtcgacgacctgaccgacgaggagagccgcgaggagcgcttcgggttcatcacgatggagaacctcatcatcgcgcacctcgaatccctgttccccggcatgatcatcaaggaggcgcgctcgttccgcgtcacccgcaacgaggacatcgacgtcgaagaggatgacgccgagaacctgctcaacgcgatggagaaggagctgctgcgccgccgcttcggaccgccgatccgcctggagatctccgacgcgaccagcccgttcctctcccagctgctcgccgaccagctcggcgtcaacccggaagaggtctaccgcctgcccgcgccgctcgacttcaccgtactgttcgaactgcagtcgctcgaccgcccggacctcaagaaccgcccgttcatcccgaccacgaaccgtcagatcgccgaagtcgaatcgagccgcgcacaggacatcttcgccgcgatccgcgagcgcgacatcctgctgcaccacccctacgattcgttctccacgtcggtgcaggcgttcctcgcccaagcggccgccgacccgcgcgtgctggccatcaagcagacgctgtaccgcaccagctccaactcgccgatcatcgacgcgctgatcgacgcggcccacgccggcaagcaggtgctggcgctggtcgagatcaaggcgcgcttcgacgaggacgccaacatcgcctgggcccgcaagctcgaacgcgccggcgtgcacgtcgtctacggcatcgtcggcctcaagacccactgcaagctcatcgaagtcgtccgccaggagcaggacggcctcaagcgctactgccacgtgggcaccggcaactacaacccgaagaccgcccgcctgtacacggacctcggcctgctcacctgcgacccggtggtcggtcaggacctgacccgcctgttcaaccagctgagcggctacgcgccgaagtccagcttccaccgcctgctggtcgccccgcgcaccgtgcgtaccggcctgattcagcgcatccgccgcgaggaggacgccgccaaggccggcaaggaagcctggatcaaaatcaaggtcaactcgctcgtcgacgagaagaccatcgacgcgctgtaccgcgccagccaggccggcgtcaagatcgacatcgtcgagcgcggcatctgcgcactcaagcccggcgtgcccggcatgtccgacaacatccgcgtgcgttcgatcctcggccggttcctggagcacagccgcatctacgccttctgcaactccgacggcccgcagatcggcgaaggccccatctccggcccggaagtgtggatcggctcggccgacctgatgcaccgcaacctcgaccgccgcgtcgaggcgctggtccgcgtcaccgcgcccgagcagatcgacgagctgattcgctatgtggacctgcagatgtccgactccacggcctcctggcacatgcagcccgacggcacgtacatccatcattcgcgcgacgacgaaggccgcccgctggtggacagccaggaatatctcatccgcaagcaccagcgccgcccgcgcaccaacaactgacatggcacccggccggacgcccgatagggcatccggcacgagcctcgtgcaccgcatcttccgcaagacaagcggcgcacgaggtacagtaggtgcataagccgatggccgacccgcaagggccggccatcgtcattacagacgagaaacaacgtagtcatgcagccggtgaggcataatggaagggtgagtggtgaggtgaaaatcgtagaagctgcaggcgcggtgctgtatcgccgcaatactgattttcaaggatggatgaagttctcggacgacgggcggcagacgtccgcggcatcccgactggccgacttcgatacgcttgaagtgtgcatcgtgcaccggccaaaatacgacgattggagctggccgaaaggcaagctggagctcaacgagacccaccgccatgcggcggtacgcgaggtcagcgaagagaccggagtgccggtcgcgctcggaccgttcctcggcgaaatcgaatacccgcttgccgaggaaggcaagaaaacccgccgttccaaggatcgaaccgtcgacacgaagcacattctcttctggatggcaaggccgatcgaccccgaggacgccgtgcggcgggccgacgcgttcggccccgtgcatcgcgctgacgtgggcgagatcgacagcgtcatgtgggtgagcgtgcagcgcgcgcggcgtatgctcacccattcgaccgaccgcgatattctcgcgttgttcgtcgaccgtgtggaggaaggcgcgctggacggcgacatgctgctgctggtgcgtcacggcaaggccgagccccgcaagcagtggacgggtaccgacgacaagcgtcccatcacgccgcgcggagcgtcgatggcgtattcgctcgaccgtgagctcgcctgctacaatcccacgcggctggtcacctcgccgtggctgcgctgccagcagaccatacagatgctgtcatggcagaccggattgccgctgcatacggccgaaccgctcaccgaggacgcgttcgccgccgatccggaagcggcgtggcagtgcttccacaaggagctgaaaaatacgttgcagcgtcacagtgcgaccgcggtctgcatgcatcgtccggtcatcggcggtattttcgggcatctgcgcgaactgtgcgcgacgaaatcgctgatgaaacggctgattccgtcctcgccgtacatgccgaccggcaccgccatcgcgctgttcgtggtaccctgcggtgacaccgtttccatcatcgacattcagaaggtcacgccacttgtctactagcatgcattttggttcaggctccgtcgttcccagccgcacgggattcacgccgaccggctcgccgcggccatcgcgccccgggcagatcgaccccggtctcatcgagggcatcgccggaggcgccgatcccagcgtggtcagcgaaatgagtcacgcatcggcggccgctctgctcgaccgcgtgcatcactccgctgatccgcaggttgtggaacgggtgctgacgctggtcgaccgcgaaggcgtggacatgatcgccgaactgtggagccggtcggaacccgactcgctgccgggcatcatgtggcggctgtacacgttgcgctcatggatgcggcgcgaccgcgatctgatctcgcggctgtggcggctcggcgaaccggtggcgaccgccgcgtcggccatcgcaggcgtcgaccaggcacccaccgaagcggacatcgcacatacggcagattcgattctcgcaggcgcgttcaccggcgatttcgccgtggctctggagagggcgagcgcgttcgtcgacgtggtggcgcagggattgcgcgtcgaagcgcggcacatggtgcggcaggccgaggccaaggccggctccgaaaccgcgaccgccgcagacctggccgaagcccatgtcatgcgctcccgcagcgccaagctgatgcacaccgccggcaatctcatcgccacgtccaaggatttccgccacggagcgcagctgtggcgtcgcggcaaactggactgagccggcgcaacacgcggacagcgtaacagggcaaacccggatatactgatatccgcgtcgggccatgcatagccccgggctccattttttgccgctgcgagcggcctttgcgccgacaggcgctttcgtggttcggcgcattctctttttctttctcaccccgttgaatccgcaacacgctgctgctgatgggacgagacgtacagcagacagcggaaaccgtgggcgatgtactgcggcacatcattcagccccgtcgcgctcatggagtcctcgacaccccattcaccctacgcatcgtcggtggccagcagaccgatcggcgacagctcgactatacggaactgggcatgtggcggaatttcacccactgcggcgtgctgtacgcgcatgtgccggaggtcgatccgctcgcgtcgccgcctgcgccacgggatgccgcaggcgccacggcggagccagcaacggcggctgatcccgacatgtcggccgaagcggtgcgcgcccgcatcgaggccgcccgcatcaaggcggaaaacgaactcatcgaccacatccgatcccacgcggacgccataggtttccccggcgagctgggagtcagccgcgccgtcaacggcatctgtctgcgagtgctcaccacacgcggtaatgacgccttcgacctgatcaaagacgtgtcggatttcgtcgttgcgtaaaatcgcgctctcaaaactcgcagatacagcatgaatatacgcaaaaagtgcttgtatctgcgagttttgagagcgtccctgacgctattgccgcaccaacggcggcatcggccgccacttcgggtcgtgcatcaacttgtgcgagtcccgccatcccttggcgatctgcaccagcccggtgcgcacgtgctcgcggtcgaccgcgaccaggcgaataacctctttcgccaccgtggcggccgttcccaaggcgaacagcactggccggtagtcgccgtgcaccatgaagtaccgggccatgtacccgcggttgcgcaggatgtggtaccggttcatgtccgaggtggagttcagctgccgcaatccggcgatgtcccagttgctgatgtcgcgcgtgcgccgcatcaccacgtcgggcaccacaatcgagttggtgaccttgctggccagatacccgtacatcgtgtcgtcccagtagatgaagaaccgcgggtcggggagcccgatcttctccacgatgcgcctgcggaacagcccgccctcgaagcacagcgtgttcatcacgcggtacccggcggagccgaatgcggccggcgcgatcgggctcgggatgcccagcggcacgatgaagttgtactgccagtagaacggcccgccgtcgaaatcgagcttgccgccctggatcacgtcatggtcgcgaccccatttcgcgagcttctcgatgccgtcaggcagtacggcgacgtcgtcgtccatcacccagaaccattccgccccgagatcgtacgcgacttttactccgacggaaaacccaccggcaccgccaagattgtcggtttgcggagcgtacaccacacggctcgtgccatctttgcggtcggcgtccgtcgtcccccacagaccgtcggccttctcccggaattcgtcgaccatgtcctgcgtctcgtcggagtgttcgttgtcgacgatgacgatgcgccatggcgcgaccgtcagctgcgcgaatgaggccaggagttcctccagcaactgctggcgcttatatgtcaccacgatgatggcgagcttgtcgaacaccgcacgggcatcacaggtgtgctcgaccgtggcttccccagttttgtcgttcctgtaagtcatacctttcattgtgacaccgtttatgtgaaggaaagtgatagtcacaggattgccaccagacaacgccataatgtcatgccgacgtttccggccgtgcagctaccgttcagagagtatggaggtgggtcatgagggcggcaccgcccggcgcgtggtcagtcgccggagctgctgtcaccggcgctgccatcgccgctgctcgacccgctgccgtcggacgagtccggggccggctcgccgggcgcctgcccgcgcgtgaccgtcaccgtgttctcggagccatccctccacataatccagtccacggccgtatggtcgtagtcgtccgcgtcatcgtccgacggggtcaacgtgtagctgccgaccgtctcgcccttctcgtcgacgatgatgttctcgtccgtggttttgacgtagaactgcttcagcagatagttggctccttcgaactcaccggagttcagcatcaggcgggcccaccgcccgccgtccagcacctcggtgaccttcaggtcgcgcgagaggataaacacacgcttgctgtcgctcgactcatcccactggaaatacagggaaccgtccgagaactggccgaagtccgtgaagttcacgtactggtcatccttcgtgttgatgttcagcaggtcggtgacttttttggtcttgcccgtgcctgcatccagaatcagcagcttgttgccgttatagctttcagagggattgagcacgtactgattcgcgccgaaccgatacaggccctgcaagtcgcatcggtaggtgtcgccaggcgagcagtagtccgaaggaagcttcacgatttccttgttgctgtcgatggaatacaggtggtatgcgctgtccttgaccacatatgtgtcgaacacgtggtaatcgtccacatcgacttcagtagtgttcaacgactggtatccgccgctgtccttgctgatgctcacgctgtccttgaacgtctgcaaggtctcggcctgcttcgcgccgccgctcaatcccatgatctgcttgtggccgatttcgacctcacgctgatcgtcgttgacagtcctcttctccgtcgtcttccagcttttctcgatggcgacgcgattgttggattgcgcgagcacatcgaattcgtaatcctgctgcaggttgatcagattgtcttcctcggtgcgcagatcgatacgatcggacaattcgccggatttcaaatcgacctgatgggcgaacaggtgcacggtttccggcgtggtgccgaccgccttggtcttgaccgcgtagatcacgaacacggccgggttgggaccgtatgtggcggcgacgaccggatcggagtacatcttctccccggatttcagagccgagaagtagatcaccttcgattcgtccattgccggcgtccagacgccgaacgcatattgcccgtcatcggcggattggctggaactgccatagtcggaatcgctgctggagctcgcatcgccgttggcgcagggcattacgtcggaaagcactgcgccgccgtcccacccccagtcggaggtgtcgtagttgcagacgaagttggtcatggtgacttcgctgaccgctttttgccttcgatctgcgtcggggattgcttttgcgttttcttcggcgttgcatcagtcgtgtcgctggtctgcacggggcccgcggccgcgttcttcctgccgtgaaggatgaggaatgcggcaactccgccgacgacgatcgccacgacgacgatggccgcgatgatggcgatgatgatcttgcgcttcttgcgttgcgcgggcgtaagtggtggcttcttgccgggttgggattgcgacccgggctgaccttggggtgcgctgccgccgttatccgcggggcccgctggctgcgggacaggcggcaacgtccccgtaccgggtactgtgttcggagcgaagccggacgcggctgtaccaggttgaggcatctgcgccccgctaccgggcgctgcggcggcaccgcttgcgaccggaatgccgcagtatgtgcagaacgccgatcccgctggaatttcattaccacatcgagcgcatctggccatcatcatcccctgtctcttcgttacgacaatcataaccaattcgagggattttgaaaggccgcgaagccctgcggccgggcgcgatgtcacgcggtctgggctatgatgaaggcgcaaccgaacgggagccgcaaggctgagaggaagcgacgcttcgaccgtcaacttgatgcgggtaatgccgccgtagggacgagttgtccagtcgcagcgcagcaacaatcggcatccgccaaccgatggcggacggttcccagccaaacgcaccgggcatcccggcatataacagaacaggcataacgaaaaaacgcatgattcgggtcatggaggggcgcaccacctcacagggtacggcttgctccagcgacccgtttttcatatcggcggacgccggcgcacccgatcggagatcgaccggcaacggccggcagcgcaatgtcgccgatatgggaatcacgccagcgaccgaggagggacacatgatcatcaacgggcagcaggaggacatcgccacgccgctcagcgtcgacgagctcatcgcgcgcaagggccttaacgcgggacgcgtggcggtcgaggtgaacggtgccatcgtgccgcgcgacaagcgcgcacagaccatgctgagcggcaccgacaccgtcgaaatcgtcacgttcgtgcagggcggctgagagcccggcaaacacgcggcaaggcatcggcacgggctcatgccgatgccggccagcgaaccgcactccgacccgaataccgcacgcatcaagcgtcatatacctcaaagaaaggtaccatcatgaccatcgcatcaaccacaccggccgcccaatcggacgacccggcgctcgacgaactcatcggcacggcgacgaacaccgcgctgctccccgaaccggacgcgcacgcctacgacgacatcgcgaccggcgacgccgacccgctggtgctcggcgggcacaagttcaccagccgcttcatcctcggctcggggcgctacgacctgaacctcatcaaggcgaccatagagaacgccggcacgcagatcgtgacgatggcgttgcgtcgctgccgcacgaccgagaacaacctgctcgactacatccccaagggcatcacgatgctgccgaacacgtccggcgcacgcaacgcggaggaggccgtgcgtatcgcgcgtctcgcccgcgaggtctgccagacggacttcgtcaaggtcgagatcgagcacgagacgaagtacctgctgcccgacaacgaggaaacgattcgcgccaccgagatgctcgccaaggagggcttcatggtgatgccgtacatgttccccgatccgatcgcggccaagcggcttgaggaggccggcgccgcctgcgtgatgccgctcggctcgcttatcggctccaacaagggactgcgcatgcgcgacttcatcgaggtcatcatcgcgaacacgcacgtgccggtgatcatcgacgcgggcatcgggcgtcccagccaggccgccgaggccatggagatgggcgcggacgcggtgatggcgtacacggccatcgcgagcgccggcaacatcccgctgatggcccgcgcgttcaagcacgccatcgaatccggccgcgaggcatacctgtccggcctgggcacggtgacggagggtcacgccgtgccgtccagcccgacgaacgccgccgactacctgcactgagccacccgtactgagtcgcctactcacgtcgccgcccggcagcgtgcacccatacgtggggcacgatgccgggtgtaccttaatctcgcgatgacgcccagcccgcggcccgagcccccgcgatcacaggtcaacggccatcgccagctccaggtcgtcgtccagttcctcgacatcgaagtcgagcttcctgagcacgtcgtcattgggaacatcgccaaggggcgcatcatcaccgtcgccggggcccatgtcaccgggatcgtcatcagggcgcatcagcatcgattccacgacctcatcatattggtccggattgccgcggaacaacgccaaagcgcacccccgcgccaggcgctcgtccgggaaccgtgccaatacgatgttcgccaaggactcgcccaaatgtgccttcgcgttcatttcctcctcgctcagcttgtcgagacgtttctgcatgcggcgtgtgagacgctgtatgtccgcctcggacgtactgtaaagcgtgccgtccgtcgcgtagtcgtcatcaagcccccgtgagaattcatcgaatccgttcatgaacgcgattatcggcaatgacagcagaccgaaccggacgagcgtctccgtaagcagttccagctgctcgacgcctcggtcgaaccgcttgcggtctcgccgctcgaatccgaggataaggtcatgggccatcacgtcgcccatcagcgagtatgccagatcgttcaggaacgccacatcctgccatagtggttctcccggcacatcccgattgtgttccagcgcgagcatgcggtcatcgacatctattggttcatcgtcccacatcttctcgtatgcatcaatcagccggacgacatcgtacatgtatcgccactcgcatttcagcagatccagcctatcctccatgtcgatgcgggcgcagctctcgcagtcgcacagcgactcgtcgcccacctcggcatatccgcgaacgccatctcgcttcgacgagcatccgcccgcgtcgcgatctgccgtcgcaatctctccgacagccggttcctcatcgtcatgacgacccatatactcactcatccactgattgccatgcagctcgtattccgcatcggcctgcgcccgccgctcgtgcagatagtcgaccacgcgccgataccgcatgtccggcgccgcaccgaagcgcaacacgtctccgtcctcgcgcagcatgcacatgccgatgccggggtacagcagcagcatccgagcgatgtcgaggctgcgccgctcatcggcaccccaattgagcagggtgtatgccgccagccggtgcatctgcgtcgaatgctcctccatggcgagcccgcgctgcttgcggttgccgaaccgcttcctgccgcgaggccgtcgcatcagttcctcgacggtcgtcatacgaatcagcgacggcatgtaatcggacgggtcgtcgcgaaacagagccagcgtggaatcgttcagcagctcgtacagccacaccgagatgccgtacttgcgcaccgtttcggagcagccgtgaagaaacctccggcactcgcccaccagccgcccgttgaatgacatcgccgccgcgcacaggttcgtcgtccaactgccgcacgcgaacacgtcgcgcgccagcgcgtacaaccggtgatcccatggcgtgggcgtgccgtccctgtcatagtcttcgcacaccttgcgcatagtctccggagagacgagttcctcgaatcgccgctccaacttgttgatagcctgcagaaatccgatggtatccatcgagaatgatgtcgccatgatcgctccttttcgtatgcgccactgccgtcacggtccctccgcgtcctcgcgcataggcacaccatggcacacccaaggctcccggcgccacccaccctcgaaaatctgtggataagtggataactcaccccttatccacagttgtccacattgccggcggaaccggccagcccggccatcagaccggtgaaaccatacgaaaacgccagaatggaacaccactcgcataaacaacatccactatcatggctagcggaagtcgattacatgccgcaggccgtcacaccagatcaggcatcaaagggaagagacaacgaacgaaaacaaacgcaccgtgacgattctcataccctgttacaacgaggaggagtcgctgccgatgctgttcgcccggctcaccacgttctctgagaacgcctagctggcaccggacgatgacgatcgcatcgactatcgcttcctgttcgtggacgacgggtcgaaggattcgacccgcgacgaaatccgcgagttcgccagcaaccgtcatcctacgtaaggtgtccgcgcggacacgcacagctgtgcccgcgcggccgtccgtggctacatgaatttcttcagatccaccggacagctcaggccatccttgatgctgctgagcttgtccagcacacctccattggaggagtcggtggagttcttgttctcgtcggcaggcttcgatgaggtcttgccggaggatttgccaccgtcggaaccgtcgctgccagttcccgcccactggtcctccaccgcatccggcacatcagcgccgcacgtgtcggtgaccttgccgttggtgcccgtgtagatgcccttctcgttgataatcggcgtggtgacgacgtccagcgtcgacttcgcctgctccgccgcccgcacggtgaacgcgatggtcaccgtctcacccggcttgatgccctgggtcagacgcaggttgatgaactggcggtcctccacggtgccattcgacaccatttcgccggattcgtaggcgagcgacgtgatcgcgccgccttcgggcgccatcaggaacagtcgcggctgcatcgtgcccttctccgtattgccggtaatgaacgccggcaatgacttcgcctgctcctcggtcatcgtgttcttcaaccgtaccgtcaccgtgtattcgtcgccgaggccggcgttcgcgatggtcatggggttggtagctcgggcgggcgcgtccacttcgtcgctgatgcggtacgagttcgcggcgaaatcgctgccgcacgtcttcttgacggtgatgctcggctcaagataccagctgagcttgctgggcttcgcctcggtcacgtagacgccggccttcggctgttccacactgccgggaatcatgcccgcgacgttcgcgtcgaagaccttggtctggacgagcgccgccagctcctcctcctgcgccatccacagcttgaaatggccgttcgcggacgtctgccgcagcgccttgagcatcggcgacagcgtcgacgcgcccgcgcccgagaacacgtgggtcatgatcgtcttcgacgccttgttggtgtaggcgttctgctccttgtagatcgggtggtccacgtacagctcgttgaggaagaacttgaccgtgttcgtgccgtccagtaccttgccgtcgctgagcttgaccgatcccgtcacaccgatcagcgactgcaagaacacggggtcaagcgcgaacacaccggcgatctcctggttctcattgcccggctgcgcgagccacatgttcttcaatgtgaccgcagcccgctggaagttcgggttgacggtggtcgtctgtgggtatttccacacctggtcgccgaacaccgcagcttccttgacgttctcggcatcgtacggctgcgtgccgtaggtgatgtcggtggtggcgatgaagtcgccgatcgtgaccttgccgtggtcggcggtcaccggcgcgatgttgccgaccatgccgccgccggaccgtagctcggccggattgtagatcgcgaccagatacgtgcgctcaccgttctcgcccagcagctgtggcagcaggttgatcagctcgtcgtattcgttgagcatcttgtccacggatttcaggccggagacgccggtcttcaccatggagacgatgctcaagctcttcggaggcgccagcttctccagccgctgcgtctcgactttgatgtcggctcgggcctgcttgacgatgcccggcatggccgtcaccgcgctcaggtcgacggatttgtctttcatggagaagccggacagctgcttgctcaggtccatcaaatcggtgaacggcccgtccaccaggtttcccatggcgtccagcatcgtgcgcgcggcggtgatgtcgttcccgtacgccgtatggtcgcgcaggaacgtccactgcggcttgtccagttcgtcgcgcagcgcccgcgtggacgtcaccatctcacgtgcggacgtgccgatgttacctccgccaccgcagccgagcgcggtgttggcgaggttttcggaagcggagatgaagcggttcgcctccgtgtacagtttgagcgcggagattccgtagataccgacgaccgacaacacggctcccagtagcacgaacaccacatacagcacgatgcgccgcggacgcagcgcttgagacaggaattgatgtccttttcgtccgatgtgctggggggatcggcgcatgggttaacctcgtttgcttcgtgttacattccgttttgtcgcgtccgtcgttccacgcgacgaccgttatcgttccgtcgggttcgatggtctgccgtcacaccgtcttttcgggcggaccggctctcgacgctacgtaatacaacctcagatgataccgtgcgatgcttaccgcacgctaagtcttctttctgaaccgttgtatttcgacgtttttttcaccattgcccgggacaggcggaaggatggcccggcacaacacccgcgaccttgtcagactgctttcagacttcattgaggggtataacagtatggagcaagataacatacacatagcgcgaccatagtgttgcctacgggatgccgtgctttacggggcctttcggggttcttcgggtggcgtcccggccactgtcacgaaaacgcgggcgcacggttgccatgatcgcagcccccgctgggaagaactggagaagtacacgcatgttcgttctcaagaacgcatggtcatccatagtccgccgcaaatggcgcacgctgttgaccatgttcatcgccatcatcgtcacattcgggacattgttcggtttctccgtcctgcacgccgatgaatcggccaccgatggctacaacccccagctggtcagcgccgtcatccgcccggatgcgaagaccaaggcaacctacaacggcgccgattcttcctatacgaagaactacctggcgttcgacgcatacgacaactacgcgtctgcgctgcagaccgccggcctgacgtacagctatgcgctcaccatcaccgtgccggtgcggcagagcggcaacgtcaaggccatcgccggcaccgacgaccagagcgccgacaagaccggcggcgagatgctgtaccgcagcttctcttcgctggaggccgcgcatgagaacgagctcggccggtacaagatcgtcaagggcaagcaactggactactcgagccagtcgaagacaggcgtgctgatttcacaggcgttcgcgaagaagaacggcctggacgtgggcgacaagttcaccgtcgcgttcccgaacgacgcgaagaagaccatcgagcagaccgtccgcggcatttacgagtacacggagccggccgccgcggggcagagttcggacgccaagctcgccaaggacaaccgtgacaacgtcatctacaccgcgtactacaccttcgcgatggacggcctgtatgcggccgacggcaaaggctggctgattcccgacctgaacatctcgttcctgctcgacagcatgtcgacctatcggaagttcgagaaagtcatcaagaaggcaaagctgcccgcgaaccatgagctcacctcgccgacgctaatcgagcacgagaagcagatcgcgccgctgcgctccctggcgagctcgatgaagcctatgctcgccgccctctggattgtgggcgcggtgctgttgctgctttcgtggggatcgagcctgctggtcggccgtcggcgtgaaatcggcaaccagatcgtcatcggcgtctcgcgtgggcgtatcgcctggcagttcatgctggagacgctgttgctgaaccttgtcggattcgccgtaggcatggtcgtcggcgcgttcgcggtcaagccgctggccacgaagctcgccgacggcaatgcggtcagtgtgccgggcaacctgatctggactgtcatctggagcggtctcggcacgattgtggttctgatggtgatcgccatgatccgcgtgctgctgttccgtgtcaggacgctgtttgcggcccgttcctcgaatgaggtcgaggtcgtggatgacggcgggacggacgacaccgcaacaagcgacaacgcagcgaacgacagtgatacggcagacgccgacgatacggcggaatcggcacaggagcaggcatgaacgacacgaacacgaataaggcggacgacatgaacgaggacgacgtcacactgaccggtcccgaaggcgagaacacggcggtcgaatcagacgcggcagccgacgccacggccgacacggcaaccgaatccccggatgccgccggagcgagcgattcgacgacggtaccggacagcgtgcagttctccatcgtcttcgacgacgacggtgacgactccgacgccatcgtgatcgacgctgccgacgcggaaatcgacactaccgcggaagccgatacgacggtcgcgacggatggctccgccgaggaggcaccggccgacgacgagaatcccggagatgatacgcaggatgccgccgcgcaggagccggccagcgccgacaacaccgccgataacaccagtgccgataccggcgatgctgataccggcaccacggcggcggacaccgccgacgagaacttggatgtggcagcggccaacgccagcaaggtcaacgaaacactcaagctgagcaccgggggcaagacggccggtgatggccagaagaagaccagggccggcagggtcaccgtggcatcggccagcgtcgaccctgcaatgcgcctgtcatcgcgcatcgacaaggagctcaagcgcagcaaggcggacagcatccgtctcaagtcctacccgacgttctcgatgaacaaggtcacagtgaccgacaagaagtccggccgtcacgtgctcgaccgcatgacccaggcgttctatgccgggcatgtgtactcggtgctgctgcccgacaacgaccgcgtgctgcacgagaccctgatgggcgtgatgagcggcatcatccggccgcatgacggcaatgtgatgaacaaaagcgcgaacctgctggagcttgagcccggcgaagtccgtggacatcgactgggactggtgccgcagcagtatgcggtacgagacgacatgagcgccgaacgcaacctggtgtatgcgatggatgcctccgggcgcacgttcctcaagccgaagccggtgatcgcacgcgagctgctgcacaaggtccatttcgatgtggataccccgaacgctccggttggcaagctggacgtggtggagcagcgtcgcgtggcgatcgcgcgcgccatcgcctgcgaggccgaggtgctgatcgccgacgagcccacgggcgggctgaacgatgacgacagcgtggagatcctgcagctgctcacgtcgctcacccacggcgaccccaaacgctgcgtgatcatcctcaccgaatcagaagccgttgccaacatagccgaaaccatcatcaagctataaacggcctcatctgatacgccctcgctgggtgggcagtccaccgggctatccacccagcgggggcgcattgattccacctagatcatgcgcatgcggaacctcgcggccagggccggcacgtcggggacaccgtactggtcgaccagatccagccagcgccgcttgttcgcctccccatagcgctccgcacgcttggcgtaggcttgcgcggtcaggaacttcggcggtatcgacttgctgttgtatttgtcggcgaccatcacgatttcctgttccagattgaccggcatgtaatcgaccggaggcagcggcaggttctgcgcgatgaccatctgctgggtcaggccgaccccagtatgattgcgcgcgaactgggcgatggactcgtccacgccctgctccagcaagtactcgtagccgagcaggccatgcaggatgtaacgtttcccgtcgaattgcagcggttcgccatcactgccgtcgtgcttgagcacgcgatacgtgccgatgtcgtgcagcaggccgccgatcgtcgccagatgctcgtcgatcaggcgtttcggcacacggccaccggtgatgccgtccgacggcaggtcggcttgttcagctgccccggcggaatcgtcaagcgcgttgccgctgccctggcccagcttgttggtgaacagcgcgttctgatggcgggcgagctggcgggcgatggtcgccacgacaacgcaatgcgtgtgcaccaggtcataggcggcctgggagggggcgattttcttgtgcagctcgtcaatctggtcgagtgtggggatataaccggtcatacggctcattgtagccatcgcgacacgccgataacatcacacaatcgcaaggtgcatttccacagatcagccattttccggccttcatcataaacagcgacgtcgattgtgctgcgcaatccgggcgtgtcgcgccggtgaggaggaaaagaggagagcgttgcgagcaagttacagatgccgggtgccatcaatcgcccgatagacgcctctcagatggagcgcacgtggtattcgccggtacggttggacgccacgatcatctgatcgttcttcagcaccttccagccatcggactcgttctgctcgaagccggaactcgccacgaccacaccggacggcttgccgtcacagtcctgcacgtcacggtacctcatcacacggtaatcgtgagctttctcgcccttgccgtactcgtcgtaaatctcgacgatgcgcggcgacgtcttctcgcggccggcggcgcacaaagccacgagctggtcctggctttggatcatgcagttgtagctggacttggggtacgcctgacgcagctggcgtaccgcctgcgccacggcctcgtccagcgcgaagccgaacgcgatgtattcgaggatgaccgagaagaagatcgcggagtcggaacggccgccggtcgacaggaacgcaccctgattgatcgggtacgcacgattgagcacgatgttgatgccgcggtcgtcggagatgtcgccgttgtggatgaagctcagcccgttcgcgaagaacggctgctggttctccagaatcagcggcaggttggagctggcgagacgcaggtgccacaggccaccgcgtgcggggtcgtccgcaaagtcacggaaaatcgggtcatggcgggcggccagtgtgctcttgtacagtttcgtgccggtctcgggcttgcgtacctcgccggcggcaaacggcagctcagtggggttcgacagcaacgcgacaccccaaccgtcattgtgaatctcgctgagatcacggaaatccgtcacctcgtgcatgcccaggacgtcgttgaggctcaggttgaatcccgatgtcgcgtatcccagtaatctgcacatgcttggtactgtatcgtgccgcggcggctgacaagcgggcgtggctataggagttccttatagcgtgcgcacggccgcgatgcgcatgcggtccggcacccggcagacacatgccgatacgaccaatacggccacacaaacggccgattgacaggcaagcgtcatcatcaggggaaactgccagaagaacaagcgtccacctgcccgctcgccaatcgcacaacagacgaacaggtatgaggcaggtgccgccgcgccaactctcagtccgcacaggcggccacatatcaccccgaagcagccaagtccgcccacagatagcgcctgcgcgaccccggccgccgtgccatataccggtatcatcaccgcacccagtgccatcattcccgcaatcaacaccagcaacgccgcacgatccatcagccacgtattcctgacggcagccacatcagccgcagacatgccaggcagcgaccacgcaatcatcgtcgcaggcacaagcgccgccaacgtcgcaagaggcagactcacgccggaaccgtccagcgcaggcaatccaaccgtcatggacgccaatggcagcgtaacaagctgcgcggccaaacacagcatcgtcagctgggccatcctcgccgtcttcatgcaagccggcagcattcatcatccataattcagcgacctgaaaatcacgtgcctgcgtgtccaatatctcgcatccgttctgtgtggtgtcatacgtcagcagaccggacagcaggtacgagacaatctcatcgccggacaactgttcactgtcttccgcgctgaacagccatgcagtatgatccgccggggattcggacaacttggcaggcgtcacatatccatttcgaccaagtttcccggacaagtcggcagccggctgaccggccaaacgcagaccgtgatgccatctcgccggtcacagacagtagaggtcgtccttgcgataaccggatatgcaccgaacggcagtaccagcgggacggctaccgcgacggtggcgcagagagcgactattgcgcagacggaacagccggcaacggtcctgtcatggctgcgccatccgacgaccatcgcccgtactgaggcggcggctggcgcaaatacgcggcacccaggccgtaacgcatgggcggtttgcctccgcagtccatcagtccatcaggagcgcacgcgagccggcagtgcggcccgtgtgcgtctactgcttagcgcgtttcgccgaatcgtcgaccttcacggcatcatttttcgtcgcgtcgaccttcgcgcctcccttggcatctgcggctgcaggcttcgcagcgccgtccttcgcagcggcggccttctgcgccgagcccgcaggcttcgtcttgcttccgtccctcgccgcggacgcagccttcgtgctgcccgagccaccgttcttcgcggtcggtttcgcagccggccgttcttccggtttgctgacggtcacgatctcgttgacgcgcggcgtgcgcgaacgcaacgcgacgcgcttcagacgcggcggtcggcgagtggagatgaacagcggctgaacctcgaccaacgggttgaacggcgccaggccgaaccatttgatcggggagccggcgacgtgacgaatcgcgtacttggcccgcaacgacatcgcgcctcgcgtggagatcttggattccggcatcaggtccttgtgaatcagcacgtaacggatggtgccgatctccgggtcggcgtccaccttcgggtagacggacttctgctgcggcaggtcaccggaatccgacaggtcgtgcatgatctggtgcaggtacaccggaatagactgcgacaccttgaatcccagacggatacgcactcggaacaggtagctcgtgccgaaattctgcacggagtactcgcgcgtgaacggttcgtcggtagtctgcaccgacaccgcccaccacgcacgggcgcgcttgggatgatccgcgaagatcgagaagaagatgtccgtatccagtcgtcgcatatccgaatcgctggtcagatacacgatgttgtcggcgaaatacgggatgcggaagtcgccgtgcaggcggtcaagcgccggcaggaagtccttcggcatcatgtggcggcgctgcgcgcgttccagacgcgtgccctcgttccacgtgtacatgatgaacaggatcgccaacgtcagcagcatcgtgaaccagccgccgtgcaggaacttcgccatcgacgcgatgaagaacatcagctggatggcgaggaacacgatggtgaacacgaccgccagcacccgcttgcggtcgtaccacatgtacaccgccagcaggatcgtagtggtgatcatcgtgatcgtcagcgcaaggccgtaagccgccgaaatatgctcggaatcccggaatatgcccagcacgatgagcgtggccacgcacagtacccagttgatgacgggaatgtacagctggccgcgggtgcgcgccggataccgcacctgaagatgaggcatccaattgaggccggtcgcctctgacaccatcgtgaacgcgccggtgatcagcgcctgcgaggcgatgatgccggccgtgaccgacaggatgacggccacatagcgcacgttcggatccatcatctggaagaacgggttcagtccctccatgtgctggtactcgggattgttctggttcttgaggatccacgcgccctgaccgaagtagttgaacaccagggcgaccttgatgaacggccacgtgaagtagatgttgccgcgtcccacgtgtcccatgtcggagtacagcgcctcggcgccggtggtcgacaggaacacggtgcccatgacggcgatgccggccgcattgtgcgggctgaacaggaatttcacgccgtacacggggttgagcgccgcgagcacggaccaatcgccggagaggttcaccgcgccgaccacggcgaggaacgtgaaccacaccagcaccacggagccgaacacgcggccgatgctttcggtgccgcgcgattgcacggagaacagcacgacgatgatgaccacggtgatcatcagcgtcaggttgccgttttccttgaacagcgcctccaatggcggcagcgtcttcagaccttcgaccgcggagctgatcgacacggccggggtgagcacggaatcggcgaggaacgccgcgccgccgagcatggcggggatggcgagccatgcgccatgcctgcgaatcagcgaatacagggcgaagatgccaccttcgcccttgttgtcgatacgcatggcgatgagcacgtatttgacggtggtgatcagcgttatcgaccagaacaccagcgacagcatgccgagcacggcctcacggtcggtgttggcgatgccgccctggccggaaaggaacgtctgcgcggtgtacaggggcgatgttccgatgtcgccgtagaccacgccgagcgcgacgatggccatgccgagcgagatcttgttggggccggactgcaatctgcgccaccagcggccgatcgcgcccttgcttgcggtcttggcgagtttttccgcttccttggtttctgccgcctgctgctttgcaagctcttcgcgctcctctttcgtcagtgtgcgacgagagactttcgggacgttggtgaacgtgtcggcacgtaacaacgtttcatcgggcttttgagccatgatgcttcctccatcgacggggataatccgcacatgatatccgcatattctaggtacagctactaacggaaaccttggtatttcaaattcaagcggtcagtatatgccccttttcggttttttccaacttggggaggacgccggccgcccttgccgcccctcgtcacaccccgtataccgtgcgtgtcgtgcgccgcgtcgcacgcgcgacttcggcgacgggcaggtcgaacacgtcggcgagcgccgtcagcgtgtacgggatcatgtacggcgcgttggtgcgcccgcggtatggcatcggcgtaagatacggcgcgtccgtctcgaccatgatgcggtccagtccgaccagccgggctgattcgcggataccgtcgttgcccttgtagctgaccgtgccggagaagctcagataccagccgttgtcgcgcgcgatctcgcccatttcggcgtcgccggagtagctgtggaacacggttcgctctgggctgccgtctgcgagcagcgtctcgatgacctcccggtgcgagtcgcggtcgtggatctgcatgggcaggttcagctccttggcgagcgcgatatgctcgcggaaggcgtctcgctgcagttccttcgcgccttccccggtgcgaaacaggtccatgccggtctcgccgatggcgaccacctgatgcgggtatgcgagggccaggcgatgcacttcggcgagcgcgtcgtcgaagctcacgtcatggtggggcttgtatttcagcgacagaccgtccggtccggggacgccgcggtgaccgtggagcacggcttcattggggtggattgcgatggcggcatgaacagagtcgggatggtcgacggccatctggatggcggtcatgaggttcggcagctcgcacccgcagtcgatgatgccggtgacgccgactgccgcggcttgggcgagcagttgctccacgtcgtacaccggtacttccggctgtcctttttcgacggcttcgtggctcatggcccgcgcaaacggaatgacggatgccacatgcgtatggttgtcgatgacgtgcgcgtcgtcgggcagcggcgacggcgcgggcgcccagctgcggtcacgatgatgatgcttgctcatgtctcaccagtgtagcgagcggcacggcattgctgcgcggccgttcatgagtctcgcctcgccggctaccgccagcagttctcgtagggcaggccggtcagtcgttccaccacatgacgggtttcgggcgtgacgtcggccttgtcgccgccgttgcgcaggcgggtgatctctgtcaatacgatgccgtccgcacgcttgttgatggcgagatgggcggacacaatccagcagatgaccatcgcgacggcaagacggtaaaccagcccagcagcacggctcccaatccaatgcccgccaccgtcgtctgccatgcgcgcgtcgcgtcgaagccgaccgcgcccagcaccaggccggcggcaatcgtcgctattcccgagcccagctgacggaacgatgtctgaatgccggagaacgtggcggaacggtaccggcgagtcacgatctggtcgatgtccgcgatgtacgggaacaccgtccaccacggttccggcagcgcgccgaccagcatccacgccgcgaacagccaggccgtaccaagccagccgatgaaattgatcgcgtacagccgtttcgggcctatcttggtcatcgcccagccgaacaccggcatcagcggcagcgagatggcggcgcatcccggcatcagcgacgcgaacgccgccgtatggttccagtcgtgcaccacgaagaacacgaacgtctggccgaacacgtccatcgtcacctgcaccagaaggtagatggccagatgcttgcggagctccttgacgcgcagcgtgctcgcatactcgcgcaacaccagccgtgcacgccgcagccagcccgccatgccgacgtgcccgtcacgcttctcgccccacgcgtgcgcgccgaatccggcagtctcaggcgtcatctcccaggtacaccgccagcaggcgaacacgtatatgccgaacggcatctccggaatccacaggaacacccccagcaggatcatcggcgatatcatcatcagcagcagatggcgtacggccacctgccccagctgggcgcgcggaatgcggatcgaggtgatcggcggcgtgaccaccggggcgatcagcgtgttgtcgaatccgatcaccgacacgtcaccgggcacgttcacgccgtcggcggtgaaccgcagcacgatgcccaccgcgatcagatcgttgtaggtgatgatggcggtggtgtcccctccctccaatgcgagcgcggcctgatagccgccctcgactgtggggtgcaccgggcctatctgattgaccttgaatcccatgcggttcccgatgtcatgcaccgcggccacctcgactgattggcccatgacgcggccgggccggcgacgtacgtgaccgcgagcgtttcagcaggctcagcgcgcacggtgccgatgcgcggatcgggcacaacgctggccacgccttcgagaggacagttcagcacgaccagcggcacgcgcttcgcatagtcgcggatgaaactgatgccgggcgcgtcggtggacaggatgacgccgttcaccttgtcggcgagatggtcgagcatctgctgtgtgcgctgcccggacgaccccgtttcgatgacgctcaccgcgctgtccgattccatggccgtgacctgcgcccctttgaggatctgcgacgagacgccgtcggcagtgtccttgaccaccagcgcgatgatgctgccggggaggccccgaacggggagaacggaggcggtgcgctcgcactgccgaccggcacagacgaccgcgaggccaaggccgcctacacgttcgcgcacggcgacggcgtgaaggggaatcttgcgcaggagggcattcctccgctgaaatcgacgctcggcgacccgcggcccagaccgatgatttcttcggagggcagaagccccacgccgtcatcgcccaggcgtccaaggacgtgcgcaccgacttcacgtatctgtcgtacacggcgtacgcgaactcgatcgccgtggattccatcggccagtcataccacggcaaactcaccttgcacgaggccctgcagcagtggggcgaatcgctcaagaaatatggagaagagtaaggcttcaccgtacggtaggccgggtgccgacccgaacaatgaaaggaacatcatgcaactgttgtgatcgtgccgcacgcacgatcgaaatcccttcataatccgccgtgcgcggcagtccgacatccaacccctgatgcgacacgcccggattgcttcgcacaattgaagcacggcattccggagaatggcggaatgccgcgaccctgtgaacgcagatagacgattgtgctacgcaatccgggcgtgtcgcgtcagggggttggatgaaaggccctcacgctccggtccgataggcgcaaccacacaccggaaaagaagaacccggcggggaagccgccgggtgagagaagagagagaagaaggggttcaattatggggtttcaacaacctcgccaacgttgtaacaaccgctgacatgttctatataaccgcatcatgcttggaggaatgatgcacgttcctcggaattatctgtgagatgtgtgcccgacttgtgagcatgtagtcacatcccggcacaatgtacggaaaaccggccaataggcaaggaacatggccgttcttcaccggtaacaaccctccgtcactttgcggcgggctgagcaaacggcagagctgtttgtagacgaaggcgatccgacaggcgagcaagtgggctgcggccgaaggccgtccccaattgcagggcccgaatggctgtcgcgtagcgactgggggtggtcaccggtcgtcgcaatcatcctctgcggacccaccgcatccacatcctccccaactaccgcagccgggttcgatggcagcagcgaccacgcatacgacacctgatactcataatcgctgccgcgccgatgctcgctcagccgcaggtattcattgatacgctgctgcacgtccatgagctcgtcacgggtcagcagcagcgtcccggtggtcatcggcgtgaaggggaattgccgacgtctctcagtgaggggtatggccgcgccagcttccatgacaccgttgatgcgcatgcgcagcgccttgagcaccccgtccatgaccctcatgcgcatggcggagtcacgttgctcgctaacggccatgctgaaggattccgcggcgggcgcgaacgactgtttggcaccagagggtgccacatcggtcaggtcgacttgctcgccggccgtgacaccggtaccggtggcggccggcgccgccggtacttgcatgatgccggtcatcgcaacacatgcgatagccgccaaagcgcggcgtcacttccttgtatgactgtcagttgagcataatatacgaaaaatatttcctattttctaccattgctcacgtattggacgaaaaatccccctgacattcatatgtcagggggattacaacaaagcctcaacagtcaacggcccttgtcagcgcctagatttcactgcttgagttcggcttgagccgcggcaaaccgctcagcctcggccttcttgcgggcggcgagctcggtgtcgaagcgggtgagctcctcggccacagcctcaggcggaattttcgcgaaaatcggatgcggcttcggcaccggagtgccggccaccagacgctcgctctcccacgggtgcacggtctcaccgagcttgtagtcgccggtgatgatcgggtacgtgaagcccggcttgtcgaggtcttcgacctcttcaaggcgcggcagcggcgagaatacgcctgagccgcccagcgcctcgtagaccttctgcgacgcgtgcggcaggaacggcgccagaaggtggttcgcgtcgtacaccgcctgcgctgccacatgcagcaccgtgcccagacgagcctcgtcgtccttgatcttccacggctcctcggcggagatgtacttgttgatgtcgccgaccacgcgcatcgcggcgaccagcgcgttcttctggtgatgcttctcgatcagcgcgccgatctcgtcgaacgcgtccgaggtctccttgagcagcgcacggtcctcgttggtcatcgagtcctcgtcgagcgccgggatctcgccgaagttcttgttgatcaggttggcgacgcgattgaccagattgccccagctcgcggccagctcctcgttgttgtggcgtacgaactcggcccacgtgaagtcggcgtcggaggtctccggtccggcgatcgagatgtagtagcgcacagcgtccacggggtagcgagcgaggatgtccttgacgtagatgacgatgccgcgcgacgagctgaacttcttgccctccatcgtcatgaactcgctggccaccacctgctcgggcaggttcagcgggccgagttcaccggtctctccgcccttggaacccttgccgttgtaggcaagcatctcggagggccagatctgggagtggaaggtgatgttgtccttgcccatgaagtagtaggccgggcagctcgggtcgttccaccactcgcgccacttctccgggtcgccttggcggcgggcccattcgatggaggccgacaggtagccgatcaccgcgtcgaaccacacgtacaacttcttgttcggattgtcgatccatcccgccaccggtacggggatgccccagtcgatgtcgcgcgtgatggcgcggggcttgacttccttgaacaggccgatggagaagttgatgacgttggtgcgccagcccttgcgggtcttgagccacgcgaggttcgcctcggcgagcgccggcaggtcgaggaagaagtgttcggtctcctcgaagcgcggggtttcgccgttgatcctggagacggggttgatcagctcgtcggggtcgagctcgttgccgcaggcgtcgcactggtcgccgcgggcgccgtcggcgtggcagatcgggcattcgccctcgatgtagcggtccggcagcgtgcgtccggtggacggcgagatcgcgaccttctgcgtgcccttatagatgtatccgttctgcaggcactgcttgaacagctcctgcaccacatgctcatggttgccggtggtggtgcgggtgaacaggtcgtagctcaggccgaggtcgcacaggtccttggcgatcacgcggttgtagcggttcgcgagctcctgggcggtcagtccctccttctccgcctcgacgagaatcggggtgccgtgctcgtcggtgccagacaccatcagcacgtcgttgcccttcatacgctcatatcgggcgtagacgtccgagggcacgccgaaaccggcgacatgcccgatgtgacgggggccgttcgcgtacggccaagcgacatttaccaaaacatgactcataaatcccgattatccggctcagcggggacaccgcggcatatccacagcattatccacaatgcggcgtcgcggaatgtgagttatgcacatatccacagatttcgccaggtcggtggcggaccgccgcatcgtatggttatggtcggcgtatgaacagaatactgccttcggatatcagatatggagtcgcgccggcgcccgaccagacggatgtcgctgaagcggcaaaagtcggcaagccgcagcccaacgcgacacagcccgacacagggccgcccagcgcaacgcgacccactgcgacggcaccaagcaagactcagcccggcgcaacgcggcccggcacggagtcagccggcacaatcagccgcagcgacaacgccgtcgcaatcgtttccgacctcatcgcgcgcggcaccatgccgcgtatcgacaccacgccactgctcacccacaaggaccttcccggtccgctcagcatggctcggctgacgcatttcggcaccctgcactcgctcgaccaaaccaacgcatacagcgccgagcacgccgacaccctgtacggccgcgcgatgatcgcgctgaaactcatcccgttcgggacgattgcatgcgcgctcaccgccgcgtgggtatggctcggcggcacgttcccgcgcacggtcgatgtcatatccagctcccattaccgggcggattcgcacgggcggaagattcgcgtcttcaaccgcaagacggctcccgagcacgtcatacaggtcgggaacctgcgcatcaccacgccgatgcgcacagcctgcgacatcgcgctgctgacgccgggagagctgaacgagcatgacgcgtgcgacgtgctgtgcgccttgttcgaggagtatcaggtcagtcttacgcagtgcatgcagacgctcgatgacaaccatttctggccgaacacccaaccggctagggaactgttcacatcgatgaagcatttcttctgattgcaagcggtcgcggggccgcatcggcctcccgtccgactcaaccatcgacacggctcaccgccacgacacatcagcacgacacatcaacacgacgaaaggagagccacatgcgaatgccatcacaggagaagacattgcagcgactgcagaatcccgcggagacgctgtgcgagcgtccccgcgcggggacggccaggcgacggcttcgacacagtcaagccagacgagccaaacgcaagagcattcccggcagacggatgcatgctctgcaacggcgtgaacaggcgacggcgtcacggcggtcaacgcgggcggcccctccccctccgccgctcagactctccccgctgctggcgtgcgatcccgcgaccgcgccggaagtgctctggttcatcgccgagcatgagccggaactgcggcgctggctggtcgccaatcccagcgcggacgccgcacttctggaatacgtcgcgcaggcgggcggccccggcgtcaaccgcgccctgaccatcctgctcgacggtctgccggcggcataagtcaggatttcattgccagaacggccgtatacacctgcttgcggttcggcaacgagccatccggcagcggatgttcggcgaccacctgcgcgatcgcgtctttgatgcgcacgccatcctccagggcacggtcgatggccagcacggccagatcgtcgatgctcaacgtcgccggcgcggccgcctccgcctcctcatccgacgcgccaccaatcaccagcaccatctcgccgcgcggcggattgtcaacgacgccttggcgtatcgtgccgaccatgccgcgacgaatctcctcataatccttcgtcagctcgcggcacaacgccatcgcgcggttcgggccgaacgcatcgagcaggtcatccatcgaatccgcgatgcgatggggcgtctcgtagaacacgatcgtgcggcgctcggactgcagcatgcgcagatgctgcacgcgttcggagtgcttgcgcggcaggaacccctcataacagaaccggtcggtcggcaggccggagagcgcgagcgcgtcgagcacggcgctcggtccgggcgcgcacgtgaccggcagcccacgctcgatggcccggcgcacgatcgccagtccgggatcgttgatggtcggcatgcccgcgtcggataccaccagcacggtggcgccggtctccacacggtcgagcagcccgtcggccttggctcgctcgttgtggtcgtgataggcgatgaccgtgccgttcacgtgcacgccgagtcggttcgcgaggtcatacagtcgccgcgtgtcctcggccgcgacgatgtcggcgtccgccagcagcgccttcaatcggtcggaggcgtcgcccacattgccgatcggcgtggcggcgagcacaacagtgccgctcggcaccatgaccgtccgcggggcggccttcggctcggtggcgtccggtacagtggcgtccggtacagtggcgtccggcgaggcgccctccggcacgacttgcgaatcatcttgcacagtatccatggttcccagtatcccgcacgccaagtacctgacgaccacccgttgcgtccctaagtgcacgccgaaacgacaagtgcgcgaacataagaacgcaaatgaccctgtttgcgtacctaagtgcgcacggtcgtcgtttcagcgcgcacttaagaacgcaaaaccgcctatccgcaccgctatataccgcgtctcccctgttacacccccgctggtatggttcttagagttttcttaatggaattacaccattgatagtgacgggaattttcatgggtttcgttcatttcatcgtcaatttgctgaaggaccctcgcggcgcaatcgccagctggattgccatgggcaccgcacctgcgctcggcttcatctttctcatcgtattcattgagacgggcgtggtgttcttcccgttcctccccggcgactcgctgctgttcgcagccggcttcttcgccgcgcagggcgacagcgggctgccgttgatggcactgctgcccatagtgtggattgctccgatcctgggcgatcagagcaactacttcatcggacacttcttcggacgccgaatcatcgcgtcaggcaaggtgaaggccatgacgccggaacggctggcgaaaaccgagaagatgatcgaaaaatgggggccactggcggtgttcctcgggcgtttcttcccattcatccgcacgttcatgccgttcatctccggtatttccggcatgcgctggagccggttcaccccgttctcggtgctgggcggcctgtgctggtccacgctgttcacactgctgggattcttcttcggcaacatccccgtcgtgcagaagcatttcgaattggtcatcgtgctgattctgctggtgtcgctgctgccgaccatcatcggactgctcaaggcgaaattcggcaagaagcccggtaccgcggcgaactcatcgagtgtggcggccggcacgcagaacaagtaacgcgaccggccactcctgttggccgcccggcctgcctgattacgttccgttgcgtcactgggtgagggctcacccagtgacgcaccccacgcacagtgacgcatatcagcccataaccggcacccaattttcacacacgccggcttgcatttggacatgggtcgtattaatgtgtattaagttgtcctgcgaagcaaggcaacatccaaggggctgtagctcagttggtagagcgcttcgttcgcatcgaagaggtcgtggtttcgattaccatcagctccacgaaggccgattccattccaccgggatcggcctttttcatttttcgcccccgatgaccatacgcccccgctggcgggggctgtcgagcacagcgagactggggggggtctggagccgatacggtaaagaccgcccccatggtaaagaccacccccagtcggctttcagtcgacagccccgccagcgggaggaagattcagcaaccgctggtggttcaggagccgaggcgctggcggatgaaggcattcagcgcttcggcggtgatgccggcgaagccgtcgatggaggcgcattgcggaccgtcggctttggcgttgcggttgaagccgagctgggcaatggtcgtggctccggacgcgacagccgaggcgatgcccgtggccgagtcctccaaagcgacacacctcgcgatgccagggagtgccgcggcgacatcggctccggccacgcccgtttcgatgccgagcatcttcgccgccgccagatatggagccggatcgggcttatgcggcaggtcatcgtcaccgcagacgaatccagcgaacgcgccggccggcgcatgatcaatcacgttctgagcgagcctgcgcggcgatgtcgtgaccagcacggagggaatcccggcatcgaccagcgaccccagcacgtccagtacgccattcgtccaaggcaccctctcgaactccttcttggcgacgtaatcgaccatcgccttggcaatctgctcgggcggcagattcgtcccgtgctcgatcatcgttttcgcgcaatggtcaagcggagtgccagaacaggaccacgctagatcctcatcccaatacccgccatgcgccgcggcgatctccatctcgccctcgtgccagtagggttccgaatcgatcaacgtaccgtccagatcccagaacacggccttcaacaacatgtcactcatgcacaacccaccttgtattgacgccaactgtatgcctgcatgcccagcaaccgggctttcgttttcattatcccagatgacctcgaagagggcgcctgattcttgacgtccattttcttgacgtccattacacgctcatgactcagcaacgaccatacttcgaccgaggcaacccgcaatcagcgcaaacgaaagcgggccgctggcaggatttccgccaacggccctcaagaccagtcaaccgattcggtacgggctgcggcaatcagtcgaaatcgaaacgaaccgttgactgccgccgcccagtcaagagacttaccgattcgcgcgacggcgcagcgacagcgtcacaccgcctgccgcgagcagcgccgccactgcggtaagaagaccgaacacatccgcaccggttttcgccacagcgtccggggtcggcttctgcacgtcgccggtaccggcgccagtgccgtcaccggtaccgtcaccgtccggcttttcgctcgggtctggagtgggatcgggatccggcccgggctccggctcctcgacagccgccagcgtcgccgtatatgtcacggtcacggcatccgcgccctccggcacgttcgccgaaccgaccacttcataccggtgcgccgccgtatcgtttacggtcacgtcgatgccatccgcaagcacatccgcgggcttgaggccgtccgcgaccagggtccgcccgccgtcctcgccgatctcgtagacggcgtagctgtcggcgaccaccagcgaagccgccgcaccgatctgcatggtgtcgatgtgcgccctgtcggtgccctcgacgcgcccgaccggcagctcgccaccgttttcactcgctccgaccaaagtaacattggcggtgtcgtacggcagcgacgcgatgcggctgcctgacacgttgctcgggtacaggtcgagcgagcgcatcatgaatcgcgcgtaaccgagatgcccggcgtagttgagctggccggccttgttgaaccacgcggtcttgacgctcgcgtcagcggcgacgaccttgccgatccacgcctgcgcgtcgatgagcggcaaatcgtcttccttggccaccgtgcgcatagcgccggcatactcgtcttccccgccgcgcacggtgaccggcgtcaccagcacgaccttggcgcccgcctccttcgccttggcggccacggagcgaatatgcccggcgaacgcggcggcgtcgctttccgcaagattcccgtcagcgtcatacaggtccggagccaagaagaggatgtccggcgaatactcgtccaccatcgcagcgtagtcctcgtccatctgcttggcagttagaccgccctgcccggccgccacgaagaacttggcacgctgcagttcgcggtccgtggcgctcagcccggtgacgtattcccagcgcacgcgctcgtcgagcagctgcacgatgttcttggcaatcagatgatccgtatacccaccttcgatggtctcgccacccatgaacacgatatttttgcgagcaccggtatcggagatgatcggctgcaacgcgttcaccgccgcatcgaccttcgtcaccgccacggcactggtttcggcgctgattcgcttggcttccgcatcggtcagcgtgcggctccatgcggcgacgtaatcgacaatgccggtgagctgctgcgcgccgccggcgctgtcggtcccgcggatcgcgccggccgtggccgtgttcaccgtgatcgcgcccggcacgttcagctgagtgcccgcgccgccgctgatcgcgcgcatcgcggctccgtcaacatagatcgtgaagccgttcgccacgaagttcacggacaccgtatgccatgcgccatccgcgaggtcgttcgtgccgaccgtgtagaagtcgccggtgttgccggagttgagaaactgcaccagaccggtcgcgctcaggcgcacggtcgcgcgggtcgcggagtcggagtcgcccagcgagaacagcgtctgcggctgtccggtcgccgacgcacggaacctgatggtcacgttggactcccgcttgccggccacagcgctcaccacatcgccgcccaggtcaacgtactgtgcgccggagaggaacttgcccacggacttggccgcggccggggcgggttcaagcccgtccgagcccttcagcccgttgccgtcggcgtccaccgtcacggtcggcttgtccagtgtcgtgtcggagctgctccaccgggcgagcgggtcgtcgttggcgatcatattgagcgctcccagcgtgaacttggcccattcgatgtgcccgttctcgccggggtggatgtcgttgccggcacccatatacgtgccggattcgcggttgccgccgccaagtgccagccactgcttgttgaagtccaccagcagcacgttcttgtcgagcgcgagtcgacgttccgcgtcaaagtacgtgtcgaggttggcgttgaacgtcgtgttggtcgtgtagttctgcgtctgcagcaccgggatggcgccgaggtcgcggatcttgtcaatcagtgtggacaggttggcgatgtactggtcgacggtgaacgcctggcctgtacgcccgtcgttcatgccgaacgtgaggaacacgacgtcggggtgcttgtcggacacccatttctcgaatgcgccgtccttgagcggccaactggcgtccgcgctggagatgccggtgttcatgaccacatcgttggcgcgggatacaccgcgcaccgacgtggtgtccagatggttcgcgaacagttccgaataggtgcggtagccgcgcgtgaactgcacgccgtgcgtgatggagtcgccggtgaacagccagttgatacggtcggtctttgcgagcttttcggagagcgcctgccagtcgtcgagcgcctcgttgcgggtcttccatgcggcgatgtccgccggcagttcgaccggctggctcacggtgacggggtcaccggtgatggacactgattcgagcaccgtctcgccgctcgcgtctgcggtggcgtcgatggtcgcgctcggcgtgaacgagccggccgtcgcgtccgcttccgtcaccgtgtggtaggcgagctgtttgccgttgccgctgacgcatgcaccggtcgctcccggagccaacctgctccaccggcatacgggagcggggttgctcgccgactgcggggtcgtcacgccgtccagattggattcgcgcggatagaccgcgaatgactgcgtgccgacgttctcataggtgatccggtaggtcagcgtgtcaccgaccttgaccgggtctccgttgtcatcggtacgttcgatggtgagtttgagccgcttggctgcgggatccggttcggtgacggtcaccgccaactcgccttcggcgaagctgtgcagcgtgtcttcggactgcgcgtacttgccggtgatcttcatcgtcgctttcgcgacggtaccactgacagccgccgcaggcacagtcaccggaacgttcacggtcgcgctctgaccggcggcaagattgccgacgttcacggcttcggcgctccaatcagacggcagacctgtgggggtcacggtgacgttcgtgtagtcggtcagaccgtcgttggtgacggtgaccggcgcggtcagcgtcccctcgccttccttgacggtcgcggtgccgctcgccgtggcggtgagatatcccagccattccatcgacacgcgcgtgtaggtgatgctttcgccttcgtacagcagaccgtaaccaccaccggcggcgtcgttcagcgcggtgatgaccgagtaggccatcgagccttccttgaacagcttgccggccgaccatgtggtgccgtcatcgaatgaaacacgcacgacaccgttcgcacggccctcgttgctcgcacgcggcgccgaatacagcagcaccttcgccttcgccgaaccttccggagcgttcgggaacgcgcgcgtgatctgcgcgttgttgttcggatccggcagctgggtctccgacttgatcggaccatagttcacgccgccgtcctccgagatcgcaacgcgacggtatcccgccgcgcccggacgggaattgagcatcacgcgaccgtcggacagctccacgaccttgttctcgtccatgttcgcttcggtcacggggttgccggccttccaggtcttgccatggtcgtcggaatacacggacaccgcgatgttcgtgttgctcgtggtgcgcacagcgtattgctgtatcaaacggcccttatactgcccgtacttgagctggatgccatggccggaggatgcgaaacgggacttccactcgtcttcgtgacccttggtgatgtctttggtgatgttgcgcggctcgctccatgttgcgccgttgtcgtcggattccatgacgacggcctgcagcacgttgcgtgcatcttccacacccaatacggagccaaagtagccctgatcgtacgatttcacgcagaacaggaagatcttgccggcttcctcgtcgaccacataggacgggtcggagtagccgtatttgttggtggcgctgcgtccctgcgccacgtatgccagcgtctcccatgacttgcctccgtccttggagatgcgctgcacgatcgagttcgggttgggcgcgtccgccgccgatttcggacgcaaatcccatgcggcgagaatccagccgttgggtgcctgcgcgatggcggggatgcggtagtaatcggtgttgccgatctgcttgttggtcgccagcaggagcggttcgccgtctttgcgctccgtcggcgtggacgcggcgtcgtcggccggccccgcgacggtcaccgtgccggtggtgaacgtcatgtcatcttgcagcacctgcgtgccgtcgcgatccgatgtggcgcggaatgtggctgtcggcgtgtatctgcgggccacgacgtcctcagcggtgatgacgtgataggcgaacccacatgatgcggtccggttggcctccactccggatcggcagctgtttctcggataggacaccacgtccacgcgttcgatgttcgactcgctcgggtaggcataaatcttctgcgcggttttgttggtgtaggtgaagttgaaggtcagccggtcgccgatcttcacgttatcgccgagcgtatcggtacgctgcatggcgacgcgcagtgtggaggtcgcagggacggccggcaccgtctcgccggtgatgtcgacgctttgcagaacgccattggtgccgtcctgagtggtcgccgacacggtcgcggtgggcgtgaagccgtttgcgacatcgtcttcggtcaccacatggtaggcgaactccttgctcgcgctccaagtgcatgcagccgaagcacccgccgcgagattcccccaccgacacatgggattggggttgctcgccgactgcggcgtggcgacattgttgaggttcgacgccgtgggatgcacaatgaaaccggtatcggaaacgtttttgtagccgagactgtaggtgagcttgtcgccgacttcggccggggtgccgttgctgtcggtgcgggtcagggtgagttgcagatattcttggggtgtttcgtccgccgcattcgcgctgatggtgccagccggcagcactgccagcatggcgatggccaccagcagcccgctgagcttgcgcatcagcgtttttgccgtggcacgtcggaatattgtggtcatatcgagtctttcttctctgcggcaggtcagcttccggaccgatacgggggtagcagcgtcttcttcggcgcagtcggcttctttaccgcataatttttatgaactatcggttatatgagaatcacagcgatacgctgaaatttccctcattgtagtctacagagtgaacgaattacaacatgaaaaagcccccgtgtttcgggggcttttcctgtatgccgtcactcatcggtcggacggtttaccgccgcggcagtgaggtctcggtcagatcagtgagcggagcggcggcgcagcgacaacgccgcaacaccggacagtgccaacaagacgaacacgatggacatgcctgccgtggaagcgccggtcttggacaggccgggcttctcggtgggcacgtcgaccttcggtccggccggcttctccggttcgggcttgggttcgggctttggctcaggatcggcgctcttctcggccacgtcgatggtgaacgaggcagtcaacggatccgcaccctccacaggcacactcaccgtgaccgtcaccacaccagccgccgcgaacggctcagccaaatcgaccgccttgccgtcagcatccacagccgacagcgaatactcgccggcagccaacgccttcgacgaaccatcactcatcgccgcggtcaccgacaccttcgacgcatcaaacacgtcaccgaccttcacaccagcctgcgacgtcaccgccgaaacaccggtgatggtcggctccggctcaggatcgggctcgctcttttcggtgacgttcaccgtgatggagccgtcaaagccggtcgtggcgtcggcattcgcagcggacgtgccggtcacacgcaggacgatcttggcgacatcgtccttcttggcagttgcgggaacattcaccgtgacggtcacgtccttggacgcgccgctggcaagagcgcccacgttcaccggagaggcagaccatccggtcggcagatcggccggagtcaccgtcacgccggtgtaatccacagaaccgacgttgctcaccggaacggtcacgtccaccgtgctggcaccctcttcaaccgaagcggtcacgtcatctgcggtggcggacaggtagccgagccaatccatggaaatgtgcgtgtacatgatgtcgtggctgtcaatgccgccgccggtgacccaagcgccttcgtacagcagaccataaccaccgccagcggcaccgctcagcgcggtgatgaccgagtaggccatcgagccttccttgtacagctttccggatgaccacgtggtaccgtcatcgagcgagatgcggaccacgccgttcgcacggccctcgttgttcgcgcgcggcgacgagtacagcagcaccttcgccttcgccgagccctcgggagcattcgggaacgcgcgcgtaatatgcgcgttgttgttcggatccggcagctgcgtctcgtttttgaccgtaccgtagttcacgccgccgtcctccgaaatcgccacgcgacggtaaccggaaccgttacccgggcgggagttgagcatcacacggccatcagacagctccacgaccttgttctcatccatcagcatgcccgtcaccgggttgccggcctgccaggtcttgccatggtcgtcggagtacacggataccgcggcgttcgaaccggtcgtacggcccacggcatactgctgaatcagacgacccttgtacttgccgtacttgagctggatgccggcaccggaggtggcgaaacgggacttccactcgttctcgtaacccttggtgatgtcagcggtgatgtcacgcggcttgctccacgtctcgccgttgtcctttgagctgacgacgaccgcatgcagcacattgcggttgctctcatcgacgccaagctgagagtcggcgaagcccttgttatacgagtgaacgaagaacaggaagatctcgccggtctccttatcgaccacataggatgggtcggaatagccgtagcgttccggggcgttcttgccctgcgcgacatattggatcggcgtccacgacttgccgccatccttggagatgcgctgcacgatggagttcggctgcggggcatcccagcacttgacgccgctgccgttggccatcgccgtattgggacgctggtcgaatgcggcgaggatccagccgttgggcgcctcggcgagcgccggaatacggtagcattcggtaccgaggttctggcgggcggtggccaggcgcacggcctcaccatcggcacggtctgtggggatggtggccggatcggggcgcttgccttccttcacggtgacggtatcgccggtggagacgatgttgtcttgcagcacctgagtgccccctcggtcagaggtggccttccacacggtacgcggggtgaagctgccggccgtgagatcatccgcagtgatggtgtggctggccgtggagcaagggtaggaagcgcctcccgcaaggttctcataacggcagttcggcgttcctgtggtcagcacaccgctcagattcgactcggcggggaatgcggtgaatgccgaactcgtgttgttggtgttggtgaaactgtaggtgagcgtgtcaccgacatatacctcgtcgccgagggcgtcggtacgcgtcatcgtgacggtgagcatgtcagcatcatcgctggccgcactcgcggtggatacccctgcgggcagtaccaccagcatggcagcggccgccaccagcgcgccaagacggcgcagcagcgatggcttggtcgaacgaaccatgtgtgttcctctcctgtgcaacgccgggtcacgactttgggccccgaccgccgttccacctatgggacggcatggcttcctcaccatcaagcgttatttgtatagtatcttgctattcaatcttcattggcatagcaaaatcgctgtcgggtacagtattatagcctacattgtgaacaaaatgacatacaattgtctgcaattccgtatcattcccccacttcccatccagcacccgcccaaagtcccatccgacaggaataaaacgggacgatggcgggatacaagacgtccccatacgacaaaagtcccatccagcggacgccagatgggactatgacgggatgacggccgcctattcgcgaccggatgtgatctgcaacggtgcgatatatgcgcgtccgcgccgacgcacatgatagaacggcgactgccgcacctcgacgacttcaccatccataccggcctcgaacacgctatcgccgtccagtcgacggcgaagatgccgaatctgccggcgcagctgcctgttctcctcctgcaacgaaagaatatgcgtgacgcctgcgagattgataccctcgtcctggctcaactgctgcgcctgtgcaagacgcgccacgtcacgaagcgtgtagcgccgcgcaccaccctccgtgcgctgaggcaccaccagaccaaggcggtcgtactgacgcaacgtctgtggatgcacgcccgcgatctgagccgcctggctcaccgtgaacaccggcatctccacgttcaggccgagcgcgtcgattgcatcgagatcaacaccgccggagaccaacgccgcggcgcaagcagcatacgcacgcctgacttcctgtgcgattcgcgccatgatcatcatctccttaacgttgattatcggctgcggggtgatggtgaaccgcccccagtcgctccgcgacgatgcgagatgccgccgggaggattaccgctcggcggcaaccgcttcggcgtagccttcgacggacttgtcgaattccttcgcggcgtgcttcgcgcccagaccaggcttcgcgggcacgcgaatctgcacgcgcccaatcaggtcgccggcagtggcggactgaacgcccttgccgctgacacggatctccgcgccactggacgagcccgccggcaccttgaacgtgacggtctcgccatcgatgtcatgcgcttccacgcgggcaccggccacagcctcgcctacggtcaccggcacatccatgacgatgtcatggccgcgcatcgtgaaccgcggatccggcttcacctgcacggtcagatacatgtcgccgttcgcgccgccgttgctgcccggcttgcccttgcctgcgatacgaatcttctgcccgtccttgaccccggcgggaatatgcgtcttgaactgcttgccgtccacgcgcagcgacacggtagcgcccttgaccgcctgacggaacgtcaacgtgatcttggacttgcggtcatcgccgcgctgcggagtcggcggctcctcatacgggttaccgtaacgcgaaccgccatagctcgcactgccacgcccaccggcagccccgccgaacatcgagaagatgtcgttgagattgctcggaccgccgccggacgtgctgaagcgcacattgccgccgttgccgccgaacatcgaaccgaagatatccgagaatccggaagcgtcgaacccgccctggccggagccgccagagaaacgcgccccgcccatgccgaactggcggatcgcgtcgtacttctgccgctgctccttgttgctgagcacgtcgtacgcctcggagatgtccttgaacctctcctcggcctccttcgtcttgttcaggtcgggatggtatttgcgcgccagcttgcggtacgctttggtgatgtcatcctcggtggcgtccttggagacaccgaggactttgtagaaatccttgctcagccattcattctcagccattcaggtctcctttcgtgtatgcgtgtatgtgtgtcgtatgttgtttttctgttgttgcgtattggcgttcgtcaccgcggaggtcggcatgtttgctgtgaccggagcggagacgacggtgatgtgatcgtgtctgcggtcaacgcgcgaccgtgcggagttttgtcgcttggggtagcggacgcttggggcggtgcggagaccgtagaccgtgcggagcgggcgggcatgttgtccgacttcgctccaggccgctcgggccgaggtttacggtcggacaacatgcccgcccgctccgcactcgttaggtgcagtgacttgcgtcgcatctccgagtcgggtgcatgttttgcgcgagtgtggtatcgcacgcttgccgcggtgacagcgagatgagacaggtggtttgcggaaatctgagggtagccggatttccgcaaactcctcttgggggggggttagttttgcggggaggctactacgacgcgggcggcgcggatcacgcggtcaccgatgcggtagccggcttccacgaccgtgtcgacggtctccttctcggcctcggcgtccggcttgtgcaggatcgcctcatgcttggttgggtcgaattcctcgcctttttcgccgaacttctccacgccgaacttctcgaacgccttgtcgatcttcgcggccacggccttgaaggaatcgtccatctcgctgtgttcgcggatgcgatcgatgtcgtcgagcgccggcagcaacgcggtcagcacgtcgatgatgccatgctggcggaaacgctcctgctcgcgctgcgcacgattgcggtagttgacgaactcggcgcgttcacgctgcaacgcttcgagatagtcggcggcttccttcttggccttgcccagcggggtcagcgagtcgtcggcggccgctccgtcatccgcacccgcggcagcggagtcaccggtcttatcggaagggcccgcttcggcggacgccttgtccccagccgggccggcagcgcccttatcagcagacgcatccgcagacttggccgagtccgacgccttgccggcagaaccggcggcagcgccgtcggaagggccggcctgcccggtggcggacaggttgtccgcgtcaggcaggtcgttcaggtaatcgtccttgttgaactcggacatgattacttgttgtccttcttgtcgtcatcgtccacgacctcggcgtccaccacgtcgtcatcgccaccgttggaggcggcacccgacgcaccggcagccgcaccggcagcatcagcagcgcccgcagcaccctgctgcgcgtacagtgcctcgccgatcttctgcgcggaagtcatgagctcgctctgcgcgctcttgatcttctcgatgtcctcgcccttcagggcttccttcagggtgttcaccttgtcggtgacttccttggcgatctcgtcggagatcttatccttgttgtcgttgaccagcttctcggtctggtaggcgaatgcctcggcctggttgcgggtctcggcgtcctccttgcgcttcttgtcctcggcctcgtgggcttcggcctccttgaccatgcggtcgatctcgtccttcggcaggcccgagccaccggtgatggtcatcgactgctccttgccggtgcccttgtccttggcggacacgtgcacgatgccgttggcgtcgatgtcgaaggtgacctcgatctgcgggatgccacgcggagccggcgcgatgccagtcagctcgaaggtgcccagcggcttgttgtcgcgagcgaactcacgctcgccctggtagacctgaatcagcacggacggctggttgtcttccgcggtggagaacacctcggagcgcttggtcggaatggcggtgttgcggtcgatgagcttggtcatgatgccgcccttggtctcgatgccgaggctcagcggggtcacgtcgatcagcaggacgtccttgcggtcgcccttgatgacgccggactgcacagcggcgccgacggccacgacctcatccgggttcacggactggttcgcttccttgccgccggtaagctccttgacgagctccttgacggccggcatacgggtggagccaccgaccagcaccacgtggtcgatgtcgctcacggagatgttggcatcgcgcagcacgttgttgaacggcgtgcggcagcggcccagcaggtcggaggtcatttcctcgaagtgcgcacgggtcagggtctcgtccaggtgcaccggggtgccgtcgggcgtcatggccaggtactgcatgttgatggaggtcgaagtggacgaagacagttccttcttcgcctgctccgcggcctccttcagacgctgcagcgcgatcttgtccttggacaggtcgacgccgtacttgttcttgacctcgccgacgagccagtcgatgaccttctgatcccagtcgtcgccgcccaggtggttgtcgccgttggtggccttcacctgaatggtggagaagccgtcgtcgtccttgccgatctccagcagggacacatcgaaggtgccgccgccgaggtcgaagaccaggatgcgctcgtcttccttgcccttctcaagaccgtaggccagcgcggccgcggtcggctcgttgatgatgcgcaggacgttcaggcctgcgatcttgccggcgtccttggtggcctgacgctgggcgtcgttgaagtatgccgggcaggtgatgacggcatcggtgacgggctcgccgaggtacgcctcggcgtccctcttcagcttcatcaggatctgcgcggagatctcctgaggcgtccacttcttgccgtcgatctcgacggtccagtcggtgcccatgtgacgcttcacggagctgatggtgcgatcgacgttggtcacggcctgacgcttggcgacctcgccgaccagaatctcgccggacttactgaacgccaccacggacggcgtggtgcgcgcgccttcggcgttcacgatgacggtgggctcgccaccttcaagggtcgcgatgcaggaattcgtagtacccagatcaataccaactgcacgtgccataatgtgtgctccttagatatcttgttcgtttacgtttgcttgctcaagtcttggccccgcggccatcggtgctcgatcgacgcccacgggtcttcgcctcaaggttgccctcgttttgccttccaaaacttgagcctacactactcaactttcgagcaccagcttttattcccacttcttcacaaaaacttgagtcgatatcactcaagtccgctctcaaaactcgcagatacaccgatttcttagcgaaaaagccgccatatctgcgagttttgagagcccccaaatgcaaagagccggccgcaaccatcacaggttgcagccgactggcgtatcagtcgccccaggcgacgtcacgaatcgcggcgagcgtcagctcagcggcgacccgccttgacggagcgcacggccatcgcgccggcgcccagagcgagcaccatcagcgccaggccgagcacggtcgcgccggtcttgcccagagaagcggtcggctccttgacggtgccctgagcgacagtgccgctgccgttgccgccgttcggcgtcttgtcggcggagcctgaggcggacgggaagctcacggaggcggacttgccggactggcggccgttcaccgtcagcgtgtaggacgcgccctcggccggagtgaagtcggcgaacgagatcgaggtggtggccgcggtggcgacgcgcacgccggagagcggggtggacgtgttggactcggcgacgaccttcttggaggcgttgtcgaccagctggtacgacagcaccgcgtcaccgttgaagccggtgacggccgcgctgtacttgccgtccttgtccttgttcacggtgaccttgccgccgttggacaggttgttctgcgatgtggtgtcggtcgccaggccaagggcgccggcgatcgtgtagaagttatcggtctggtcggtcaggccatccacgcgggacgcaccgggacccgatgcggcaatgcgcagctgggtgccggtgtggctcatgttgccctgggccttgctggaatcggccgcgccttcggtgtcttggccgtcggagtacaggttcttctcggaggtgccgtaggagatggtggtcttggagccgtcggcgttcttcagcacggtgctcagcgcgtagtacggctgggattcgacgatctgcgaggtgtgggcgtggtcggcggtcacgatgatgagggtgtcgctcaggtcgaccttcttgagggcggcggagatggccttgtcaaggtcgtcggtctcgccgatctggccgcaggcgttggcgttgtggtcctgcttgtcgatggaagcgccttcgacctgcaggaagaagcccttctcggacttcgggttggcctgcagcaggccgagcgccttgtcggtgaagtcggcgagggacgcgccctgattgccgagccacttggcgttggtggtgcacacggtcgggttctcgtccttggcggcgtcctgcttggtggccacagacgggttgaactgggtcggcaggttgccgtcgccgagcagggcgagcaccggctggccatccttgtaggtcaggttcttgaagccgtcgacgtcaccgctcttgacggtctggaaaccgcggtcagcggcctgccgccacagggtgttgccgttctcgtcgagctggttgaagtacttggcgccgccgccgatggtcacgtcggcgcgcgtgtcgagcagctgctcggagatggagccgatgccaccgttggccttgagctggtcggcgaggcagctgccgatgccggcgagctcggcgtctttgatatcgaccttgccgtcgccgttcttgtcggtgccgtcccacttgccctgcgggccgtagcaggcgcgctcggaggagtgggattcctggaccgccggagtggcatcctggatctcggaggtggtcacgttgccggtggcgaggccgttggccttggcgagctcaatgaggttgagctgcgggttgcccttgacgtccacggacacggcgttgttgtaggtcttggtgccggtcgcccagccggagccggaggcggaggagtcggtgaccggggtgatcacgccggcggtcttggaaccggtgagctggcccttggaatccttggccatcagcgaatcgttggagctgccgcccagcgagaacgtggtgtactggccgacgccgctttcgacggccttgccggccgaggtctggagtgcgcccggctggccgatcttgtcgaggccctggaacgtgccgttgacgccgtgcaggtagttgcgtgcgacggtgatctcggaatctcccatgccgtcgccgatgaacaggatgacgttcttcgccttcgcgttgccgatcgtggcgatgcgctgggcgccgccgtgcaccgacagggcgtccacgcccttgccgttcagatcgtaggtgccgctcgcggcgaacgccggagcggtcagcgcgcccagggccgcagctgaggtcaacgccgcgacggcgcctttgagcattttgttgatgttcatggatctcttcttccaatcacgaagccgggcatgccccggcggtcaatcaccggcgccgtcgggcacagcaagcctctctcggcagcgccggaaggcctcgcggccctcaccgagcaaactatgtcggccattcaaccgtcgcgcgacgagtatccgaacgtaacgtgaacttccgtggtcattttccgtaaccgagagaacggttttcattttcaaagagccttacacacgcccctttctctttgagaacgtttgcagtatgatgaaacaaatatgatgtcggcagtcacggcacgatggggaattcagcacacagcaaaggagttgtctacatgaataaagcaggaatacgcgaagtggcaaaagcggcaggggtctccatatccaccgtatcccgcgcattcgcccaccccgaagtcgtgtcggagaagacacggcacaaggtgctgcaggccgcggaccagctcgacttcaacatctcccgctcggccgcggccctgaaatccgggcagacgttccgcgtggcgctgctcatgaacgaggagatcaccagctggttcaacacccagatcttcgccggcatcaactcgatcatgcacgacgccggctatgacatctccgtcttccagcacatcgacaccgccgacatgcgtcgcaagttcttcaccgacctgccagtgcgacgcaacgtcgacgcggtgttcgtggcgtccttcgccatcgacgagaaagaggtcgaacagctcaagcgcatccgcgtgccgatcatcggcatcaacacgccgtccatcgacggattcgacgcctccatcagtatcgacgacgaaaacggcatgtacacggccacccagcatctgctcaacctcggccacaagcacatcgtgtacgcctgctcggcggcgtccgagtccatggactcctcgatcgacgcccgcggccgcggattcatccgcgcctgcgaaaacgtcgagaagacgcgcgaactcaactggcaggtggtcaccgtgccgcgcggacgcgcattcgccgattcggcgctgtcggcactgctcgcgctggacgagttccccgacgccatctgctgccagatggacatgatggcgattccgctgatgctcaagctcgaacgctacggacaccgcacaccacgcgactactcgatcatcggcttcgacgacagcccctatgccgacaccgtcaacctcaccaccatgaaacaggacccgttcaagatgggacgttcggccgcccagaaggcaatcaagctcatcaacggagaggaacccgagaagccgcatgaaatcgtgcagccgaccctggtgctgcgcgagtcagacgccctgtacacggactgaacccgtttcagaccgccagggcgcagaccaccagcgcgatcagaagtccgaatatgggattcatcacgctccaatcccaccatcggccggtcacgatcttgtcatacggggcctctgcgaccaccgccgcgaccaacagccgcaacccgtaccgccacacgtcaccggtgtgccgccagttcttgcccgcattgttgtacttgtgacgccagtttgccgttgatgacggtgaggccttcggcgtcgacgccggcggagggtttcttaccgacgtacatggacgtcagcagttccagcgctcgatgacacggtcccccttgtatacggacagaatcgaataatgagcggtatccagacgcagcagacgtgcgaaatgcgggtcgacccccagccaacgtgccgtaaggatgcgcagcacatgcgcgtgcgcgacgaacagcacggaatggccgctctccatcagcggcaccgcctgatcgatggcctgctgcacacggtcatagacgtcgctcagcgactcgcccggcccattatgcacgggaacctgctcgccgtccggcagcgtctccgtccagtcgccttccattgtggggctcagcgcatcgggaccatcattccatagctcccaagagccgccgtgcaattgcgcgatggtctgacgggtacggccctccgcccggccgtaatcccattccgcgagcgccggcagcgtacgcggagcgaacccggcgaggcttgccgtctgctgggccctcttcagcgggctggcgtacacgcagttctcgccgaatccctgcggaaacgccgtctgaatccgggtgccggcatcgcgggcctgtcgctcgccttcggcggtaagaggaatatcggtgcgcccggtatgctgcccggactcactccacacagtctgcccgtgtcggagcagaaccagtcgccctgccgtagccgcgttgccacctgtcgtttgagtcatatgcagtactgtactcaacctgcagcatattcgcatgccgaggcctatatgcgatgcgtctccacctcgcaaaataatggtgacatgacagaatttcaggatggaccgggcaacgacggatcggggctcgacggttcaagcaccgatcggatcatcgaaggcttcgcccgaatcaacgagaaagtggatgccatgcgtaatcagcgtctgaacgaccccgactccctcggcgataaggccgtcaaattcgcgctgccgtccatcgcagggttcgtggccggcaagctgttcactctggtgtggaacaagttcgtcgcccgcaagcgtccatccgatggcacgggcgagctgggggacggagtcgtggaccagcaggagagcctgttcatgagcatcctgttcgccgcattgtccgccgccgtgggagccgcggtctcgcaactctccgatcgcggctccaaagccctcgtcgctcgccgtcaccgtcgccaatccgactgataatcacttggcgtcgtccagcgcattgtcgccgtgcatcttctatgcgcatcagcccgttttgcgtctttaagtgcgcgccgaaacgacaagtgcgcgaacataggaacgcaaatggccctgtttgcgtccttaagtgcgcacgggggggtgcggatgaaaagttggacgctttggtgtccggattggagttcgcatgttttcgatggaggatcggcgcaggaatcagccgcaacgccgcaatcaggtcagatgccacgtgacccgatgcagcggcgtgactcccagacgggcgatggcgtcgcggtgagccgccgaaccgtatcccttgttgtgcgcccagccgtacggcgcgtaccgcggattgccctgcgcgatgtcaaccatcaggtggtccctcgtcaccttcgcgatgaccgccgcgcaggagacggtcgcacaatgacggtcgcccttgaccttgcacgacacctgtaccggaatcggcaacgccggcgcgtcaaacgtgttcatcgtcttggtgatgtaatcgttcggaccgtccaggatgacgtccacgcgacgacccgaaccggccggcccgtccatgccgagctgccgctccacatcgttgagcgcccgcaaggcggcgatgcccaacgcatgcgatatgccccattcgtcgatttcggcgttactcgcctgacctaccgcgtaagcggcgcaccacgaacgcaactcgtcgacgattccttcgcgcctgtgctcggtcagcaatttggaatcggcgacaccggccggcacttgcgcggcggcgaggtcacgtgaccacatggcggccgccccgaccatgaccggaccggccagcgccccgcgcccgacctcatcgcagccgatcaccacatcgcagccttgggcggcaagctgccgctccatatcaagcgtcggatgttcgatcatcgccatatcaccatccgtctgatgtcactgcgccttgccggcgggaacgtccttgaacacatcatgatgggagctcaggaaactcatccggttcagcggccaataccgcatcagtcccactccgaccacattgtcgatgggcaccaagccatgatcaccgtcgtcctgatggtatcgggagtcggctgagctggcgcggttatcccccatgacgaaaatatgcccggcggtcacctcgacgcggaacgagaaactgctcgggtcgacgccggatttgatgtatgacgtctcatcaatcgcgacgccgttgatcttgaccggctgcccggcaccgccgcactcgaccacgtcgcccggcaagccgatcaggcgtttgatgagataatcgcctttgcctctggtggtctcctggttcagccagttcgcggggtcgtggaacacgacgatatcgccgcgtttgagatcgaaatatctcggcgtgagcttcgacgtgatgacccggtcgccgatctcgatggtatcgcgcatcgatccggacggaatcacgtaaaagccgatcaggaagatgcgtaccagcagtaccgccacgaaggggacgacgcaccagatcagcaggtctcggaacgagaacgaatcattgttgtgcttaggcgaggtcttgcgatgggcacctttcctgcggcgggccaacgagtctcggccgtcggtgcccactacccgccccggcatatcggtggggtccacgccatgatcggctatggcgacgatccattcgtcccggctgaattcggtgccggaaccgggcatggcccgatccgtccgatggtcgtctggccgcatagttcctccatcacgcatacatgaaaccccaactatactagcggcgttcctataaattcagcccggaaccaatcggctccgggctgaatttcacggtactgtcgcctcgcttggcaaaactcaggcctgagtcgccttggcggagttgtcgcgacgctcgacgatgcgagccgccttgccgcgcagcttgcgcaggtagtacagcttcgcgcgacgcacgcggcccttgcgcaccagcttgatggagtcgatggacggggagtgcagcgggaagcggcgctccacgccggtgccgaagctgatcttgcggaccaggaaggtctcgcgcaggccggagccctgacgagcgatcaccacaccggtgaaggtctggatacgggagttgttgccttccttgatcttgacgttgacgtcgacggtgtcgccgggacggaacgccgggatctcctcggcgggcttcatgtgcttggcgtcaaatgcctcaacagcgttaaccattgctattccttagtcgctgccgcatatcagcgcactggtttggggttcggtgatgactggcatcacgaacacgtctgtaactccctcgggtctgccctcaggaagcctgtcaatccgccgaaacagcggctttgcgcccgttcggtctggactcatgaagaggcggcttatgcggcggccgaccctcgacacagcaaaacaacattttattgattcatatggacgagacggaattgacatcaacttcggccgggctccgtaacggaagcctcccgttcggccgacggaacgagccgacacgcccggagtgtgcagcacaattgttgggtatcgccatgcgaatggtgcgataaagccaatcgcgatattgaaccgcgacgattgtgctacgcactccgggcgtgtcacaagcacagccccccatacctcgctcgcagccgaaaccaaatcacaatcccctcatgtgccccgtcgtcagtgctggccgtacacgttctggtaacggtcgttcagcttgtcgatgtccgcctgcggaatctcgatgatgtcacccagctgacgggcggcccacatcgtatgagccacctcctccgtcatcgccgcggccttcaccgcggcctccgcatccttgccgatcgtgaacggaccgtggttctgcatcagcaccgcctgcgacttcggatatttcttcagggtctccaccacgcccttgccgatcgcctccgagccgatcagacggaacgggcccaccggcaccgggccgccgaactcgtcacccatcatcgtcaggccgcacgggatgttctgacccgtcgccgcccacgccgtcgcgtacgtcgaatgcgtgtgcaccacgccgtacacgtccggcatgttgcggtagatgtacgcgtgcgacgccgtatccgacgaaggcgcctccgccccatccaccacgtttccgtccagatcgcacaccaccatgctcgacggcgtcaggtactcgtagcgcagacccgacggcttgatcaccatcagatccgccgaatgcagacgctgcgacacattacccgccgtccacaccaccaggttccacttgatcagctgctgatgcaaggccgccacgacctcacgcacctgcttgacctcagcacgaacctcaggaccaaaatcagccaacgaaaccataatcaccactcacttttcttattcgcacttatatatcgggacgttcatcaaaggcggtgccggcgcgccggcacccacgagcgggctcagtattctccgatgccggcgatcggctcctgttcgatgcccaccacgtcgaacagcccgtcgaacatctttttggcccgagtcacctcggccaccggatccggcgactcatcggtccacatctcgaccgtgtagctgccctggtatcccagtcgtttgaagatacgcaggcacgcctcgaagtcgaccgtcccctcaccgaagggcacccgtttgaacacgcctttcgaggtctcgcccaccggcttggtgtccttgaggtgcacggcgacaatgttgtcgatgttggattcgatctcgcgccccacatcgttggtgggccaagccgtgaggttgcccacatccgggtacgcctgcagccatggactgcgcacttgcgacttgtaataggtgaccttgtccagcgagttgatgaacgggtcgtccatcgtctcgatggagagcatcaccagtttcttcgcggccatgtcgacgcatttgcgcaggttctcgacgaagtattcgcgagacagcagggttttcggctcgtaatacacgtcgtatccggcgagttggatgttgcggatgcccagatcgacggcgaggtcgatcgccttgcgcatcatgtcgagcgccttctcgcgcacctcggggtcttttgacccgagcgggaaccgcctgtgaccggagagcatcatggtgttgatgcggctgtgggtgcgccacatggcgtcgcggaaccgtgcccggtcgtgctcggtccagtcgagacgggccagtcgctcgtcgctttcgtcgaccgagaattcaaggaagttgtatcccagctcatgcaccagatcgaacgtctgctcccagctcaggccgcgcggcagcgccttttcatatattcccagcgcgttggtgaccatgtcagcgctccagcgagttctgcatgtcacgcagcgcggcccatccgccgtcgagtgcggtcagcagcgcctcatacgcctcgaacttgcggtcgtacaccgcggtctggtccgcgtgcggctcgaaccgcttggcgagcttcgacatgttgccgaacgcctcctggaacgacccgtacaggcctgatccgaccgccgcgcacatggcaccgccaagaccgcccagttcggttacggccacggtctcgaccggcaggttgagcacgtcggcgaacatctgcacccaaggatcagaattgcatacgccaccggagatgcggatggccttcggcttgtgcccgagcacgcgcagcagctgctcgacatggtggcggtgggcgaatactacgccctcgtacacggcccgcaacagctggtcgcgctcgctggagctgcgcagtccgatgaacgcgccttccgcgcccaggttcacgttgctgccgtagaggaacgggaggaacagcacgtcggtgtacttggcgtcggtacgttccagcatcgctccgagttcgtcgtagctggcggccttggagccgtctgccgtcatcatgcgcagcacgtagtcgaggttgccggcggaggtcgggctggacgcctcgaccaaggtgccaccggtggggaacacggagttcatgcagccgccgtcgagcggcgccatggtcttgctggggaacacgttgatgttccacgttccagcggtgatgctgaagatatcgtcgctcagcacgccggtggcgagcgcgcaggcgtcgatgtcgaacagtccggcatacacgggagtgccttcggcgaggccggtgttcgccgccgcttcggcggcgatggatccgcagcggtcggtcgcgctgacgagcttcggcatgcattccagcatttccgggatgccgaagaagtcgaacagccggccgtcatattcaccggtttcgaggttgaccagattgttgccggaggcgtcgccacgctcctcgaggatctcgccggtcaggaagtgccggatgaagtccttgttggacagcacatgcccgatccgcgcgtactgttccggctcgttgtccttcagccagcgcagcagtaccgggaactgcatgaccatgacgtgctggtgactgatcgggtagatttcggcgacgcggctctcgaattcgttggccaggtccgcggcgcggctgtcggaggagaggatgccgtccatgaacggcttgccgtccttgccgagcacgtacagccccttgccgtggccgaccggtacgacgccgtcgatctggcttccatccagtccggcggattccagcgcggccttgaccgccttgccgatgtcacgccacatctggccggggttgacttcgcggaagccgggacgccgctcgatggcgtcggtcgggaacgacgagacggacagttgccggccatcctggtcgacgatgatgaccttggtgttggttccgccattgtcaatggtgaggaaatgcttcgttgcgtttgtcatgatgattccttattgaatatgtgccgatgatatcgcagccgctcaggcgatcatgttgaacagttcgccgatcttgacggcgacccagccaatccatgtgctcactgcgccggtcatgttggtgacggcggtgaagtccttgggcaggtcgatgttgctctgcgtgaacgattgagtgacccagggcgcgatatcggtgccgacgtagaggatgatgatgacgctcagcgtgccgacgatcagcatcttgaacatgttgcggcgcacgaacggggtgaccagcgcgaggatgaacacgagcgacgcgaggtcggcgaacgggagcatctcgttgccgggcaggatgaaggcgagcagaatggtgatcgggatgagcagcagaccggtggcgagcaccgaggagtcgccgatgagcagcgcggtatccatgccgatgtagaactcgcggttggggaaccagatcttgagctgcttctcggcggcgtcacgcacggaaatcaggccttcgatcagcacgtcgatcatcttgggcagcagcaccatggccgcggcgatgttgatggcgagcgtcacggacttgtcaggactgtagccggcgagcacgccgatgagcagaccgaggatgaaaccgatgaccacgggctcaccgatggcgccgaagcgcttgcggatcttgtcggcgttgaagtcgacgttcttaaggccggggatcttgtcgatgatccagttgacggcgatggcgagcggcgaccaggccagaccggcaaggtgcgggaacgagatgccttcgaggttgtattccttctggatgtaaggcgcggtgaggtcagcgaccttcagcacgatggcgaagatgacccaggtgaagatgacggcgaaccagaagttgctggtgacggcatagaccagcgctccgacttgcaggaagatccagtagttgaagatgtcgacgtcgatggtcttggtgagcttgcagaacaccatgatggcgttgatgacgaggaagccgacgaccgtggcgaccatgatcggcgtgccccagccgaccgtcgaggcggtgggccagcccacgtcaaccgtagtcaggtgcaggccgaggcggttgaccatcgccttcgaggcggggccgaggttgtcaagcagcaggttgatgaccatattgacgccgacgaagccgacgccgacggtcatgccggccttaaaggatttgccgattcccatgcggaagatgagtccgaccacgaagaagatgatcggcatcatcaccgaggcgcccaggccgatgatggtgttgatgatttccataatgttcctttcccgtgcacgaggcaggctgcttcgcccgctgctctgcgttgttgccccgcactttccgtcggcgtcggtcttcgatgagccctgcgcgtcgacagcctctagctaacggcggaaaggtcttgcacaccacccacgcgatgaacacatgttcatcgaacacatgagagctgagtgagcacatgtaatcgaccttcttttttgcaatcgattgagagcgctcacatatcaaggattcattgagttctttcgcgctctgaacaattgttcagcatcgttgctgcactggaaaaactaacatatgttcaccggccacaccggatggaatagaataatgccatggttgcaaacaagctgacaatgacgacaactgagtcgcgaaaccacatcgagctcgtgctgaaaatcgctcgcatgtattacacggacaatctgacgcaggcgcagattgccgcgcagattggatactcccgccccaccatctcgcggctgctcagcgaatcgcgcgaccggggcatggtacgcatcgagatcgggcatccactcgaacgtctgatgcagctggaggacgcgctggtaagacggtacgggttgaaatgcgcacgagtggcgcaggtcaatcccgggcaggatcccagcaccatcgtcccccgatatgccgcggccctgcttaccgaaaagtcgtcgcccgactcgctcatcaccgtctccaacggacgggccgtcgccgccacggtccgcgaagtcgccatccaggactggccgaaatccaatgtggcgcagatggtgggcgccctctcccccagcaatccgatgacggattcgcccgacatctgccgcatgctcgccgaacgcctcggcggcaccgtcaccacactccacgtaccgatgatcctctcctccgcccatatcgccgcggccatgcgccaggagccacaaatcgccaccgcgctggcgctcggcggcggcgccgacgtggccctggaaggggtcggtgcgaccgaaggcgaccgcctcagtccggtgttcgacgcctatgtcacaccacacatggtcaaggaaatccgggcgcagggcgcggtcgccaccgtatgcgggcacttcatcgacgcgcagggaaggcccgtatgttcggagctgtccgaccgtatcatttcggtggagctcgatcgcctgaagcgcatcgcgctggtcatcggcgtggcatgggggcaggaaaaagtcaaggccatcaaggcctgcctggtcggcagctatatttccgccctcgccaccgaccaagccacagccgaaagcctgctcgcctgacatccatccgatcctgccccgccggcggggcaggatatggcccggcgtagtttgggcgcgacactacggagttgacatggtctgccggcggttttaccctgagagcgtcggtaggcgaggctaccgcagggatatgggttgctgccgctaacagtggagacactgcacgcaggtcagcagttcttgtcggattaaggcatgaactaacgcaactccaccgccctgcgatgctgaagcttgaacgatgacacgaccaggggcaactctcgagaagtcgcacttcctcatgtcgtcaatgtccgacggcgtactggatccattgaggaggtgaatgtcatggacggcgatttaggtcatagtagccggctgcgcgatggcggacaatatcacatgccatcgggcgcagcatacggcccattctcttcacacgtttgtaccgcgaccatggcattggccgtccgtcacgacaccgccgcatccggcgagggcgatccgatcactgactgattcggcccgcatcgacttcaccgcctcacgacgactgcgacatcccgcatgacgtacgcgccgaacgcctgactcgcgaatccacatcccgttctccggactcccggcatatcggcatcatcatatgacgacgccgatcggctatctgtatgcagacatacccgcatatcggcgcgcctgcacgcgaccgccgacgcccatgacgcgcatttgcggcacggataccgagtcgaacgcccaccgaacgggaaccgtttatctccttcgagataacgacatgagagcgcacaggttccgttatgtccaattttttcaattactcctcgttccccggcattcgtccgcgttccggcgccgacaccgccgacatgtcccgcagcggcgccgtgcgccgcatcgccgcagacgtggtggtggccgcgggcgtgctcgctctgttcggcgtcgtcgcctggctgctgccgcaaatcaacgaaccgatcggcccgtcaggtgtgccgagcacggtgagcgacgatttgcatctgctgccgtattacgcgctgcgttcggtgttccgcatgttcatcgcgctgtttttgtcactggtgttcagcttcatctatggtttggcggcggcccgatgccggcgactgcgcatggtgctgataccgctgctcgacatcctgcagtcggtgccgatcctcggcttcctgtccgccacggtcaccatttggatggtgttgttccccggctccattctcggcgtggaggcggcgtcgatcttcgcgatcttcaccagccaggcatggaacatgaccttctccttctaccattcgctgctcagcgaaccgcaggagttggatgaggcggctcgttccatgcagctcacgcgctggcagcgtttctggaagctcgacgtgccgaattcgatgattccgctgctatggaactgcatgatgagcgtcggcggcggctggttcttcctgacggcctcggagatgatctccgtgaacaacaggacgtacgcactgcccggcctcggcagcttcgtggcggtggcgtccgagcacgaacagctgggcaaggtgctgtgggccatcgtgaccatggtcatcgtggtgctgctcatcgacgtgctgctgtggaagccgctgacggcgtgggccgagaagttccgcatcacgcagaacgagtccgtgcaggccaagacgagtttggtgctgtcgattctgcggcgttccggcatttcggatgcgctggctctcgtgggccggcccatcgccgatctgatgttctggctgacccgcccgctgggccgtaccggcgcacgctggccggccgccggcacccggcgtcgcacgctcgacatcgcgttcatggcgctcatggctgtggcctgcctggccggcctgtggatgctggtgcgtttcatctcggacggcgaggggttcgccgaggtcggccacgcgatggtcctgggactgatcacgttcatgcgcgtgacgctgctgaccgtggtgtgctccatcatctgggtgccgatcggcgtgaagatcggcatgaatccgcggatttcccggttcgcgcagccgctggtgcaggtgttggcgagcttcccctcgaacttcacgttcccgttcgtcacactgtggttcatcgcctggcatatcgacatcagctggggcagcattctgctcatgtcgctgggaacgcagtggtacatcctgttcaacgtgattgcgggcgcttcggccattcccgatgacctgcgcgaggccacgcgggcgttccatctggacacgcggcagcggtggaccaagctgatcctgccggcggtgttcggctcatggtgcactggcggcatcaccgcggcgggcggcgcgtggaacgcctccatcgtctccgagatcgtgacctacgggcacaccacgcttacggcaaatggattgggaacatatatcgccaatgcgaccgcggtgggagacaccggcaagaccatcatcggggttgccgtgatgagcgtgttcgtcgtgggcgtcaaccggctgttctggcgtccattgcaggcgtacgccgagcgccgtttctccgtcgcctgacggaggccgcaccggccgtcccggcccatcgacccgcaacaatccaacagcatcggcggcgagcgcatgtcattcgaatccgccgcgatcatccgcaaaaaacgtaacagcaaggaccatttatcatgaccatcgcaactttttccgaccgcaccgcaaccttcccgcagaccgccgcgacgaacgccgccggcaccgcgatcatcgaggcgcggcacgtgggcaagacctaccgtgccgagcgcggtaaagagctgaccgtgctgcgcgacatctccttcaccctgcatgagggcgagatcgtggcgatcctgggccggtccggcgccggaaaatccacgttcctgcgcatcctggcgggcctggtacccgcgtcgagcggtaccgtcacctaccgcggcaccgacatcaccggccctaatcccggagtgggactcgtgttccagaccttcgcgctgatgccgtggctcacggtgcaagcgaatgtggaactggggctggaggcccgcggcgtgccgcgcgaggagcgccgtcgcgctgcactgcaggccatcgacgccatcggactggacggattcgagaacgcgtacccgaaggagctctccggcggcatgcgccagcgcgtgggcatcgcacgggccctggtggtgcagcccgatgcgctgttcatggacgagccgttctccgcattggatgtgctgacggccgagaacctgcgcaacgaggtgctcaagatgtggagcggcaatcagcgttccatcaagtcggtgctcatcgtgacgcacaacatcgaggaggccgtgcagatggcggatcgtgtcgtggtgctcggctcgcatcccggtcatctcatcgccgacgtgcccgtcaccctgccgaggccccgcgaccgtcattccgcccagttcgaggctatggtcgacaccctgtatgcgatcctgaccgggcagagtcgcgatggcgggccggcggataccgccgacgagcgcacggccgccggggacggcgtcgcgcatggcacgtcagatggcgcggcgaaccagaccacggcagcggatcaggccccggcccgggcgagcaacgccgaccatcaggcatcctccgacatgctgcccaacgctacgccgggaggcctggccggactggtggagatcgtatacgatcacgcgcagggcatcgacctggccgatctggccgacgagctgtcattcgaggtggacgacctgttcccgctgatcgacgccggaaccatgctgggattactgaccgtcgagaacggacacgtgacattgaccgagctcggacgccagtggaggcaggcggacattctgacaagcaagacgatgttcgccgccatgctgcaagacaaggcaccgctggtgcgcatcatcgaccgagcggtccgtcacagcgaacacggccgcctgcgcggcgagctcatcgtcgacctgctgagggcccgtcatacggacacggaggcggagcgccagttcaacatcgccatgacgtggggtcgatacggagaactgttcgactacgacgccgatgacgacatcatcaccgtcgacgccgccaacccggcaaacgccacccgaccggccgaggaagccagcgaaacggactgagttgacccgcctcagccaactgccgcaatggaaacaacgatcaacccgacagcggaacggaccgccccgaatcgccaaggaggaatcatgaacacgctacgactgatacgctggcgcggcgaacgccacgccagcatcacccagcgactgtatttcgccgcccatgccacgccagaggccacgctcgccttggtgtatgcgcacgaatccggcttggaacccgacgaggttcgccgggcgcgtcgggcttacggcggcaacaccataccggcgcccgacgtccatgaatcgccggcgcggcggctggtcagggcgttcatgaacccgttcatcggcgttctgatgttgctggcgctcacctcgttcgtgtgttcactggcccagcgcggaatcgtgacttcgggcaccactgcggcgaacggaggcggcacgccggtgaccgtgggcatcatcctgctcatggcggtggtgtccggtctgatccgatacgtgcacgactcccgaagctcgcatgccgccacggcgctggccaccatggtgagtaccacggcgacggtgcggcgggtcggtgccggcgagcggcagattccgtccgaagagcttgtcgtgggcgacatcgtgacgttgtccgccggagacatcgtcccggccgactgcaagctgctggagagccgagacctgcgcatcgcgcagggggcgctcactggcgaaagcatgcccgtgcgcaaggatgctgccgcactgctcgccgccggcgccagggacaccgcgttgacggacgcggcgtgcctggtgttcatgggcacgacggtgatttcgggttccgcgttggcagtcgtcatcgccacaggccgcagcgcactgttcggcggactgtcacgcgcgttccaatggcagcggccgcgcacgcgcttcgagcgcggcatgaactccacgtcctggatgctgatggcgttcacggcggtcaccgtgcccgtgtccatgctggtcaccggcatcgcgagcggcgactggctgcaggccctgctgttcggcgtatccgtggcggtggggctcacgccggagatgctgccgctgatcgtcaccgtctgcctgtcccggggcgcgcggacgatggcctccggcaaggccatcgtcaggcggctcgacgccatcgagacgctgggcggcatggacgtgctgtgcgtcgacaagaccggcacacttaccagcggcgtcatcaagctcgaccgggcgcagagcatgagcgggttgaactcgtcctacgtgctgcatgcggcatggctgaccacactgattccccacacgacgagcaatccgtgggatgacgccatcgtcgcagccgaaggtgactcggcaaacgataccggcgacgtacaggtcgagggaggcacgcctttcgatccgatacgacgccgggcgaccgtcatcgtcgcgaagagccatcaccgcgcggaccgcgagcacacaggtggcagcgatatcagtgagaccagcggcgccggcgccggaacgtccgggaacgtcagccgcatcatggtcgtcaagggcgccgtctccgaaatgctgccccgctgcgacaccgtcatgcgcaatggaaccgcagagccgctgaccgatcgactgcgcggaacatataagcggctgatggccgacaaggcgacgcacggataccgcgtcctgctcgtggcgcagcgctctgtgacagaccagaccacagtgcaggacgaccgcgcgctcaccctgctgggctacctcactttcctggacctgcccaagcccgatgccgccgacacgatcgcccacatgcacaatgccggcatcaccgtgaccatgctcaccggcgacgagccacaagtggcccgtaccgtcgcccggaaagtcggcatcaatgctcgacgggtggtcaccggccgaacgctggacgacatgacggacaccgcgctcggcaccgaactgcgccgcgtgaacgtgttcgccaagctcactcccgagcataaggcgcgtatcgtctcactgctgcgccgcgaggggcattgcgtgggatacatgggcgacggcgtcaacgacctgccggccatgcacgccagcgaaatcgccatcagcgccagcaccggctccgaggccgtccgacagtcggcggatgtcatgctcacgcacaagaacctcgacgtgctgctgcgcggcatcacgcaaagcaggcgcacctgcgtcaacatgatgaagtacatcaagctggcgctgagctcgaatttcggcaatatcatctcggtgatgatcgccggcgcgttcctgccgttcgtgcccatggcacccgtgcagatggtgctgctgaacctcatatacgacctggcctgtctcgcgatcccatgggaccgcgtcgacggcgatgtcctgcgctcccccgcccggtgggacacggcgtctatcgcccggttcatgagtcgcttcgggccggtgagctcgctgttcgatatggtcaccttcaccgtgttgctcaccctgctctgcccggccgtcgcaggcgggaggttcccggagctgcacggggatgggtcgcgtctgctgttcgtcgccgcgttccagacgggatggttcgtcgtgtcgatgtggacccagatcacggcactgcacatgctgcgcaccgaacgcgtcccgttcatcgggagccgcgcgtcggtgccgctggtctgcacgtcgctcgcggcgctgactatcgccacggcgctgccgttcacgccggtcggcgcatggatgggtttccacgtacctccggtgtcgctgttcgcgctgctcgccatcgtcatcgccggttatgccgtgacagtacttgccgtcagaaccctgtatctgcaccgtcagcagccgctgctgtgacttctgaccgcccggcgctcctgcggaaccgatggaatccgcaggagcgccgggcgggcacccccgcgttatcatcctctccccgtaccaccaccgtctcccgcatccattcaaacgaaggaactgatcatgacagtctggaccgcaatcgtcacatcacaggtgttcgccataaccctgcgcatcctgctcagcatcgggctcggtgcgctcatcggattggaacggcagctgcgcgcacgcagcgcgggcatccgcacgaacgcgctggtgtcgttgggttcctgcctgttcaccactgttggcgtctatacgctcgcggccggcaccggagaccccacgcgcgtggccgcgcaggtggcgtccggcatcggcttcctcggcgcgggcgtaatcctcaagcagggtgtgtccgtgtccgggctcaacaccgcggccacgctatgggcatcggcggcggtcggcacgttgtgcggctccggcatggaagcggccgccgcaatcggggccaccgccatcatgctcgccaacatgatgctccggccgatcggcgcggccatcgacgcccggcgcaccgcgcaatcgcatgaggccgagggcatccgttacacccttgaggtcaaatgcctgcgtaaggacgagcaggccatccgcgcgctggtgttcaacgccctgcatcagcccggtttcatcgtccagtccatcgcggcttcggatcttcccgatgatctggtggtcatcaccaccgtcgtcgccacccacatgagcagcaacatcgacatcgaaagcagcatcgaaacagtcatcaccacgcccgaggtcctcggcgtcaaatgggatgccgagcaaatcaccgccgtggattaaacgtgaccgtcatgaatccgcgtcatgaatctgcccgccgcgaatgatcagccgcgtggctcgccagtgggaaagcccgcctgcgttggtcggaatactcgtgaagtaggtcacgttgtccaccttgacgctctggtcggcggcacggacccagctgccgttagcggagcccttctcgaagacgacggcgttgccgccgctgtcgctgacagagaacagggcgccgccgatgccgttgtgctgcttgtcgatcttcttcatggtgaagaatcccagcttgacgaccgtggtggcggcctcggaatcggcgccgccattgtaattggcggtcgcggagttcgtcacctgatcgtcgacggcggctttggcgacgacggcgttgtacagcaggacgagcttctgcccatccttgccggccacggcgatggcctcgcgaatgttgccgtcccacttgtcgctgtccacggccttcaggccaaaggaagtcagcttgcccgtcggcattcgcgaccgggtcgatgtacgcggcgatacgatatgccgtatacgtgcttttcgatgtatcggcatcatcggccttgttcagggtaatggttgacggcgtggccgtttcgggcactgtgagcgtatcggtatcggcattgaccgtcatggtccccaaggccatgccgcccaaggcagccgcaaccgccgcgacgccggcgatgagtttcttgaattgcataggaaccttcctgctccttcatcggctatttgaatccccggcatgacgagaatgagtcatggaccggcgattcctgtgttcctgtcatagcggacgagtccgccatgttgtggagcctgtatccttcaccacaaattcgctcgcgggcttctggccccggcgtctaccgcaatgtgaacgtacccatcaccttgtccggggcgtattcggcgaagtcgtcgctggccgccgcaatatggctttctccgcgccaatcggtcaacgaccagctgtcccagctcatggtggcgccggcaatcccgccgtcgtccccgccgatatcgacggggaccggaaccacgatggattgcccttcggcgagcgcgatgtcgtccatgattccgctgatgcgtccgagcgtcgtcttgcccttcttgagatcgaacgtcaggttcagcccgctgagcgtgccgggcacgtggctgcgcacggccacggcgatgatgcgctttccggtgtccacggtcgacccgccggcatccgccccctgctggatgccccggtcctcgatgcccgtgatctccagcggcgcggacggcgcctcggcggcgggcagcccgagcttgccgcgcaggtagacatccgcttcgctgacgccgtaggcatcgagcgagatcagctcgtcgctggcggacggcgtgaccgagtcggcgacatacgaggcctgccgggccttggcgtcgtattcgttggcgacgacggccgccgcattggcgacctcatcgggccaggtgcgtgaccgcagcgccttggcggtggcgcgcagcacggtggcggcctttcccgcggcggccctcgtggccttcagatcaccgccgtacaaggtgttcatcgcgtcgcgcaacggctggatcgacggcttgacggcttccagatagtactgccccgcgtccttctcgctgagcctggcccccttggcgggatgctccgaggtgtcggacgtgttgacaaacggcgcgtcgccgtccagggcgtatttggcgtcctgcgggcacaccacgcccgtgatcgcggtcacgatgccgcccggatcgccgccgaacatatacccgacacccagcgacgcgcctatggcgacgcccatcgccacgacgatgcccaccgccttgcgcaccgggtggtaagtcatacgccggagttcggcgtcggcttcgacgacggcctgctcatgggtgagcggcatatcgtcgtcatcgatgccgtccgcatcggaaccgtgccgactgtcgtgtaaccttgccatgcataacctcgctagttgtacagtgaactggagatgctgatcaggtcaccatcgcccagcccttcccatgtcgcgctgttggcgaactcgaattccaggttgaagctctgccggttcggcgccaacatcgtgccgtaccggccaccgatacgccaatgccgttcctgggtggagtcgagatagcctccccactggtcggcctcggtgtacagcacggtcgtgtcgtagagcaccgcccggaacctgacggtcagccggttccgggacaggtcgaccttgccggtctgtatatagtcacggtcgaaatcgtctatggtaatcccgtgttgctcgcgcaggtcggacgccgcggcctggtcctcatcggacatgtacgaatcgtcccggccactctcgttgtcgtcgaccgttatctcgtacgcggtcacgtcgccgtatcgcttcacgaagtcgccccagctgtcgcccggctggacgccgcgggacgtgaccagcgcatgatcgcaatccctcttgtcgatacggcaccgtgcgccgcgcttgacgccgctgctggtggcgtcgtcgctgagaatcgtgtactggctggggtaatgccatgtgcgcgccgagctgatcggcttgcctgtggacggctgtcgcagcgaatattcactgaccggcaggtagccgatcggcgggttgtcatggaatatcagcagcgtggttttgtcgcggatctggagcccgaagaagatcaacgccaccacggccgcgatggccgcgaacacgacggccaccgtgcgatgcgattcgcggtcgatcgcggcgaactcgtgctccagatggcgcatcgcctccgcgtcgccttcgccggccgaagatgcggtggagtccttgggcttccccgcattgccggatttcccgaagccgcctggtttggcggggtccttgcgtttctcggcgttcccgccgaaccggccggacttgctgaagatgtcatcgtcgccgtcgaaatcatgttctgacattgccgtcacctgaccttgaacgcgttcagcacgtcatagccgcctgattggaccgcagtgaacgatgcgaggtgctgctcccccgccttgtcctccacataccatgccgacggcacgaaacggtcgccgccgcgcagcagtttcgggtcgatttccatggtgagcttcaccgtgtcccccttatggatgccgccgtgctcgatgatgtcgccatcgtcatcgaactggatgtcggagctggccctcacgccggtctcgcggatggtgccgtcttcgctcagaagattgaatttgatggacagccccgttatctcggccgggacctggtcggtcacggtgacggtgaaacagtgccggtcgacttcctgctgaccgccgtccttggcggtctccagtcccttgcaggctccgccgtcggcaatgtcccgtatgtcgaacgggacggccgtctccggctcgtcgggcagtttcagcgcgctgcggattacctgctgcgctccggatggcctgaattcgccgaacaccatccagtcgatcgcctcgccgttgcggttgccggcgaggttggtatagatcgccgcgcgctcctgatattcgatgatgaccatgcggatctgcttggtcagtgatttcggccaggtgcgggcggcgagggtctccgccgcctgttgcgagaggtcacgggccttggcggcggacttgttcaccgcatccttgtcgccgccgaccgcggcgaggcgcacggcgtcgtatgccgcggccgtgcctttcaccgcctttgcgaaatacgggccggcctgggatcggcccagctgagggccggacggctgcaacggcttgaacccgccataacagtagtccttctcgtccgcgactccggtctggtgcgaacagttgacaggggagccggtctggaggctgcgccgccagcagaatccactcaccagcgatgcgacgatgaccacgacgaccagcagcgtcatccggcggtgccgtttgcgcagcagtgtgacggcctcggcatcgacctcggcggattcggcgtcgtcggtgatgtcgtcggtgatgccgtgaatgtcctcggaggcatcgctcacatcgcgggtctcatcggcgaccggcgtatcccaactcttctgcgccttcatcaccaccatctcccattgcccgaatcccaatccgacataatcgacgccatcttatcagccacaacacaaccccgctaggccaatcccacgatgttaagcccggggactgtcgagcgaagcgagactggggggggtcaatcacagatatcccgacaccccaaatacaaggtcctcatgaaaatgtatcgattaccccaaagagtgcgcatgaaaatgcaaggaacactgcaatgaagcggtttcccacggctgatctcattgacccggaacaccaccccagttcacaggtcatagatataacgtcgcacggaatatatagcaatgtgccccagcatccgaagatgccggggcacatgcgtatcagagttcagctgctagagccgaaccgacgaatcagaactcgcgccatggacggtcgccagaccgaccatcaaacaacacagcgcggcgcgccaaccgcgagttctgattgaagcgacgcaggagcggagatcagaactcgcggttggcgcggtagaacttgatcagggactgggtggaggcgtcctgggcggcgagggcgtcgtcgtcctgggagatggccggggtgatctgcttggcgagctgcttgccgagctcgacgccccactggtcgtaggagtcgaggccccacacggtaccctcaacgaaggtgatgtgctcgtacagggcgatgagctcgccaagcgcgaacggggtcagagccacaccgaagatcgaggtggtcgggcggttgccggagaacacgcgggccggaacgatctcttccggggtgccttcggcgcggacctcgtcagcggtcttgccgaatgccagcgccttggtctgcgcgaggtagttgccgaggaacagctcgtgcacgtcctggtcgccgtccttggtcgggttcggggtgttgacgaacgcgatgaagtcggccgggatgagctgggtgccctgatggatcagctggtagaaggcgtgctggccgttggtgccgggctcgccccagaagatttcgccggtctcggaggtgacgggggtgccgtcccagcgcacggacttgccgttggattccatggtcagctgctgcaggtaggccgggaagcggtgcaggtactggtcgtacggcagcacggcgtgggaggcgaccttgaagaagttgcggtaccacacgttcagcatgccgagcagcacgacgacgttcttctcgaacggggtgttggcgaagtattcgtcgatctcgtggaagccgtgcaggaactcctcgaagcgggcaggtccgaagaccacggccagggaggtgccgacggcggagtcgacggagtaacggccgccgacccagttccagaagccgaaggcgttgttcgggtcgatgccgaactcggcgaccttctccaggttggtggagacggcgacgaagtgcttcttgatggcttcggcgttcttctcgtcggaaccgtcgatggcacccttggccttgagctcctcgagcagccaggtgcgggcctcacgggcgttggtcagggtctccagcgtggtgaaggtcttggagacgatgatgaacagggtggtctccgggtcgaggcccttggtcttctcggccaggtcgttcgggtcgatgttggagatgtaacgggcggagatgccggcgtccgcgtagggcttgagcgcctcgtacaccatgacggggcccaggtcggagccgccgatgccgatgttgacgacggtctcgatcttcttgccggtcacgccggcccacttaccggaacgcacttcgtcggcgaaggcgtagatgcggtcaagcacctcgcgcacgtccttgacagtgtcctgaccgtcgacgatgtacttgccctcgtcctcgaccgggcggcgcagcgcggtgtgcagcacggcgcggtcctcggtgttgttgatgtgcacgccggcgtacatcgccttggtgcgctcgtcgagcttgacggccttggcgaggtcggcgaacagctggagggtctccggcttgatcaggttcttggacaggtcgaagtgcaggtcgccggcgtcgaacgacagcttgtcgacgcgctcggcgtcatcggcgaaccactgcttgaggctgacgccctcggcctgcagctcgtcatagtgcttctgcagcgcggcccactcgggggtcttggtggcgtcaactggcggattgatggccatggtattggtcctttcatcatcactgtacgccggagtcggctctccaatgctggcgggccacaccggttacttcgcttaccaagatactcacaaaagcggacagaaacaaacaaaaatacccaagatgaacaaccgtgaccgacacgacatgcccgcgcacgacatgccagccgaacttgcataaatccacggcatacagtaaagtctcattcttgtgcgcaggttcatcaacgaatcggcagcatgccactttagctcagtcggtagagcggctcactcgtaatgagcaggtcgacagttcgattctgtcaagtggctccatacccctaggctccgcgcctagggttttgtatatccagccgtttcgacgggtggcacgcgcgagtggcgaaatcggtagacgcgcaggatttaggttcctgtgtctttgacgtgagggttcaagtcccttctcgcgcacgcggaaccatacctccgcaatcgccacagggaatagagaagcatgaccgcgatactgaaacccatagcgtttctgctcatcatcgtcgccgcgtatctggtcaagcgggcgggactgttcaagccacgcgactatcgcgtcatgcaggtggtggtgttcgatttcacgcttcccgcctccatcatcgtctcgttcgccacgaacccgcatcatctgagcatgctgctgatctcggtgttcgccatcgtcttcggcctgctgccgctgctgctggtgtatgcggcgacccggcacaagcccgtcgcggaccgcgcgttcctgatgctcaactgctccggattcaacatcggcaatttctgcttccccgtaatccagacgttcatggggccttcggcgctggtcaccgcctcgatgttcgacatcggcaattccgtgatcgtgaccgccggctcaaacgtgatgacgacgtcgctgctgcacatcgacatggaccggccgctcaccgaacagcatgcgggagccgcgccgacacttccctattcgaagccacgggacaaagacgcccgcaggctcgcccgccgcgcgaaggccaagcagatcctcaagggattccttacttcggtgccgttcaatatgtatctgctgatgatcgtggtcatgctcttcagcattcacatcccggcgttcgtgccgacgctgctgcagccggtggcggacgcgaactcgttctgctcggtgttcatggtgggcatgctgatggatttgccgcgcaccggcaaggatgtcggcagcgtgctgcgggtgctcggttggcgcttgccgctcggcgtgctgttcgcggccgcttgctggttccttctgccgttcgacgcgtccgcgcgaaagacggcggtgatgctgtcgctcgcgcccacggccgtgttctcgacactgttcaccgaccgcgtactcggtaacgcgaagctcgccgggttcacgctgtccgtcaccgcggtcatctcaatcgcgctgatgaccatcgtgaatttcgtgattcccgcgtgagtgccgaacatgcgctctcaaaactcgcagatacgatttcaccgatttcgcggaaacagcggaaaatagcggaaaaccgcaaaaacccgtttttgtatctgcgagttttgagagcgtgattctaccgcaacagcgcctcgaccgccggcacgagagccctgatggctttgccgcggtgcgaaatcgcgttcttttctgccgcgtccatctccgcgctggtcagcggatggtccgcagcggcccgctccggctggtcgtccggcacgaacagcgggtcgtagccgaaaccatgctcgccgcgcgccgcgcgcaggatgcgccccggcatttcgccgatttcgacggtttcggagacgatggcgtgcctcccgcccgccacaggggccgcggaatccggcacggccagtgcggcggcgcagcggaaacgggccgtgcgcgccgcgtccgggatgtcggagagctgggcgagtagcaacgcgttgttcgccggatcattgccatgctcccccgcccagcgcgcggacaggatgccaggcgcgttgcccatcacgtccacaatcagtccggagtcgtcggcgatggccggcaggccggtgagaccggccacaaaccgcgctttgagcagtgcgttctcctggaaggtgacgcccgtctcgaccgggtcgggcaggcctaggctgccggcggagacaagctccacctgagcggagtccgcgcccagatcctcttcgagaatgcggtggatttcaacgagtttgccttcgttgtgcgtagcgacgacgagtttcatgggggtcctttattccttacctatggttgtgcatgacggggtgaggccgatcgcccgccggcggcgtgcccgactcgtttcaatcgagcgagagggcggcacgctgggcggcctgaagctccttgttgcccttttcggcgaggtcgagcaatgtgttgagttcggcgcggttgaacgggcggtgttcggcggtgccctggatctcgatgaagtcaccggatccggtcatcgccacgttcatgtcggtcatcgcctgactgtcctcgatgtagggcaggtcaagcatcggcgtgccgttgataacgccgaccgacaccgcggaaacggcgtctttgagcacgcggtcggccgaacgaatgtggcgcttctgctcagcccagcgcatcgcgtcgaccagcgccacatacgcgccggtgatcgaggcggtgcgggtgccgccatcggcctgcagcacatcgcagtcgatctggatctggttctcgccaagcgccttcatgtcgacgacgccgcgcaggcagcggccgatcagacggctgatctcatgggtgcggccgccgaccttgccgcgcactgactcgcggtcggtgcgctcggcggtggctcgcggcagcatcgaatattcggcggtcacccagccgagtccggaatccttgcgccagcgcggcaccgacggtgtgaacgtcgccgtgcacatcacgcgcgtgttgccgcattcgatgagtaccgatccttcgggcacgtccgtgaagtgccgcgtgatgcgcaccgggcgcagttcgtccactacgcggccgtccgcgcgaatcaccattgccttgtccaacatgtctttgatttcagccatgccttcaacgtagcaccatgcggcgaacgtgcccgcagcgcggcacgtctcccgccgccgctgcggcagccatcgtgaccgccgtcacgccgaatggctcttgcgcgagtcgccgcgcgacactagggttttggataacacacgattcttgtcttgcgggagggcggtcatggtcgattattcaccggcactgatgacggatatgtatgagtacacgatgctggacgccagcctgaaggatggcacggcgaaccgcaaatgcgtgttcgaggtgtatacgcgccacctgcccgaaggccgccgttacggtgtcgtggcgggcatcggccgcattctggatgagctgggtcggttcctcctcagcgacgaggacctgcgtttcctgtccgaccgcaaggtggttagcaaggagacgatttcgtggctggagaacctgcatttctccggttcgatcaagggttaccgcgagggcgagatgttcttcccgaattcgccgattctgcaggtcgagggcacgttcggcgagtgcacgctgctggagacgctggtgctgagcgtgctgaactatgattcggcggtcgcatccgccgcctcgcgcatggtgagtgccgcgaaggaccgcccctgcatggacatgggcgggcgccgcaccaacgagtgggccgcggtggcagccgcacgagccgcagtcatcggcggtttccagggcacagcgaacctgcttgcggcgcagctgtatggactgaaggccatcggcaccgccgcgcactgcttcacgctcgtacatgatgacgagcgcagcgccttcgcctcgcaggtcgaggcgcttggccgcaacaccacgcttctggtggacacgtacaacgtcgaagaggcggtgaagaccgccgtggaggtcgcaggtcctcagctgggcggcgtgcgcatcgattcgggtgatctggccgccatggcgcagcgcgtgcgcaaccagctggacgccctgggcgcgacgaacacgaagatcaccgtcaccaacgatctggacgagtacgcgctggccgccctgcagagcgcgccggtggactcgtacggcgtgggcacgatgctggtcaccggctccggtgccccgacctgcgcgatggtgtacaagctcaccgagcgcgagaattcggctggcgtgatgcagcccgtggcgaagaagtcgaaggacaaggccagtgttcccggccgcaagctcgcctaccgttcatatgagtatggtctggccgagacggaacatgtgatctccggatcggaaacccagctggccgagtatcgtccggctgagggatggaaggacctgctggtcgactacgtcgaccacggtgacatcgattcacgttatcagggtcacgccgccatcgccgacgcgcacgaataccgggccaaggccctgcgcgaactgccgatcaccgcgcaaagcctgatgaaaggcgagccggtaatccccaccgaaatcaccgtgctgtaatccttctggccctgcgagctcgatgtcaagcccggtcagcacctcgaccatcacggccaccaccttgctgacgctgatgtgtgtggatgccagcatgtcgaagaaccagtcggaatacgcccatgtcctcggcagcgcatggctcttcttctcttccggaccgcaccgcgtggcccattcgcggcggaccagcatgtccatctgctcgcgctcgaaccgcttgccctccgccttgtcggcgaacagcggcagcggcgacttgtagtactggcgtccgtcgctgtacgagttctcgcgctgcttctgcatcatcttctgcttcatgctctccaacctgtcgttggagaccttcaggccctcgcgaagatgccgcgcctcgtcctgcagctgggtgaggtactggaacacctcgtcggcggcggactcgtcgatatggccgtcgtcgtcggtgataaattcgacgagctcctgcatcgagtcgaattgcgtgcgcgtcatggcggcgccttccggcagggctgccgacagcccccccccacgccgctttcggggtgacgaggtcgaatacggcggcgacatcatgcagattcgaggcgaggctgttcgcgtcgaacaggggcttgccgaagcgacgggtcaccactaccgcgggatgctggcggtcgggggacgtcaggtattcggatagggcttcggcctcgtcggcatcgctgatggcaatcgcagtgcccgtcatcgtatcgtaaggttccagtggctcatattgcgatgaattggattgcgctgtcatggcgaacggtgatgtgccggtctgtatcgaacctgattgtgcggaaccagactgtgcgatggcatcgatcccctgcaacgcttccccgccattatttcatatttcgcacggcatgttccacaatgtccgctttcgcgatagacgccgtttcttcaagattccggggaatccgcgcgatgtgctacaccgatgggcatcaccgcaaaaacaaaaaccgggcgggaaagaacccgcccggcaatgtcatgctcggccacgccgataccgcatcagcggcccttaatctcggagccgatgaccttttcgctcagcgccttcggaccgcgcgtcacggcgaccgcgccggaacgcaccagctcgatcacgccgtagtgctccaacagacccagcagcgcgtcgatcttgccttcggcgccggtggcctcgatggtcagcgactccgggttcacatcgacaacacgcacacggaacaggcgcacgatctccagcacgtcagaacggttcgactcgttcgccgccaccttgatgagcaccagttcacgctccacagtggtgttcggatcgagttcgacgatcttgagcacgtgcagcagcttgttgagctgcttgatgatctgctccagcggcacggcctccacgtcggcggtcacggtgacgcgggaaatgtccggacgctcggtcggcgagacggacagcgagttgatgttgaacgcacgacgggcgaacagaccggcgatgcgggccagcacgccgggacggttctcgacgagcaccgacagcgtgtgacgctcggaaccgaggcgggaagcgggatacatagccataatcacttactccttattccttgacaaccgtgccgtcacgcctggtcaccatcgtcgacgcccttgtgcagcagcggctgcgtgcccggacgatacgcgacctcgttgttggacgcgccggctgccaccatcggccacaccatggcgtccttccatacacggaagtcgatcagcaccggacggtcgttgatctcgttcgccttgttgatcgcgtcaatcgcctcgtcctcggtgaacgcgcgaaggccgacgcagccgtacgcctcggcgagcttgacgaaatcaggcacgtcgaagaactctccgccttccttcgaatcgccgtcagccaggttggtctgggagtagtgctgtccgaagaacagagtctgccactggcgcaccatgccgtacacggagttgttgatgatggcgatcttcaccggcgcatgatccaggaacgcggtcgtcagctcttcggaagtcatctggaacgagccgtcgcccgcgatcagccacaccggcttgcgccccttgaagtcgcgctgggagccgaccgaagcgccgatggcggccggaaggccgaagcccatcgtgccgaggccgccggaggagatccacgaatgcggcttctcgaaatcaatcagctgggccgaccacatctggtgctgaccgacgtcggacacccagatcgtggaggggtcggcatggtcggacagctgcttgatgacccactgcggcgcgagcgaaccatcggtcggcttatcgcacggctgatcgtaatcgatggcatattcctcgcgcaggcggttgagctcgtcccaccacggcttgaggttcggcttgccgccgatggcctgagaacgcttgatttcgggaatcaggtcgttgagcacggtggacacgtcgccgacgatcggcacgtcgggagcgcggttcttgccgatttcggccggatcgatgtcgatgtggatcacccgcgcgccgggtgcgaacgcgtcgagcttgccggtcacacggtcgtcaaagcgcgcgccgatggcgaccagcaggtcgcagcgctgcgcggccgcggtggcggcgacggcgccgtgcatgccgagcattccaagcgccttggggttcgagttcggcacgatgccgcgggccgggagcgtggtgacgatcggcgcgccggtcacttcggccagctcggccacttcggcggacgcgttggaacgcaccgcgccaccgcccacgtacagcacgggacggtacgactgcgcgaacagcttcgccgcatccgagatcacgcggccgtgcgccttcgtggtggggttgtaaccgggcagaatcatgcgctgcggccacgaataatacatctcgccggtctgcgcggtcttggtcaggtccacgaccaccgggccggggcggcccgaacgggcgatatagtgcgcctcggcgagcacgcgggggatatcctgtgcgcgggtcaccagatacgagtgcttgacgaccggataggtcgccccaacgatgtccgcctcctggaaggcgtcggtgccgatggcgttcacgcccacctgaccggtgatcacgacgagcggcacggaatccatgttcgcgtcggcgattggggtgatcatgttcgtcgcgcccgggccggacgtgacgatgcacacgcccacgcggcctgtcgccaccgcatagccttcggcggcatggccggcggcctgctcgtggcgcacgagcgtgaaccggaacttcgtatcgtcgttgatcgcgtggaacaccggcaggatggcgccgccgggcaggccgaacacgtcctgcacgcccaaatcctccagcgcgcgaatcaacgcctgcgcgccggtcattttctcaccgtcgatgatcgtctgcttgtctgcggatgcggtgtttttcggaacgccgctgaacgcctgcaatggtgtgggtagagccatcatgtcctctcaactcaaatcgttcggtcatatgcctggacccgtcgcgcctcgcgagcgttcatgacttgcgtgcgccgacggtcacgatgcgcgttcgcttgtggctatggcgtctgtgattcgtattttctcagtttaagcatacaggtgacagcatcgcgcaatcgccgttcaccagttggtcagttgccggccgagccgctgcgccggtgcttggacgagccgttcttgcgggccgccttgagcgcgggcgcgtaccggtcgagctcatgccaggccatttccgccgcggcgagctgcgccttgcgcttgctggtgccggtacccttgccgatgatgtcgtctttcgggccgatggtggccttggcggtgaattcctgcgcgtattcggggccggacacgctcatgcggtaccgcggctcatccaggccgagctcgtgcgccttcacggtcagcgaggtcttccagtccagggctggtccttcggtggccacttccgccaacgtgtcgtcgatgagccggtgcacgaccttgcgcgcgccttcgatgccgtgctccaggaacgtggcgccgatcagcgattcgacgatgtcgcacagaatggagcttttctcggcaccgccggactccgcctcgccgtgcccgagcaggatgaacgggccgacgtgcaacttgtcccgggcgatcgccgacagggcctcctccgaaacggccttggcgcgcatcttcgccagctggccttcggtcatgtcgggatgcagcgtgaacagcgtctcggtcgataccagttccagcacggcgtcgccgaggaattccagccgctcatagttcgatgtgccggggtgttcgtgcgagaacgaacgatgggtgagcgcctgtatcagcagatccgggctgatggtgacgcccagcgcggagaacagctcttcgcgcggttcaggttcagtcatgtttttctccttgtccaccgtatccggccgcacgcgcacgccctgaacgcatacgcgcagtgtccggatggcaatgcgacaatatacgaagaccctgccacccgtcgatggcagggtcttcatttcgctatcggcattcggctgcgatcacttggtgtgagcggagcgaatggctgcgcggtacacgcggccgcggtaggagccgcagctcgggcaagccatgtgcggcagcgccggagcgccgcagttcgggcatgcgatggtctgggcggcggtagccttccagttcgcgcgacgcgagtgcgtgttggcgcgcgaggtcttgtacttaggcagtgccatttgttattcctctgtttcgttcgaacaattgagcttaagcgtacggtatcttaacgcatcgcccgtacaacggcatgtcgcggcgtcgcgcgagcaggttcccagacccgcacgccgatcgcccaccgttacttgtcgccgtgctcctcggcctccagctgggccttcaacccggccagagccgcgaaccgcagatcggtcacgtcatgatgatggtccgggtgctcgttgaggtcgacgccgcactgcgagcacagtccccggcagtcctcgcggcacaggggctgcaatggcagcgcctccaccagcgtgtcacgcagcagcgcctccaggtcggcgaacgccccgtctcggctcagcggatacacgtcctcggactcgtcctcccccgcgacgatctccacgtcctcgttcttgggcttgccgtgcgagcgggccttcgcgctctcctcgtaggggaagaacgcgacgacgtccacaccccaatcgcgcttgatgggcttgaggcagcgtgtgcactcggccgcgacgggcgcttcgatgcgagcggtcagcaccaggccgtcgactatcgagtcgaacgagccgtgcacgctgacgtccgcgccctccttcacgccgatgacctcatcgccgatgccgctcggcgcgggaaacaccgcgtccaccgtcttggactgccccggccgcgacgccacctgcgccacgctgaccgcccatgcggaatcctccggtcgtgccatgcaaatctcctccctgctgctgccgcgcatgctgttgcgcgttccgttacactccggcgcgcccctactgcgcttccggataatcgttgatgttcaggtgcggcatctgctcgcccgccgcgcgctgccgttcctcaagcacgttgagtcctgcctgcacgtcgtgactgagcttgccgagctgctcctgcaggccggtcatcaccgtcgtgcagtactcgtcggcgccattggtcagatggtcggcacgcgcctgcgccttgtcgagaatcgcacgcgcacgctgccgcgccttgtcggtgatgttctcctggccgacgaggatctgcgcctgcttgttggcctcgtccaacgtgtcggcggcacggctctgcgccgacgcgatgatggcgttcgcctgcgtctgcgcggattccaagcgccgctcggcctcgcgcatcagcgcggacgcgcgctccagctgcaccgggagcatccgcttgagctcgtccagctgaccggcgaactcctcgcggtccacacgcaccatgctgggcgcgaacaggctggtcttcgcggcctccagcgtcgcctccatcgagtcgatgatgtcatagacggtggtgaactcctcgcgggacttcacctcctcggggttcatgtcggccttcggatccagcgtctcgcgcaaatcggggagctgactgatcgggaacgtcggcttggactgcttcgcgtaatcggatatgtccggcttgttctcgtgcgtcgcagcggcggccggctgcggattgtgcgacatttcgtcccacacgctggcaggtgccgcgctttccggcgcatcgttcagccgcgccgcggccgcatacgtgacgctgtaggcgtcggtcgactgcgcggccggctcggtgccggtcgcgggattcatggcggcgccgccgtcgttgccgtcaccgacgttgacgatgccatcgttcgttgattcatccatgctgcatctctttacttttattccggtcacgtatcagcgaccggaaaacccagacaatatcatatgggattcgcgtcgcgacgtcactcgccacgctcatggttcaacgcctcgtccagcatcggcaccacgccatcaggcaccatgccggtcacgtcgccgccatgccgggcgacgtccttgacgatggagctggaaatatgctcaagcaccgggtcggccggcaggaacagcgtctccacctctgcgagcttgcgattgaccagggccatgcccagctccgcctcgtaatcgccgttctgccgcaggcccttgacgatgacggtggcaccgatctccttgcagtagtcggtgatcaggccggtcgtggacgcgaccttgacatcggggaatccgtcgtggtcgagcgcctgacgaatgatatccactcgcgtatgcgccgggaacatcggggtcttcgcggcgttcacggccacgaccacgtgcacttcgtcaaaaaaacgggcgcaccgctcaatgacatccaaatgtcccgcggtcacggggtcatacgatcctgggcatactgcgatagtcatatgcatagcctaccgcgaatcgccggacagtccgtatacgagcgagccggggctcagacgccggacatgcagcggtagcatgcgggcattatcatgaatctatgccggtggaagacaggccggccattcgccgctatgatgtcgtcatggatgaaggaatggagtcgaaatgtcatctgaaccgtcaacacagctgaagccgacatccgccgtcgcaggagggatcgccgcggatctcgcggatccggtgtcgccgctgtccaccccggaccagggcacggggacggcggtgctggagcgtccggaaaccgaggagcagaccgaccgttccgacaatggcgacgccgaccggttcgcgcactatgtgtcgcgcgatcgcatcgccgaatcgaagctcaccggccggcccgtggtcgcgctgtgcggcaagatctgggtgccgaagcacgacccgtcgcaataccccgtctgcccggactgcaagcgcatctatgaagagatgatgaagtaaggtcgcgcaccgcgcggcgattactccagtttttcggacaattccatccattcggtctccaaggcgccggactcgtcggagacggcctgaagctgcccgttgagcttgttcagcccctcatagtcgctcggatcatgggcggccatatccgcttcgagcgcggtcttctgctcctccagctttgcgagcttgcgctcgatggcggagatgcgcttgctggtctcgcggaattccttgccgctgagcttgggggcgtcgtccgccgtggcagtgacgccggagtcggccggctccttctgcgaagccgatacacctgccggcgctgcggtcttcgctttttcgatcatgtcgagataatcgtcgacgccaccgggcagatgccgcaccttaccgccgatcagtgcgaactgctggtcggtgacgcgctccagcaggtaccggtcgtggctgacgacgatcagcgtgcccggccacgtgtcgagcagatcctccatgacggcgagcatatcggtgtcgaggtcgttgccgggctcgtccatgatgagcacgttcggctcatccagcaggatcagcagcagctgcatgcggcgcttctgtccgcccgacaggtcgcggatcggcgtcatcagctgcgcggattcaaagccgagccgttccatcagctgaccgggcgtgacttccttgccgtcgacgatatagctgggcttgtagcgggacagtacttccttgatcttgtatttgccgagtttctccagctcgtcgagccgctgcgaaagcaccgcgaacttcacggtcttgccgatgttgacatgcccggctgtcggcgtgagcgtgccgtcgatgagcttgagcaacgtggatttgccggcgccgttcgcgccgacgatgccgaaacggtcaccggggccgatcagccaggtcacgtcgtcgagaatcttgcgaccggcgacggtgatcttctgcgccgcggaggtgacctgcggcgcgaccgactcctccgtgacacccttacgttccgcgagcgcctccgccttcgccttggcttccgctgcggcctggatggattccggcacgccggcgtccacgagacgcgggtcggcgagcgtgtcgacggcgacttcgacggaaccggtcacgcgcggctccgagtatagggaggggacgatatcgatctgagaggaggaggcgggggcctgatccgccgccgtgtcgtcggtcggcgtgaccggctgctcgccttggcttttcgcgaagatctgcgtgacgtcgatcaggtcgacgacctgcttgcccaggcgcgacgtggccatctgcttgagttcgacggcgttgcgcatgggcggcacgtcggcgatgagctcccgcgcggccttgacatggaacttctgcttggtggagcgggcgcgggcgccgcgcgacagccaggcgagctccttgcgcgcgaggttgcggcgctttgtctctcgcacatcggcctgtcggtcgcgctccacgcgctgcagcatgtatgcggagtagccgccttcgaacgggtcgattacgccgtcgtggacctcccacatcgactcgcacacctcgtcgaggaaccagcggtcgtgggtgacgagcagcagcgccccctgccctttcgaccagcggttcttgagatgttcggcaagccagtggatcgtcacgacgtccagatggttggtgggctcgtcgagcgcgaggatgtcccaatccttgagcagcagccgggccaggtcggcgcggcgtcgctggcctccggacagcgagccgacgcgggcgttgaggttgatgccgcccagcagcgcctcgacgatctcgcgcgacttgttgtcggcggcccactcgtaatcctcgcggccttccagcgcggccgcgcgcacggtggcgtcgtcgtccagcgggtcgcgctggtcgagcatgccgaacgtcagtccgccgcgcttggtgactcgcccggaatccggctcctgagtgcctttgaacaggtgcagcagcgtggatttgccgtcgccgttgcggccgacgatgccgatgcgatcgccctcgaatacgccctgcgtcacatcggtgaagatggttttggtggcgaaggcgagtgaaacgtgttccaatccaaggtcataagtcggcatgactcaccaatgtagcgtcagcggtgggcatcaacgtccgaaccaccatacgcccccgctggctcgtcatgttcgccccccgccagcggggagcgaactcgcagttcgctagcgcagggattgggcgtaggtgttgcagcgggcggcgaatccgccgaacacctgctcggccaacggctgcaggcgcggattatattcggcgaacgcttcgcgcagctgcgacttcgatccgcccaccgccttgaggtccttgaccatcgaggactcatccagccattcctccagcaacgtcggcgtcacttcgagatggaactgcatgcccagcgccgagccgatgcggaacgcctgcaccttggtgtgctcggaccgcgccagcagctgggcgccggcgggaagccccaccacgtcattgtgccagtgcagcacgtcgatctgcttgttccacatcgagaagtaattgtgcttgtcaacgcgcttgatcggcgcgaacccgatttccggcgactcgccacggctgagtttgccgcccagcgcggtggcgatgatctgatggccgaggcacacgcccagcaccggcttgccgacgctgatggccgccttgaccagtttcgcctcgaccttgagaccgggatacttgtcataatccagcgcgcccatcggaccgcccataatcaccagtccggcgacctgcgcgaagtcaggcagatcgggcttcttttccttggcgatgttcaccaccgtggacgacatgttcaggtcgtccaggttgtccaggatgcgccccggcttctcccacgggacgtgctgcacgataagcacttgcgattgcgtcataactccattgttgcatcacctacgtaaactttgcacaccgtttcttcatctttcgtatttccagccgcgcccgggcggccgcgcaatcacatttgccgggtggtttgtctgatggtttgtcgtataacgcgaatacgctcgacattatgacacaagcctcagaaccgcagaattccaacacttccgagaacgccggcgtggcgcgcgccgcggccggcctgaagctgtatgacacggcttcgcacacggtctcgcgtttcaccccgatcaagcccggccaggtggggatctacgtgtgcggcgccaccgtgcagagctccccgcacatcggccatatccgagcggccgtcgcgttcgatgtggtgcggcgatggatgctgcggctgggatatcaggtcacgttcgtgcgcaacgtgaccgatatcgacgacaaaatcctcgacaaggcggccgcggcaggccagcagtggtgggcgcgcgcgtacttctacgagcgggagttcacgcaggcgtatgacacgcttggcgtgctgccgccgacgtatgagccccgcgcgaccgggcacatgatcgacatgatcgacctgatccgccgcatcatcgacaacggtcacggctacgtagtttatgacgcggatggcaagccgaccggcaacgtgtatttcgacgtggcgagctggccgcattacggcgagctgacccatcagaagcagggtgccgccgaggccgacgaggccgccgccgtggctgaccgcatgggcccgtccgtggatgcggccggcgacgacaagtacaatccgatcgaccccgccgacgcatcccccgacaagcacgatccgcgcgatttcgcgctgtggaaggcgccgaagcccaccgacccgcaggacgcgcgctggtcgacgccgttcggcgtgggccgccccggctggcacatcgaatgctcggccatgagccaccggtatctggacggcatgttcgacatccacggcggcggactggacctgcgcttcccccatcacgagaacgagatggcgcagacgcgtgccgccggatacgagtcggccgcacgctggatgcattcggcgtgggtgaccgccaagggcgagaagatgtcgaagtcgctgggcaccggcctgtccgtgccgagtgtgctggccgagcactccgcatgggtggtgcgctatgcgctcggctccgtgcagtaccgttcgatgctcgaatggtccgaccaagcgctggtcgaggcccaggccgcatacgaacgcatcatgaacttcatcgagcgcgccggcgtggctttgggcgagcagcccgagcgcgccgagatcgccggggtcagcgccgatgatcttcccgccgatttcgtctccgcgatgaatgacgacgtgaacgtctccggcgccacggcggcgatcttcaccgcgattcgcaacggcaacacgctgctgagcaagctggatgaccgtgccgacggcgatgcggcccgcgccgaggtgcgcagcgccctggtcgcggtgcgggcgatgctggatgcgctgggactggatccgctggccgagccgtgggccggtgccgcaggcgcggacggcaacggcgagagccgcgagcatgatgtgctggacgccctgatcacggagcagctgaacgcccgcgccgaagcgcgcaagtcccgcgacttcgccaaggcggacgcgattcgcgacgcgctgggcgccgccggcatcgccatcgaggacggcccgcaaggcagcacgtggagtttgaagtaatcctcccccgacactgtgtgatccgttatgttgagccccgcctccctccaaaaaaagcggggctcaactggttacggttatgcaatcggagcatattttgacggtgaaagcgacgatagcagcccagcattgtcgctggcattatgccagcaaatgcaatcaaataccgagcaggaacgccccggcatcatcgcgggacagtcatgatcatccgatcctgttccgctccttaatcgaacacgaaatcgacatccacgatatgcagccgcttggtcagttccttctccaagtctcgcttgcactccaccagatcctccacgtcaatgctctgcccgataccgctcagatacacatcgaccgtatagttcatgccggtcttgaacaccagtacctgctcgtaatcggtgttctgcggcagatgccgctgcgccgccgactccacgaacgcgttcgtcgcatcgtcgtcatgcactccgccgaccagttccacgaacgcgtccttgagcacaccgaacggctccttgatcgtgagcagcaccagtgcgacggtgatgaagaaatcaccggtgtaatgcaggaaatccagagggccaccagccggcaggaaccacaggaacacggccaccacaccgatgccgaacgacatcgaaccgtcgaccagcgtgctcttgcactccgcggtcagcatcgtgctggaattgcggatgcgccggttctcgcgccggtaatacaggtacagtcctaggcagacggccacggtcaggatctcgtaaatcaccacgggcccggtctcgatgcgcccgccctgcccaagcacgaaatagtcataggcgacgcgcgtcacatcgacgagagagaaaagcagcagcgacatcgtcagcatcgccttgcagatggcgtatatcggttccagagcgaacatgccattggggaagcgctcggtggtgcgcacggtgcgcgacgacaggtatgcggcgacgaggccggacagcacggagatggcggtgaaggagaagtccaggaacatggccttcagaccggtcatgaagaacacggccatgcctgcgagcacctgcaggatgttgatgacgatgcccacgatcagggctttgcgttcgatggttttctggtgtggcataggcgggccttccatattgcacggcatgtctgcgtcggcgtcagcgcggcagtctgcgtataggttgggtccgaaggataatcaaaacagctcagcgatccaataatccacggaattattgcccttccatggtaacggaaacgaacgattccgggcgtgtcggttcgcgctgagcgtgcgggaatccccaccgcccacaaagccaacggttctgtcgcatttccaccgctctctcgcgtcgatcccacgcgcagccgcgaccgccgaacggcgccccgcggcacctctccgtcgccgtgcgggccgcctcggcggcagcccgctggttttccgccgcaacggctagactggttcgcattatggctgcttttagttctttgacagaccggctctcgaatgcgttcaagcatctgaagagcaagggcaaactttccgaggcggatatcgacggcacgatccgtgagatccgccgcgcgctgctcgacgccgatgtggcgctcgacgtggtgcgttccttcaccgcgcgcatccgcgaacgtgcgctcggcaccgaagtgtccgaagcgctcaacccggcgcagcaggtggtcaagatcgtcaacgaggagctgacggatgtgctcggccagggcgtggaccggccgctgaacttcgccaagaacccgccgacgatcatcatgctggccggcctgcagggcgccggcaagacgacgctcgccggcaaactcggctactggctgaaggattccggccacacgccgctgctggtcgccgccgacttgcagcgtccgaacgccgtgacccagctgcaggtggtcggtgaacacgccggcgtgccggtgtacgcgcccgagaagggcgtccagtccgacgggggcgactcggtgtccgcgccgggcgagacctccggcgacccggtgaaggtggcccgcgattcgatcgcgctagccaagcagaagctgtacgacacggtcatcatcgataccgccggccgactgggcgtcgacgaagcgctgatgcagcaggcccgcgacatccgcgatgccgtgaaccccaacgagatcctgttcgtcatcgacgcaatgatcggccaagacgccgtccagacggccaaggcgttcgacgagggcgtggatttcaccggcgtggtgctgtccaagctcgacggcgacgcccgcggcggtgcggcgctgtcggtggcgagcgtgaccggcaagccgatcctgttcgcctcgaccggcgaagggctcaaggacttcgaggtcttccaccccgatcgcatggcctcgcgcatcctcgacatgggcgatatcctcaccctgatcgaacaggcgcagaagcagttcgacgaggaggaggcccgcaaggccgcccagaagatggcggaaggcgagttcggactcgacgacttcatggaccagctgcagcaggtgcgcaagctcggctcgatgaagtcgctgctcggcatgatccccggcatggcgcagcaccgcaaggaactggagcagttcgacgagaaggagatcgaccgcaccgaagcgatcatccggtcgatgacccccgaagagcggcgcaacccgaagatcatcgacggctctcgccgcgcccgcatcgcctatggttccggcgtaaccgtctcggcggtcaacgggctgctgcaacggttcgagcaggccgcgaagatgatgaagcgcatgagcaacaaggccatgggcggcatccccggtttcggaggccccgcggtaggcggcggcaagaagggcaagggcaagagcaagaagaagggctcgaagtccggcaatccgatgaagcgcgaggccgaggagaaggcgttgcgcgacaagctcgccggcaagggctccggttccggcaagtccggcgggtccgccttcatgaagaagccgcagaatccggctcttccggccgggctgcaggatgcgctcgacgcgaacggtggcgagcttccgcccaacttcggcggcggcctttccggtctgctcggctgattcggcccgtttttctctggcgccgggcggggatggacgttttcgtccatccccgcccggcgccaaatcatttgccatatcttcgcagctttccactcgccgcgaattcgcaacggctgccggtacactgaaagccattattcactcgttggaatgttaggtaaggagttcggcggtggacgtgttgtcgtggatactgctggcggcgtgcatgctatggtcggcgttgcggttcctgccagccggacgggaagcgcacatgccgacgatgccttacatgattgcgctgattcgttttttgtggataccgtacctggtcatcgcggtatgggccggtctggtcggctcgtggtggcagtgcggcgtcgccgtcgccggcatcgtgtcgatacttgccatgcaggttccgtattggacgaacatgccgcgggaacgatggcaccaccagcgtggaacatcccatgaaacagcgtcagacgaccatcgccagaccgcgcgatccgccgacgccgagccgaccgcgaacccgccgcaggcgagcggcgacacctaccatctgatgacgttgaactgccgctatggcaaggcgagcgccgacgccatcatcgcggccgtgcgggaacgacacatcgatgtcctcgcgcttcaggaactcagtacggatctcatcaagcgtcttgagcgcggcggcctgcacaggatcctcccctatcggcagctcggtacgccccgcgaaaagaccgacaacggcggcttcaacggcatctggtcgcgcaccaagccgaaacgcggcacgcatggcattgtctcgatacctgcggccgacgtgccgggcatcatgctgcaaaccgatgacggcacctccgtggcattcgcatccgcgcacaccaaatcgccgatgcgcggctgtcgggaatggtcagacggcatccggtccctgagcgcgctggttccgatgccgcgcaagtcggtcagcgcaggcactggccgcgcggaacgtgccaccggctcgaaaggcggacgcgacggtggttccgcatatcccgacgtcgatatcgcggtgctcatgggcgacctcaacgccgatatcgaccatgccagcttccgcgagctgctgcggtccggattccgcgacgccgcactgtcacaggctcgcggacatgtcaataccttccccagtcaggtgccgtggccgcgcatcgagctcgaccacatcatggccgcgacgcgagaatccgcgtcaggctccgccgccgagccggcacgagccgtcgcgttcagcggcgtcgaatcatccgtcgtggaagacaccgaccacctcgcgctgaccgccacaatgactatttgagcgtcatgccgcacggacagcatggcggatatgcgtcactgagcgcgcccaccgtcactgagcgcgggcacactcacagtgacgcacccacaaaacccttgcaatcactgggtttccgggttgtgtcacgctgtgcgggcacacgcagcgtgacgcaacccgctcacagtgacgcagaatgaccgagatggcccgcccccggcacgtcaaaacaacaatgccgcatgggctcccgtagaagtccatgcggcgaggcttggattgcccgactacagcaccgccatcgcgaaatccacgagcagcttgatgccgtacaggacgatgatgccgccgcacacgcggttgagcacgccgatgatcttcggattgaacttgtgcgcgaacgcgttgacgacgagcgtgacgccgaggaaccacatcactgaagcggtctcaacgcccgtgatgaacggggtggcctgctgcgcgctcagcgtagccgcaaacgcaccgagcatcaatgtgccgtcgatgatggcctgcgggttgaaccacgtgaccacgcatgcggtgccaacggtcttcagcagtccacgcagaccgagacgcttggcaggggcttcagcaccagcgaccggactcgccgtcgaagcagtcgcagcagcaacagcaccggccccagcgccgttctcggaagtcgacttcttcttcggtagcagcagtcccagaccgatgcgcaccacgacggcgccgcccaggccaagcaccacggtctgcagccacggatgcgcctgcatcaacgcgccgatgccgaaaaagcacgccagcgacagcacgatatcgaagaaaatcacgatcaccgcagtaatcaacgcgttgcgacgcgtacgcgtcaacgcggaattgatcacgaacagattctgcatgccgattggcgcgacatacgccaatcccatcgtcaagccctggaaatacagacccatcatcactcccgacaatcatttggttgggtcatcatcacccaaccaaaaccagccaatatgccatcagctggatttcctcacgcggattgcaagttatacaaaatccgccttattccaacacctttgccatattctacagattcgattacacttggcaaccagccaagaacagagcaatgcacccaaccaaaaatcaggcatcatgacacgcagcacaccattggacatcaactgggagccggaccgcagcagcggcgagcccataaccgaacagatcgtcggtttcatgtgcgcccgcatctcaagcggcgactggccgatcggatcaagactgcccagccagcgggtactggccgaacgcttcggcgtgaaccggtccaccatcatcgccgcgatcggagagctcgccgactacggcatcgtcgaaggccggcacggcgccggcacacgcatcgccagcaacacgtggtcgctgatgctgccgggcgcgccggactgggcggattacgtgtcgtccgggttcttcaaggcgaacaacgacaccattcagacgataaaccgactcgaattcgaccggtcgaaaacccgtctcggcaccggcgagctcgacccgcggctgttcccccgtgacatgtggcggcgcgtggccggcgaagccgcggccgagataagctcgctcgggtatccgccgccggagggccttgacgtgctgcgcgaggcgatagcggcgcacatggaggcgtggggcatcagctgcacgcccgggcaggtccttgtatcatccggcgcattgcaggcgttgcagatgatttcggtgagtctgctgtcggccggatccacggtctatgcggaggcgccgagctacatcaagtcgctgcaggtgttccaatcggccggcatgaaactcgccggcgtaccgatggacgagcatggccttgacgtggatgcgctggggaagctgatgggcggcgggtcgcagtccgaggggatgacggcggcggtaccgtccgccccgcagacctcactgccgccgcgggccaaggccacgcgcgagaacgacgcggtgctgtatacaatccccaccaaccacaatcccacgggcgtcacgatgagcgagccacgccgtcggacgctcatcgcctcatgcgtggcgaaccggttgccgatcatcgaggactgcgcataccaggacctcatcttcgacggggatacgccgcacacgctcaaatcgttcgatgagaccggcatggtgattacgctgggcagtgcgtcgaaggcgctggcgccgggactgcgcatcggctggatcgtggcggacgagcgcatcgtgcaacggttggccgacgtgaagatgcagatggactacggggcgagcacgctgagccagtgggtgttcgcgcggttcctgtccagcggcctgtatgacgagtacatggtctcgctgcgcatgcagctacgccggcggcgggacgccgcactggagacgctggagcgactgttcgccggccgtgcccactggaacgtgccgcgcggcggtttttacgtctggctcacgttcgacgagccggtgcgcacagggcgcctgttccagcgcgcaatcgagcacggcgtactgctcaaccccggcgacatctacgatttcgagggggacaactcgctgcgcctgagctactcctacaccacgccggaggagttcgcggccgccgccgaaaccctggcctctttggtataggcctcgatggcggcttcgggctggacaacgtccaagcaaacccgccgttatccgtctcgaaaccgcccgctgcgaccggccaaggtaccccatgtggccgtatctcgttttcaaggggttgatttcggctccgccggacatctatctgcgtttcaagggggcgccaaaacgcgatatccgaagtatgatcggcgaaataccaccggaatcatgcggttcttgggccacttatactttgtgaccaacccctcgaaacgcagataggcattcggaacaacacgaatcaacccctcgaaatgcagatagccccgaatcctccgccagtgaatgccgaccaggctttcaagcatcacgtcaggcaccttgcgcgccgatgttttttgccacgtcgaccccgacgatcgcttgccagctccagcgtgtcgggtatccacccctatgcgttataatttatcggttattcgtgatgggtggagccctctcattctgcctttcatgaggaacacgtgggttctcggttgaggtgccccacacacaatcgaaaatccgcaaaactagtattacaaggagagccattttggcaaccaagattcgtctgaagcgcatgggcaagaagttctacgccttctaccgcgtggtcatcaccgattcccgcaacaagcgtgacggccagtccatcgaggagatcggcacctacaacccgaacacccagccttcgaccatccagatcgactccgagcgcgcacagtactggctcggtgtcggtgctcagccgtccgagcctgtgctcaagctgctgaagatcaccggcgactggcagaagttcaagggcctcgacggcgccgaaggcacgctgaagaccgtggaagccggcccggacgccgcagctcgcgtcgaagccgtggaagccgaagcccagaagctgaaggccgcgaagtccgccgctgacgccaaggccaaggccgaagccgaagctgccgctgaagctgaagctcccgccgaggaagcgcaggctgagtgatcatgctcgcgcaggctgtggaacacctcatcaagaacatcgtcgattttcccgatgacgtttcggtcaagtcccacgagaacgcgcgcggcgaactcattcgcgtgcgcgtgaacccggaggatattggccgcgtgatcggccgcagcggccgcaccgccaatgcgatccgcaccgtggtgcaggcacttgccgaccacaaagtgcgcgtcgacatcatggatgtgcgcaggtgaaccctagcgtggagcgtcaacaacactctgacgaccctcagcagcgcgagttgctgagggtctgtcgtatcggacgcgcgcaggggctcaaaggcgaggtcaccgtgcagatcttcacggacgagccggaatatcggttcgctcccgactccgtgctgtacacgcgcgacggttcgcaggaatacgtcgtcgagtacgcgcgcacattcaagaaccgttggatcgttaagttcgagggcattgatgaccgcgacgcctccgaggcggcgaatggcatcgagctgtacggcgaggctgacgatcccgaggacatgctggaagaggacgcctggtatccgaaggatctggtcgggcttgaagcgcggctcgccgagggcaacgggctcggcctgccggccggccaggtcataggcaaggtcgtggacgtactcgacagcgcgcagacgctgttgaagattcgcctggcctcgccggttcgggacgccgtcaccggcgaagtgacggaatcgaccgcactggtgccgttcgtcgacgagttggtgcccgacatcgacctcgaagaggggtatctgacgatcgacccgcccggcgggctgattccgggactgtgattcggccccggtcacccttcagtgtccgacagctgcggctgtcggacactgtcatatatgacggcgttgttgccgggcgccgagccgagtccggcaacaatgcggcgcgcccggatgcgtagcaaggctgacagacgcgatttataaaatcatgcgattccagtcagccggcgccgacaaaccatgccacacatccaggcgtgtcgcgacgctcatgccgtcggactgcgggattcgctacgctggagaacatgaagatcgatatcgtgtccgtgtttccggagtattttgacgtgctgaacctgagcctgttcggcaaggcgcaggagaagggtctcgtcaccgtcaccgcgcacaacctgcgcgactggacgcatgacgtgcatcattccgttgacgatacgccggccggcggcggtgccggcatggtgatgaaacctgaggtttgggcggaatgcctggatgacctgctcggtctggcacccgcagtcatcgcgccggacgcggtatcttccgacgcgcacgacgatgattcggcctccgtcagtccgtccggcgcagtcaactcggcggaagcagccgatacgaccgatgcggccgactcgggccatgcaggtaatccgaccaatgcagccgcttccgtcacttccatcgtttccgataccacgagcgacaccagtgaagctggcgggaacgccacgccggttctcatcttcccgaatccctcggcgccgctgttcacgcagcgcgacgcgaccgagctctcgcacgccgaccatctgctgttcggctgcggccgatacgagggctatgacgcgcgaatccctgagtattaccgcgcgcagggcgtcgacgtacgcgaatactcgatcggcgactacgtgctgaacggcggcgaggtggcggtttccgtgatgctggaggcgatcaccagactgctgccgggcttcatgggcaatcccgattcgatcgtcgaggagtcgtacacgggcggcaacgcactgctggaacaccatcagtacaccaagccggccacgtggcgaggcatcgcggttccgccgatccttaccagcggcgatcacggcaaggtcgaccggttccgccgcgacgaagcgttgacccgcaccaacgacattcgcccggatctcatcgagcagctcgattgccggcagctcgacaagcaggaccgcaagacactcatcgcccttggctgggaggtctccggagcgcgtccgcgcaagctgcagtaagtcacttgacacacgtcatcagccactatccccgcaaaagttgagtctcatacgctcaactttttcactgtgggtaaaaactgggaatgtcaggacggaataccggtaggtagtggtgcaaggcaagaggaggagctccgagaggggttccgggaacggccacgatagaccacaccggcaaggccagtcacccggccggcgcggcaagccaacccgttccactccgatatgcgaggagtaccgattatggcaatgtttccggctttgatgaatgacacgatgttctctgacctgtttgacgacccgttcttcgagggttggcgctccgccgacaacagcgcggcgatgaccccgacgaacatgatgagtacggacgtgcgcgagaacgacaagggctatgacgtggacatcgacatgcccggcttcaagaaggacgacatcagcgtctcgctgaacaacggctatctgaccgtgtccgcccataaggacgaggacagcggcgacaaggatgagtccggcaagtggcttcgtcgtgaacgttacgtcggcacctgctcgcgcagcttctacgtcggcgatcaggtgaaggagaacgacatccacgccaactatcagaacggcacgctgtgcattcaggttccgaagatcgaggcgcagccgcaggtcgaaagcaagcaccagatcgccattgagggctgatgcctgatggccggccgtacaggtcggcggcggaaacaacagtcaagcagaaatcccgtgaccggcatgcggaacatgcaaccggtcacggtttttattggctcgttggtatttcgtccccaccccgtcagcgggagcgaccattcggcttacaggccgaacaccttcacgcgggagtcaaccggctgcttgtcaaccggagccgcggcctgggcgacggtgccgaacggcatctgcgcctgcaacacccagctgggcggcagaccgaattcggcggagaccgcctcgtcgatcagcgggttgtagtgctgcaaggatgcgccaagccccttctcggcgagcgcggtccacacggcgagctgcagcatgccggcggcatcacgggcgaatccggggaagttcgcagcgtaggtcgggaagttcttctgcagctgcttggtcacgtcggtgtcgtcgtagaacagcacggtgccgtggccggcggcgaaggcgttgatcttggcctcggtgcccttgaacgcttcgtcatcgctcacgaccttgcgcagcgtctccttgacgatgttccacagcttctggttggcgtcgccgaacagcacgacggcgcgctgcggctgggagttgaacgcgctcggcacctgcacggtgacatcctcgacggtcttgacgatctcctgatcgccgaccggggattcggaggtcagcacgtactgcgagcgacgggccttgagttcctcgatgaagttcgacatgatggcatcctttcgcgatggcattgcgttttgttgtttcactgtcttctaatagctcgattcgatacctcgattcgaggcattccatgattaacgatacgtgcgccatgcgatccacatgccgatgttctctgtcagagaatattagctaggtaacattcggcacggcggcgattgggccaaggccgcttcgggctcgcagcaacgggctacactcgcctcggccgctcactcatccgtcgcgcccgaggtctccgaggcctccgatgtctcaagcgcggactcgatataccacaccgcggtctcgccataatcgcgatgctcggcgaggacccatccctcgggcggcacgggctcgtcggaacgcgcggatcgctccaacacgatcgtcgtattcccgccggcgattccatgggcgaccatgtccgagagcaactggttgcagtcctcggtggcgaacgcgtacggcgggtcgatgaagatcacatcgaacgccgccgacttcgcggagccgccagcagcatcggcgttcgaggccgagcgtgcggcacccgaagcgacgtacttctcggctctggccctgatgacccgggccgtcatgccgcgctcccacgaacggttccgctgcagcgcggtcaacgtcttggcgatcagcgccgccgccggagcggaggactctaccgccaccagctccctcgcgccgcggctcaacgcctcgacgcccagcgccccggtcccggcgaacagatccaatacgcgggcgtcgtccagcacctgccatgaatccagatgcgagaatatcgcctctttggtccggtcggtggtcggccgggttccggttttcggcgtggtcaacgcgacgcccttgaatcgtcctgaaatcacatgcatgacaccattatggccgcaccggcgaaacgaccgcaaccgcaccaccggtcctgggtcgtacgtgccatatatcagacggctccgatacgcgactcagcttgctcacatgcctcatatgctatgatgctttgcgggtacccttgctcggatactcactgcgacccgcgtaatttgaccgtttgcgggtcgctttttcatctggacatatcttcgaccacccccagtcgctacgctcgacagccccccgccagcgggggctgtcgagcgtagcgagactggaggcggccccagccagcccactcgccagcctatgcggcttttgccgtggcagcgtgggcggagatgccgcacgcgccaacgggcaccggagcgtcgtcggcatcgtcgtcggcctgcacacgcagcatcgactgatgcaacgtcaatgacaatccaggcgtcaccgcgaatcccggctgcaccggcttatgggccgcaccgactccagccgcgacgggcgaggcgacgacggacgccgcaacacccaccgcgccgaggggagccgcaacaggaacgacaggagccgcaaccgccccgccagccggcgacacgaccacgcccgcgcgatggcgatgccgcccggcacgagccgaatccagcacgctctcgtcgaactccccggtctgccgcgatacgatcgccgcgcatgtgaccgcagcggacacgttcgccatcgtgctcggcatgccgacgatgttgctgaccggcaccagcggcaccagaagctgcaccggaagaccaaccgcggtgaacacggtcgtcgcggtcacgatcgcagtgcccggcacgcccgcggtaccgatcgacgacagcagtccgatcaccgcgagcgccacatagctcaccggcgaataccccagtccgagcgcgttgatggtgaacacggccgacagcatcggccacacaccagcgcatcccggcatgccgatggtcgtcccgatcggggtggtgaagttcgccacgtccgcgccgacaccgaccgtgccgagctgccgtatgctcagcggcagcgtcgccacgctggactgcgtggcgaacgccgtggcctgcgccggcagcacggccttgaagaacgtcaagggcggcacgtgcgccacgaatttcagcagcagcccgttgacgacgaacgcctggatgatgttgagcacgaagcccagcacgagaatgctcagcagcgcgagcagcgcgtccgccttggatgtggtcgcggccgtcgaggtcgctcccagcaccaccaccgcgtacggggtgagctcgaccacgtagccgacggccttgtagatcacgcccttggtctgctcgaagaaccgcttgacgacgctcacgtccttctgccgaccgaccgacacgatggcgatggccagcacggtggccgtgatgatgatgggcaccacacggttgccggacaggtctccgacgatgttcttcgggaagaagttgagtatgacctggtcgagcggcgctgtctgcgaggtgaggaaaccggcggtcgactcgtcgtcgacgagtttgacgcccgagccgatgtgcagcgggatggccacacccagcgtcatcacgatggcgatcagattggtgagcagcagccagccgaccgaccgcaatccgatgctgcgcagctttttcagactgccgacgtaggtgatgctggagatgatcgacacgaagatcagcggcgcgaccagcgcggtgatcaggttgatgtagatgttgcccagcaggttgagcgagtcgacctgcccgtcgaacacgaggctcagggcgatgcccagcccaagcgcgagcaccgtcagcaggctgaagttgagtttgaagaccgcgcgcagcacggcgatcagggcgaacagcaccacggccgacgcccagaccgccactgcggtgggatcgatgttggatagcgctcccatcagtcagctcacctcgccgaggtcgggcgggtcgagtcggagagagcctgtgccgccgcggcgtcgccacggttgcggctcagcgccagcgccccggcggcggtcagcgcgaggctgagcgcgacggatgcgatgaccgtggcttcggcaccggtgcgggagagcggctcgttgccggcgacgacgattttgcgggacggcttgttgccggccgtgctatcgttgccgccagcgttgtcggtgttgcctgcgaccggattgttacccgtgtcgccgctaccgctgccgttaccgttaccgctgccgccgttgttgcctccggcgagcgccgtgaccgcattggcgatgttcttcgtggcggtgtcggccgcgctgatggtcgccttcttgtcggacacggtcttttcggccgcggcgagcgtcttcttgaatgcggcgacccggtcggcggagtaaccgtccaggctcaccgtcttggcttgtgcgatttcgccgcgcaggttgagcagggagtagaagtggtcggcctgggcgatgtatgcgtcacggtcgttgttgaccttgcgcccgtagttcttcgccgcgctcaggtcgtcgccggtgatggagaatccgccttggatgatcgccttgtcgtcgtacgtggtgccgtaccagttgagcatgtattccctcgccgtgggctgcggcttggtgtcgacgttcgcggtcttgccgtggtagtccacgacctcatcggtcacggggccggccggctggtcggttccgggcagctgggcggcgttgttcttgttgtagtgcagcagcagcggcacctgcaggcgggtcgcgccgacgcccttggaatcgacgacgccgtggctgccgtcctcggtcacgaggttcggcaggtatgtgttcacgagatgcgtgtacaggtccgacagcgggtggctgccgttgttgtagttgtcgcggatgtggaacggcgagcctttgccggacgtgctgtcgaggatcgtatcgaacgtgtacacgtgcttgatgccgtatttgcgggcttcctggttcacgtagcggatcgtggcgtatgtgttgccgcaccaggtcgcgccgaagaagatgtaatggttgcctggcgactgcagcagcttctccagttcgccgtacgtcaccgatatgagcgagaagtccttgttctcgccctgcttgaacacgctggccgcgccggccgagacgttgttcaggtagtagttggtgtagaactggccgttggtgcgggtcgcggcgttcttcgcggtgcccagcacgcgggtcagctcggcgctgtcggcaacgttcgcggtggatgcgagcaccttgtcgccggtgttgtccttgttgtaggtgaacagggtcggcaggtcgacgacgtttgctgtgttcttgctttgcaagtcggtcaggccgaattcgtcgatggtctgctggaaccgcttggcgaatgcgtcgaccgcgttgttcttgtcgttgatgttgacgagcgtgtcggctccggcgttgtcgaggtgcgggtcgaaattgtagatcttctcgatgccctgcgccttggcggcggtgttgatggcgggcagtgcggccgtcgtcgcggagtcccacgtgccgccgatgagtatcacgaagttgcctttgccatagcgcaggatgtcttcgagacgttccagcgtgatgttctcgaacacgtgatccgaaggcaggttggggatgcccgcgtagtagtcgaatggcgtgtcttcctgggattgtgcggctgttgccgccgtggtcgtggtttcggcggcggatgcggcgttcccgcccgtcagcgcgaatccggtgagaccgagcgccgccgcggtgagcagcgccgcggctttagcggcgatggagcctctcgtgaggctgtggttggtgttggacattgttgtggttcccttctgtatttcttccgtatcgaattgcgttggtactgctgcgctgatggctcagcgggacgatggtccgtcgccgaggttgaagtcgtaccgcgcggtaggagcgccgccgctgtcggccacgttgagactcgccgatggcccggcggatggcccattcgccggcgatgcgatgggctgcagcacttcggtcggcgcactcgcgtcggcacgggcttcggttgcggcaatggcgttcgccgtcgtcgcgggggccggcgtcgcgccgtctgcgatgtcgaatccgtcgtcggaccggccgccgttcgctccggcgagcgcgggagcgcggcgcttgttgcgcacaatcagcgcggcgcccagcgtgccgatgacggcgagcgcgatgaccacgccggcgacgatgcgcaccaccgggctggtggtttcggcccgatcggtgaccggagaggcctgcgtggtggtttccgccgtatcagtgccgctgtcggtggtgccggattcggtcgtggtggtctcgccgccagcggtgtcggcggtgttgtcatcgctgttcttctgggaggccgcgtccttcgaggtctgagtggcggtggcatcggcgttcgtgttcgcggccgtgtcgcctgtgatcccggctgtgctgcccgtcgtgctctggccggactgtgtgccggtcgactgcgcgggctgcgactgttgcgcggtggtgttgcccgtggagggcttcgtcgtctgggtggccggcgagcccgaggactgcttcgccggggccgactgcttcgggttgctcggcttcgtggcgggggcgggcgtcgccggctcctccttctgggcgtgctccttcttgtagttcgcgcagtagctgtcgaacgcggccttctgcgctgagacgtcgatgccgcctccggggttggaatcgtaggccgaaccgccactggaacagcaggcgaccggattgtagttggtcgagcacaggtcgcacacgtcgccggccgcgtaggccgtgccgagcgcgaattgcaggccgccgaccgccatagcgcctaccacggccgagccggcgagtacgcggataagccggcgcttcacgggccgcccgttgcgtggcgcttcatgacgagctgatgatgtggacatggatattcccttcttcttgtcttccgcgccgtttttggatacggcgcggcggtacagtttggtggcggcgaatcgcgatatacgaaaacctgcgatgcggcagaatccgcatcgccgcgaatgatccggcaaccgtcggcgtaatctgccgggagtgtgaggaatcatgccggacggcgaatcacaatcatcacgatcgcgccggcaaacatccgaaacggactatcgagcggtctctcaccgctcgcgcatgatcggcagtccgcccgacagtgagctgacagccgatgccttcacgccttcattgacacgcataacgtactccttgctcagataagacacctgaccggggtgccgccccatcatccggggccgggcctgttcgcgggttcccgcgaacgttgacatcatcgtaggcaccgcgtcgccgcgttggcaaacccgcggttatacatagttgttatggcctcgtatcaaccctatatttgttcacgatgacagcagcgacaaccgttatggcgaatatcacgacattgccgatgatcagcagacggttcatcgtgtacagcagccatgcgatcagcagcaggtcgacgagcagcgcgacgatgcacaacgccgcgagcccggattgcggcacgcggccgagcaacggcagcgagcggaatgcgcagagcgatgagccgtcgcgcagtatcaggcgcaatgcggcgacagcgaccatcgcctgcaccacgattatcagaatcgtgacgctcgacgacacggttttcgaggaattcccggcgatcagcgggcactccgcggcgatcatgcccaccgaaagcaggcgcacgggagcgccggtccgagcggaacgctctcccagttcgcgcggcaaccatccgtccgcgcaggccgaggcgaccggatacgccacgcagccgaccacggcattgagcgtggtgagcagggcgaacgcggagccgcccaccacgaacgcgaccgtcaccggagccgggatgaatgcagacaggctgacggcgagatcccgattcgcgacctgggctatcggcaaggcgccggcatcggccacgcagatcagcgcatacgtcacgacgaccagcaacagcgagacgcgcatcgcgcggggcaccgtcacccgcggacggtccgcgaccgcggcatagttcgccacgccggccaccccgttcatcatgaacgtcatgtacacgcatgcgaacaggaacgccagaggtgagccgagaaacgtgtaatgcgcgagattcgcgagccgcacgtgcggcattgtcaccgcaacgtacgtgcccaacgccgccgcgagcagcacggccatcaccagttgggcgatggcggcgatgcgggcacccagcatgtgcacgccgaggaacagcgcgacgaccaacgccgcggtcaggcgtgtcggcagcgtgggcaggccgagcagctgcgccgcggacagcgcgtacgcggagatgtcgaacaccagaaaacacaggatataggcgacgatgccaccgaacacgggcggcagcagcgtgccgacctgctggtactggccgcccgggtaatcgccggacgagctggccagcagctgcggcaccagcgcgaacgcgcctcccagtccaccgaccagcgcggcgagccacaatccggtgcccgtgatgccgacgccgatgccggccatcgacatgacccccagaccgacgacattgcccgcgccgaaagcggccagatgaaccgtgtgcagtgaacgtgatgatgccatgatgcccctccccggccgaaaccttcatgacaactgaaccacatcatgccggcgatgagaacgccgttcccatatgaaaaatctatactgtgttcaagcgccacattgttcgatcgcggatggcggggccggggctcgtgtccaacgaccctatccgcggcgcatatctcccgtcgcgcgtcagctgctggtcaggaacgtctcgttgccgcgggtgaaatcaagcaccgcgccggcaagctcgacctcgcccgacagatcggggtcatcggcgagcaaccgccccgcacgttcgcgcgcgtcggcgatgatcttggcgtccttgaccacgcgcagcagtttcagaccggacttgccgcccgactgcgcatcgccgagcacgtctccggcgccgcggaactccagatcggcctgcgcgatctgggcgccgtcgagcgtgccctggatgacctgcagccgctgctgcgcgggaccgccgtcctcagcccgcgaaatcaggaacgcccatgaatccgtgccgccgcgccccacgcgcccgcgcagctggtgcagctgcgaaagcccgtaccggtcagcgtcgaagatcacgatgcagctggcctgcggcacgtccacgcccacttcgatgaccgttgtcgccaccagaaccggcgtggccccatccgcgaaatcggccatgacctgctgcttggtcgcgtcatcgtcgcggccggtcagcgtcgcgaaacggatgccacggaactgcggcagcgatgacagcctgcgctcgatctcggccacggaatgcagcggcggccgtgacggagcaccgtcaccatcctcctgcgatggcgcgctggcggatgtgttggcggccgcggtggcggattcgcgcctgtaggcgtcggaatcgtcgtacacgccgatctgcgatgccccacttgtatcgtcatcgccgtccgattcatcgtcggcatcgatacgcgggcagacgacatacgcccgctcccccgcgtcgatgcggccgcggatgtgggcgaacatggagcccatcatgcggccgtcgtcttcaggcacgatgaacgtgcggatgggcttgcgcccacccggcagctcggtgagccacgagatgtccagatcgccgaaccaggtcatcgccgccgtacgcgggatcggcgtcgcggtcatgaccagcaggtgcggcacgacatcgtttttggtgcgcagggattcgcgctgctccacgccgaaccggtgttgctcgtcgatgacgacgagcgcgaggttcggggcctggaacgtcttggagaacgcggcgtgcgtggcgacgatgatgcacgggtcgccgctggccgcgagcgcgagagcacggcggcgggcggccagtttcatgccgccggtcagcaggatgaccggcacgtgccgcgtgttcgcgtccgactgcgcgtgcgccgcgccgtcttgtttcccgctgcgtgccccactgtgtttcacgggatgtttcacggccgcgcgccccttggcatctccgtcatcggcagcggattcggtggccttgatcaggtcggccgggtcattgggagacagggcatcgcgggacgggtcatcgcacgtctcgacgccgtcaatcgcgcagagcatggcgctgatggtcgcatgatgctgctcggcgagcacctgagtgggcgcgacaagcaccgcctgatggccggaacccgccgcctgcagcatggccgcgaccgcgaccacggtcttgccggaaccgacctcgccctgcagcaggcgctgcatcggatattcgcgggccatgtccacgccgatatcatcgatgacctcccgctggccgccggtcagcgggaacggcagtgattcgatgaaccggtcacgcagcgccacgcccgcacaaggcagggccgcatccttgcggacattgctacgcgactggagcagcgccgtctgcgagacgaacgcctcctcgtagcgcatcgtgccgatggcccgtttgaaatccgcggtgctgagcgggtcgtggatggccaggaatgcttccgcgcgatgcagcagatgattcgattcgcgcaccgattcgggcaggacgtccgggatcgcgcgggccaggccgacggccacggcgtttcctgaccgagactcggcatccgctggagcggttccggcgccgctgatgccgccgtcttccatcggtttcattgtttgcggggcttccgttgccgcatcgcccgggagatcctgcccggttccagccagcaactcgatgcattgcactatcgactcatgaatgtgttcgctggagatacgagacgacgcgtgatacaccggtcggggtctgctgatgcgacgcaggcccgcttcgacggtgtcggcatcgtatttcagagcgctcatctgcacgacaccggagtattcgccatcagccggaccggagccgggagcgaccgtcattatttcgggatgggtgaactgcagttgaccgttgaactcgctcggctcgccggcgatcaccacaatcgcgccggaacgcagccgcatgctcagccaatcgacatactgcttcttgtacgagaagaacaccaaacgggcggcggcccccgcgacatgccgggaaaccgcgaaatccccgtcatccaccacggcctcgagccggtagccccgccgaacgttcatcggcacgacccgcatgccgcgcaccgacgcggagaacgccattctctcgccgatacgggcctcgcgcagtgcccgcaggggcaccggatcggcgacgcggaacggatagtaggtcaacgcatcgcccaccgtcacgacgccaaggcttttgagcgcgccgacacgccgcttgttcgtcatgatcgacgacatggtggtgttcaacgtgatgctcatacgtccctattgtggtgtgccggcgggacggcatcgcattgtcccctccgccagcggatataaagaggccccggagtcttgcgacttccggggcctcagtgaaacgttatcgcgcgatgtcacgcaaccacacgctgaaccttgccggccttgaggcacttgacgcacacgcggacgcgaacgttctggccgtcaacggtggtacgaaccggctgcaggttcgggcggaaggtgcgcttgttgcggatatgcgagtgagaaacggtgtatccgacctgcggacccttgccgcacactgcacaacgagctgccatgatggactcccttaataaccttgatgttcaagtcttccgtgttccagcacggatgcttgaacacacaacttcacaataatagcgccaaatacaaacaaatgcaaatcaagcgtgtatcattgcggctttcacctacacatccacacaatatcacccgtcttgactattgccgcatccagcaactcttcataaaatcacggtaaaacggttactgtatggcatacgatacatgcaacgcggcaatcgtcaaggaggaatgatgctcaattcacttaaaggcctgctttcacgcaaaaacgacgtgccctcccccacagtgatctcgttgggacaggtgtgggtcgacatcatgatggacatcgacgcgattccccaaccgggcggattcgccgtcgcgaaccataccatgccgtcggtgggcggcagcttccgcgtcatgcaggcggccagccggattggggcggcgaccaagcacgcaggcgtcatcggcaacgggccgtgggcgtcactgatccgcaaggctctcaacgacaacggcatcgagcacatcggccaggaccgcatcgacgccgattccggtttccgtctggtgctcaacgacagcgagcgcaagacgttcgtcgccacgtatggcgccgaatcacaaggcaacgagaacacgttcgactgcgtggagcccggcgagggcgatgtggtgcacatcagcgccaacacgctgatggatcacagcgcgtcaggcatcgacgccttcctgcatcgcaccgcttcggacccgacgacgcgcgactacagcatcgtgctcaatccgaccaacacgctgcacatggtcagcgaccacctgctggaggatctggtgctggtgcggcccatctggtcctgcaaccgtcaggaggcccgcacgctcgccgaccggcttggcgtgttcgtggacgattccctgtcgatgaccgtcggcggcggattcgacgactcgatgaaggcgctgtgcaacagcctcggcgccacgctgcgcgcgccgctggtggttcgtgcggggtcgcgcggcgcgtgggtgcgcacgccgggcggcgaagtcatccatgtggaggggtatccgacgaaggcgacgcacacccgttcggcgggctcgtgccacaccggtgccatgtgcgcactgatcgcccgcggctggtcgcttgtcgatgcggtgaagatcgccaacgcggccgcttcgctgggcattcagcgttccatcaacggcgttccggactgccccggctatgacgaggtcatcgccaagctcgaggaagacgagactccggccgaggccgcgaagtagccattccccgcagcgtcgcccggccgatatggattgttgcgcaacgctgtcgttccgtttgcgtccttaagcgcgcgccgaacggacgactctgcgcacatagggacgcaaatcgggtgttttgcgtccctatgtgcgcgcacttgtcgtttcggcgcgcacttaaggacgctattggaccaatcaccgtaccgatgaccgctcaggcgcggccaccccacggcgtctggccgacaatccccatatcgcgggcgagcctgcgatgcagttccttcgtcaacggaatcagatcgctttccagcggataattcagaaaaacactgcggcaacggcatgtaattcacccgcaaccatatgtagattcgtccatccatcacgatcagattcggtctgtacgggctcatcttcagcagttcgaccacgtcggcgggcacgccgccctgctcgctggcgcgctgaaacatcttgcgaccctgatagatggtcgcccacatgagtgggcctcgtggcaccgtgcacgagcataccaggaacacgatatcggtggcatagctggggttcgcgtccgatatgaactgcatcacgtcatagttgaacgtgatccagccgtccttgccccatgtcgtatgcggcatttcgctaccgaccgtcctcagcttggaaatcttggcgaaccacgccggagggaagtgcacgtcctcgtccagcggcgtccaaccgcgagcgaacatatccgcccgccgcgcctcttcgatgggatcgggcttgcgccgcgcataataggtgtaccagataacgaacgccgaccccgatgacgatcgccacgatcgacgcggcccattgcgcgcccgccccgtccaacccgtccgacccccgccggcccgcaacaattcacccgcaattcatatggaaacttggtatgccggaaacggcactttacgatatatatgaacacgacgtcaggagtccccatgaacgacagcatcgcagccaaacccgccgatgccccagcagacagtacagcggccggcacagagccggccctcaccgccaccgcgaaactcaccccgcgcgagaagaaatggatcatctacgacgtgggcaactccgcgttcgtgctgctgtccaccgcggtgattccgatctacgcgaaatcgctgatgcccgcggacggcaacatcgtgtcggcctggggctacgcgcagaccatcgcatcgctggtcatcgcgctgctcatgccgctgctcggctcgattgccgacgtgcagggcatgaaaatcaagttcttcctcggcttcttcggcaccggcgtcgtcacgtgctgcgcgatggcgcttccactgacgtggctgccgttcctggtcgtgtatatcctcgcgacgatcggactcaacggctcgctcacgttctacgattcgatgctgatcgacaccacgccgaacgaacgcatggacaaggtctcctcgcatggctacggctggggctacatcggctcgaccgtgccgttcatcgtgtgcatcgcgttgatcttcggcggcccggcgctgccattcggctggacgacgaccggctgcacccgcgcatcgttcatcatcaccgccgtctggtgggtcgcgttcacgatcccgctgatctccagctaccgtcaggagcattaccgcgccacacgcgaccagctgggaacggccgtgcgcggcaccttccgcgagcttggcggcaccttccgcaagatagtgaggaacaagccgctgtggatgttcatgctcgcgttcttcttctacatcgatgcggtgaacacggtgatctcgatgagcacctcgtacggcgccgagctgggcatcgactcgactcagctggtggtggcgctgctggtcacgcagttcgtggcgttcccatgcgcgatcctgtacgggcggatggccgggcggttcggctgcaaggcgatgatcgtggcggcggtcgtggcctacatgtgcatcgtgttcttcgccgcgttcttcctcgtgtcggccgcgcagttctggatcctggcgatcctcgtcggcatgttccagggcggcatccaagcgctgagccgctcgtattacggcaagatcatccccaaggaccacgccaacgagtactacggcttctacgacatcttcggcaagaccgcgagcattctgggcacgttcctcgtggccaccaccacgtcgatcaccggcaacgcctccctcggcgtgctttccatcgccatcctgctggtgttggcgctcatcttcctgctcctgcagaaggacccaacgcaagcgtaatgtcacccatcaatcagcaacaggaacgccgaagcagcgataaaacggcataccctaccgcccgagccgcgacctgaaacaatttagccctgcacaacgcacatattttgacagggtggtagttgtcgcaaattctgcgacaactaccgttggtaaatcgaacgctataatcagaaactttcagatgctgagttccatgcaataccccctgtgaccgcaatgcgggcaggtaagcttgcgtgtcttgggcgtgtgtgcggcgaatacgaactctcgcatacccggctggaaggtctcatggcaagccggacataggtactgcacgcgggagcgatagtacttcatcgccgcaacagtgagcgcaatcgccagcagaacggcgaccggcagcggccaccatacgtctgtcatcacaccaatgacgaggcatgcaatttgcaacaaagtcgcgggcaatgtgattgccagcatgaccaaatatgtggtgcgcagggaatgagtggttgtggtgttcataacggttgccatgtcggttaatgttgacgatacgaagtcagacgccgagaccgtcagtgctttgcgcagctgcaagcagtcatcaagacgttgcttctgctcggcgatacccgactgcaaggatgccgtctgctgatccagcaaatcaaccagcacccgttccggccgctcgtccgacagaatcgagcgaatctgctctagcttgaagccgagtcctttgagaaaaaggatgacccgcatccgctcgacctctgcagtcccatacagccttcggccgccgtcgctgatctcattgggaatcaacagacctttggcgtcgtagtactgcacggttcgcacactcacaccagtgagtttggcgatgtcccctgtggtgtatcggctgtccgtttcatcgtccatcgacatggcccaacctcctttcaccaagcaatatgccgcattacgcaacgtcacaagcaacatatgacgcaacgtcgaccacaaaaccttcacatataagcggactgtagaaagacatcgaccatcgcaattgtgcactggttcacagtgaataccccgaaccagttagacggcagaacagaattacagccacacctgttcttcaggctttacctcgccgaccacattggccacacgcatggcatcattccgactcaatctaccggtgaacccctgtagatccgaccggaggaaccgcaccagctgcgcgcagcgagcggtcgtcagatgggtaagcccggcatgctcatactcgggcagttgcacatcgcccgccccatgccaggttggattgctggtcagtttcacagccactccaccgtcgtcgtcggcttgtatgacgatggcggccacgtaatggctgcgtgatttcgtcggatcatcctcgaaccgcacccgcatgcgatacacgtcgaagacatgcaattgctccggaaccggcatcaattccggaatatcatgattattcgccatcacgccacgccttgggcagtacggcaacaccgtcggcgccccggcttggattcaacaccatggcgttcggcacttcgaccaccggatacccctgttcgtcgaccccacggtacgtaaccccattggcggcaacatgtcccgcgtgaggcagcacgggttcaggcgccttcacctcgaacggaatacgacgctgcgacaccaactgcacgctggccatattcacgaacgtattgaaattcaatcccatggaatcaagaatggcgttcacttcggctttgagatcatcatccatgcgaacagtggtagtgctcataatgaatcctttctaaagccaattgtattactaatgacttcttttctcaatataatccgtaggatgcttaacgcttttgcatcatgaccttgacatcgggacaatcccacgcgaaaccaatctctgcctttgcgctcatcagctggggagctcacggtcacactcatgcgtcgcagaccacgagcctcgctcggcgtgctgtctatcgcggtgctgctgctggtcgtggcgctcgtgttcctgcttctgcagaaggatccgacgcgagactagagacgcctgctaagagcgggccgcatgcgacccgatgaaggcgcgtacggtatccatgtactcgtccatgcgcaccaacagcgcgagatgaccgccgtcaccatgtcggcgtgcgacgcagcatcgatcagcaaatcggccatatgccgctgatacggcttgctcagcaactgcttgaggacatcgcacaggccctgcatcagccgccgttcgccagacgacaggtcttgcgtcttgcgcatcacggcccacgccatcagacgccggtgcagcggcatcgatatcaggcgaagcgtccgcttccacttgcgatggcacgcgccagttcggcgttcgtcgcgaaccgctcctgataatcgaaggtgatgaccgagcggtcctcgacgaaccgttcaaaatgcaggcagaacagtcggacagcccgattccgcccggcaggagcacaatcgttgcgcgggcggagggattgcgatgataccggtatgcgaagggttcgccatccggcaatcgcatggtttgcaacggataccgctcacgagacgcggcgagatcatccatcggccgtcctttccttgctatttcgtccgcccgggctgcccggcgccttgtccgtcgtcgttgcgcctgcgataatccttgaccagctggatgatgaggctcgctatgacgcacagcacgccgccgatcggccacggcagccagaacaggcccacggagctccagtcgtcatgcagcatccacggccccagaaacagtaggcacagggcggttatcgtggccagcgacatgatgatgccgcataccgcaccggtcagattgtcgtagaaatcatgcccggctgcacgctctttcttgccatcggtatcggccttcttgttgtagccgtcgatgtcgagcatgccgtgccgtattccgcagtaaacgaaactgaagacggcgaccgagtacagcatcagcatgatcgcgttcggccatccatcgctgatgcccaacacgtcatcggcgtacacagtcaccgctatgccgatcaggattgccgctataccgcccacgatgccgaccaccagcagacgcgtctcgcggctgcgatcctcatcggtgtagaaatcctcgatatacggatggcggcgtttgaactcggcgtgcgacatgccgcccgggaccagcatcgccagcccggcgatcacacctatgcagatgcacaggaacgtgaggaagtcattgagccgcgtcacgccgaggatggagttgcttgaatcgaacagattgcagataccgaccgccgcgatgatcgccgcaacgccgccggagatgagcagcgcgaaccggcggcgatgctcgtcgtagccggtcaggtcctgcggcagggtggccgtattggcgtgcacggcggggcggggcgaaccggttccgtacggtgtctcgccggtcggcacgcccgtgaggcttggctcgatggcaccggccgcaccgagatgcgcgggctcgtcggcgtcgcctatacttcccttcgcgttccccgcatgtgcagggctcccggcatcttcaccggtcctgcctccgacagtcgtgccgcagcctgttgccgatgcgccgtgcgagtccggccggctggtgctcacgctcacgtcgccgagcacgaggtcgtcgagcgtgcagccaaacagatcgcagatcatgagcagcttgtccatttcggggtaggccttctcggattcccatttcgaaatagcctgccgcgagacgccgagcagcatggccagtcgctcctgggtcatgttgcgttgggcgcgcaggtattgcaggttggtgcggaagctcatcgtcaaatcccttctcaagtgattccatcatgtcatgttcggccgatgaccccactatggcacgccgtccacgccatccgccaccatcttacggttgcaatcgccgaccatgccccgcaaccgtgcgcaaccacaggttgcatcggcggaatcccgccgttttgatgtcctatatcacaatcctcacgaagtcgattttccccgcctcaaccgccgccatgccgtatcgaggtcgagcgagcggcccggcagcttgggccaggtgtccaatccgtccccatatctgtgcgggattaagtgcacgtggaaatgcatcaccgactgcgtcccatgatgacccttcccggtggcaagatatgcaacgaatcgtcctcaatgatacaggcgcgagtatgataccgggccaatcgggcatcaagcgaaagcaagtctcgggattccgggaatccgcatcatgcgcacttgtgcgggaatatgagtcatcctcgcacaaacatcatcgagaacgatcaccgcactatgcgtcgtacgaatcatcatcacgcaccgaatcatcgtcgtcgggcatgaccgcgacggtcctgacctcggttttcagcaggtacttctcggcgaagtccaatgtggtggacaccatcacaacccccttcttgacgtgcgaaccatcgatatggcaccggcgaagccccttgccgccggcacccaccatcgaagcacgtcgcagggcgcgacacaagaccgcgggcatatgaaaaaactatggctcgctcaaccgacgctctcaaaactcgcagatacaggccgtcatcgggcagctgggccagatacgggcgcagaccggtaccgcgataccagtcgaggatcgcctcatacccaggcagcgcatggtagtagttcgtctcccacgcgtcgacgtgcgcggagagcggggcgagcagatcatagtatgcgcttacgtcgaaattgtcgccgccgagattgtagtagcggcgtatctcgctgatccactgccgccatttcggctcgcacgcggtctcgcgcatgatgatgtgcggcggcaggttgatgttctcggtgaattgcgccgacgcgacgccgccggcgttaagccgtcgcagcatggagggcagcacccgttcatgattcggcacccattgcaggcaggcgttggagaagactacatcgaaatcggtgtcgagctcgtcgagcgacccggcgtccagcacatcgaaatcgcagtcggggcggagcttgcgcgccgaggcgatcatgtccggagagctgtcgatgccgaggatcctcgcctgcgggtataggctcgaaaaaacaagaaacgcccctcccggaaggagggacgttctgttctgtggagctaaggggattcgaacccctgaccctctccatgccatggagatgcgctaccagctgcgccatagccccgaaaaccgaccaccgtagcggccgtgggtgatgtaggaatcgaacctacgaccccttccgtgtgaaggaagtgcgctagccgctgcgccaatcacccagtgcacaccgaagtgaacttcggcatccgtgggcgatacaagattcgaacttgtgaccccttccgtgtcagggaagtgcgctacctctgcgccaaccgcccgggtctgcgtgccgaccggccgaatcgcttcagccagccgaatctgcgagcggacaacgggactcggacccgcggtctcaaccttggcaaggttgcgctttaccaactaagctatgtccgcaatgtcaccttgacaggcaacaggggaatacattacccgaccgcctgtacaaacgggacaaaaatcgcgacacgcctgaaattccgcggaatcggtcaccgctctttgttgctgacgggcagccccccccccaaaaaaaaatggcatttatgaacagcaggttgcacacaccgaacgccacggtgttggcccgcgtgcccttgtagatgccccaactcatcaccgtcatcgggctcatccatgccagcgggagcaacgtccatcccaacgcgaccatcgagatgatgttgaggatgaatgcagcgagacgcaggttgcggtcgccattcgtcatcgggtacgcgcccggcgaatacggttgccgtccggcgtcacctgctgcgccggcgcgaaatcaccggtccattcctcgccatcccaccaacgcatcagcgagggatcgcccgatgggtccggataccagcccggcggcatgttcatgattgctcccgtccggctcgggccacttcgctccggctcatgccgctcgcctgtatctcgcccgcgcctcgcctattccgcccgtcaccttcatcggccacgaatcaccgcgccgcgccaccgaaggcgcgatactggcaaacctgcccccatcgtacagccccggccacgcgcgacgcacataatgcgacatcatcgcgccgcatgctcggtgtccctcccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccgcgggctgctgcgccttgatgtcaatctccagcgagcgcggataccgtttgacgacgttcgcctgggttacgccggggatgttcttcagctgcgagctgaccttgtctgcggagaccaggaacagcgatctgccggattgctggttcgcgatatccagcacatccttctcgctcacccattcgttgccgccgctgacgctgatctgcgaggtttccaaacggaacacggatgagaacaacagaagccagatcagcgcggacaccagcgccgcggccaatatcacaatcagcacgcggatggcggcgacccgggtgcccgccttcttccgctccttcaggcgcgcgtcgaaatccagcactttgggacgggtcgccacgccgagcacgccgacgttctcatcgagcgtcttcttgaccacatcctcgctgtgcaggcgacgcgcgtcgacgaaaccttcggcgcgtgataccgaccgggacgaggacgacgaaacgctccgggacgccgtctttccgaacctcgattttcgggagactgttttcccgccctttacctgtcgggaagtctctttttctaaggccttttccgacttcctgccggacgtcatctgccggcccgtcgccttcccgaccgtggttctccccggcgacgcctctccggatgcagccttccgggacacgtcattcgacgcggtgcgaggctttttcctggtctggcgttcccgtgtcacggcgacgcgattggcttcggcacccgacgatgaggccctgtctgccgtcgtgcgcggcttgcgcgagccggacccttgcccggcctcacgaccggcatcgccatgtgaggaaacgacccgccgtgccatcagcggtcaccgagattgtgccgggcccccagtgcgtgcaggatcaccgcgcccatggcggtaatgtcccccgcgccgacggtgaacaccacgtccgtgggacggcagcgcatcgccagcatctgagccgccacctgcatgtcgtcgaccgcgctgatccacgtcccgtcgccctgcgccgaagcgtgcggcacgtcctgcgcggcatcgacgatggtcatggcggaaacgtccgggaagtcccgctgcagttcgcgtgcggggaagatgccggtgacgatgacgtcatcggccttggacagcgcctcggcgaactcgtgggcgaacgtacgcgtgcgcgagaacaggtgcggctggaacagcacccggatgacggaacgcgggtaccggcgccgggcggcgtcgagcagcgcgctgatctccgtgggatgatgcgcgtaatcgtcgaccaccgtcacgccgttctcctcgccgcgcatctggaaccggcgcgaggctccgaggaacgtcgaggcggcctgggctgcggcctcgggtgtcacgcccaacagcatcgcggccaggatggccgcggtcgcgttgcgcgcgttgtgcatgcctgggatggcgaggctgaccggcaacgccagatcggcgtcgccgcagccgcagaccgacgcgagtgacgccggcacatggacggtgaaggtctcccggccgctgtcggcgctctcatgctcggcatcgatgcgcaccagcgtggcgccgcgcaggtccccgatctggtcggcatccttggtggcgtacacgatcgttcgacgggccacggacgggtcgaggtcgcgcagcacggccacggcaccctcgtcatcgcccgtcatgacgacatgtccgcttgcatgccccgcatggtcgacgaacgcggcgcagtaatgcgcctcgtcgccataatggtcgagatggtctgcgagcgcgttcgtgatcaccgcgatcgagggacggtacttgcagaagctgccgtcggattcgtccgcctccgcgaccaatacgtcgccgcgtccggcatgcccgccgtccagtaccgctcccccgggtgcctggatggtgccgccgatggcgtagctgggatcggccagcttcccggttccggcatggacgaggatgtgggatagcagcgaacttgtcgtggtcttgccatgcgctccggcgacggtgaccgcccggcggccgttcatcagcaacgccaggatgtcgctgcgatgcacgatgcggatgccccgctcgtgcgccgcgacgatttcggggttgtcgggcttgatggcgctggagtacaccacggtgtcggcaccacgcacgttgtcggcctgctggccgatttcgacggtgatgccgagggatcgcagccgttcggtcttcgagccttcctcacggtcggaaccgtcgacgtcgacgccacgctcatggagcatttcggcgagcacgctcataccggcgccaccgatgccgatgaaatgggtccttcccagttgcaacaccgtcgcgtcgggcgcgaacgcgaccctcatcgggtcgaggacgataggggtggcattggtttgcgcttcagacactgcagattctccttgatgattcatgctggtcaccattatggtcatacccgacgccaatcagagcgccgcattacgccagttcaagcacgcgacgggccatggtgtcggcggcgtcgcgaatgccgtactcccatgccttgtcgcccagctcgcgcagccggtccggttcggcgagcagcgacggcacatgggactgcacccactgcgcggtgaaatccttgtcggccaccatcagcccgccgccggccttgaccacgggaagcgcgttgaaccgctgctccccgttgccgatcggcaacgggacatacaccgcaggcaggcccagggcggcgagctcggacaccgatcccgccccggaccggcaaatcaccaggtcggcgcatgcgaacgccagatcgatgcgttccagatattcggccgcatgatagtcgcccttgccgtatgaatcagggcccacaccggtgaagaccccggcattggcgcgctctcccaccaacgagcgcacttcgtcgatcttgcccttgccggtcagatggacgacctgcgcgtgttcgagcagcaccgcggcactggatgccaccgccctgttcaggctgaccgcgcccagcgaccctccggtgaccagcaccatgggacgcgctgggtcgatgcccatcgcctcggcccccgactggcgcacggacgcgcgatcggacgcgaactgcgccgcgagcgtgctgatcgccggccgcaacggcagcccgacgcgctccatacggcacccggatcccggcttgaggccggtgttctcgtacgccgtaccgatgaacgcagcgtaacgcgcgccgagcttgttggccatgccggctcgggcgttctgctcatggatgacgacgggtatgcccatcctgtgcgccgcggaatacaccggagccgaggcatagccgccgaatccgaccacgacgtccgcgtgacgcgaacgcaggatatcgcggaccttgctggtctcgcgcatccacttggccggaaactggagcgcggccttgttggggcgccgcgggaacgggaccttttcgatggtgtccagctcataaccggcacggggaacaaggtcgtgctccagtcctacggccgtgccgatgatgctgatggaagcctcgggccggatacggcgaatcgcatccgccacggccagcaacgggttgacatgaccggcggtgccgccgcctgccagaacgatatgcacaggtgatgaactcataatctccgagcttagcgtgagtgatgaaaaaacgcggcttcgtcaagccgactttgacatatttcgccctgttggaagggccttatggccaccccagctggcttcgccgacagccccgcctccggtcaggcgcgggacgaatcggccttgatctgaggttgggcgcgcatgagcgaggcggccacgccggccgccgccagacacatgatcagggacgacccgcccgccgagacgaacggcatcggcacgcccatgacggggaaaaccccgaccacgacgccgatgttgatcagcgcctgcccgacaagccacacggtgatgcacagcaggctgaccgacgcgtaacggtccgcggtctgcagggccacgctgatcatgcatcctcccagcaccacgaacagtatgatgacgatggccgctccgatgaaaccggtctcctcgccgatgatggcgaagatgaaatcattgtgcgcctccggcagatagttccatttctcgcgggagttgcccaagcctaccccgaacagaccgccttcggccaaggcgtatttcgcgtgtatcgactggtagcagaccttttgggcatcggtgccgctgcactcctggtacgcggccagaacgcggttcagcctgttcggactgtatgcgatcaatcccacgatgccgatgatgcccagggcggcaaaggccgcaaggaccttgcctggatatcctcccagaagaaacgcgacgaatccgatgaacaggacgatcatggccgtgcccagatccttgcccaacatcacgaatcccaggcacaggagatacagaaccgtcaggggggcgtatgcccgcaacttgccgatcttaccgctgtgtttcttcgcccagtgcagggccgccggaagccatatgcacaaggcgagcttcatcacctcggccggctgcatcgtgaacacgccgcgcttgccgatccagccggcattgccgttgacctcgacgccgagcggcgtgaacgtcagcagctgcagcagcatcgcgaataacaccacggcgaagctgaaacgcctgtacatacgagccggaaggcacatgaaaaccacgcccacgaccagacccatcacgcagtacatgccctggctgatggcctgcgagaacggcgatcggccggcggagaccatcgacacggtggaactggagaacaccatgatcacgccgaagccggtgagcaccacaacggcggcccggaagccgtgatagcaccacagcgggttgagcaggctgcgcagtccggtgaacctgccgagccgttgggcgtcacgctcttcgacccgccgagcttcggccagtcgggaggcggacgaatcctgccccgtgcgtctgcccgtgccagtgcccgcgcccgcggaaccagcatccgaccgcgaaggctggccggatcttacggagcgggcgcgtcgccgcggatcgtcacttgccatgctgcgtcacccatcgtgaggactcccgcgcgaactgggtgccgcggtccgcgtaggagacgaactggtccatggaggcgcaggcgggtgccatcagcaccacgtcacctgtgccggcgtatgcgcctgcggcatcgaccgcgcgcgccatcaccgtgtccgagggctcgggctcgatcacggtaagaggaatgccgggtgcgctggcggcgaacgcctcaagcatcggcttctggtccttgccgatgatgacggccgccttaatcgtatgcgcctgatccgccacgagctgttcgaaacggcttcccttggcgagtcctccggcgatccacaccacgctcttgggggcgaagctgctcagcgacgcccgcgccgcgtgggcgttcgtcgccttcgaatcgtcgatgaagcgtatcgagccgccgtcgcccgtcgcggccgtcgccaccgtctggatgcgatggccgccgggggcgaacgccttcagcgcggccaacgccttatcgaggtccacgcccattcccagcgccaacgccagcgcggtcatcgcgtcggcgagcaggtgcgggtacacggtgccgtccggctcacacaggtgggggaactcctggaccggcgccaggcgggtctcatcgccgaatgcgccgccggccacgccgctgcggtcgacgatccagccgtcgtccacgccgatctggccgggctggggaacgccgagtgtgaatccgatgtgccggcatccctcggcggtatgcgccgccgaggcgagcgcgctgacgcgccggtcgtcggcgttgaacaccagggcgcgcctgacgttgcgaaacaccttcgacttgtcggcggcgtacgcttcgatgccgccatgccagtcgagatggtcgtcggcgatgttcgtgatcgccgcgcaatccagcgccagcgaatcggtgaaatgcagctggaacgagctgagctccacgcacagcgcgtcgttgtccggatcgaccgcggcgtgggacaccgccttgccgatgttgccgaccgccggtgcaacgaggccatcggcgcacagcatggccgaggtcatctcggtcgtggacgtcttgccgttcgtgccggtgatgcccacccacggggcggggcggccggtgcgggcgctgtccacgcgcagccgccacgcgagctcgacctcgctgtacacggggatgcctcggcgttgggcttcgaggatgaacggcgtgcgcgggttgaacaccggcgacgtcatgacgatgtcggccgaatcccagtcgatgtcgtcgaacgaatgcaggtcggcctccggcttatgctcgtccacgccgattacccgcgctgcgcgggaacgcagcacttccatcatgctgcggccggatatacccagaccggccaccagaacggtcttgtcactgagatccatatcgtctcccttgtcattgcgccgccgaaccggcggacgctctcatgcgaacctgcctataccgcggcggtcacgccacgctgtgcggcgcggagccgtcacggtaccgttcagacaaacagcaacccggatcgggacacccaatcgacgtagaacatcatcaggcccacgatcatgaacaggaactcgatcatccagaagcgcacgacgacctttgattcgctccacccgagaagctcgaaatgatggtggatcggcgccatcttgaacacgcgcttgtgcgtgagcttgaacgaggtgacctggatgatgtcgctcatcacctcgattacgtacaggccgccgatgatgatggcgaggaattcggtgtgtgtggcgatggacagcgcggcgaacaggccgccgagcgccagcgaaccggtgtcgcccatgaagatcgtcgccgggttcgagttgtaccacaggaatccgaagcaggcgacggccgcacagcaggcgatgatggtcaggtcgagcggatcggacaccgcatacgagaacccttcgtgcgtgccgcccttgatatggtagctttcccagaacgcgatgatggcgtatccggcgaacgcgatcatcgacgaaccggatgccaggccgtcaaggccgtcggtcaggttgaccgcgttcgtccacgcggtcatgaggaaattcacccagatgacgaatatgatcgcggcgaccacgccgccggcgaaccggaagtcgaagaacggcttctcaatgaagctcatgcctgcctgagcgctggggaaccccgatttggtggggatgatcagcgcgaggaccgcgtagatcgtggcgaagatgaactggccgatgaacttggcatgcaccgacaggcccagattctgttttttgcgcaccttggcgaagtcgtcgatgaagccgagcaggcccatcgacagcatcgcgaacagcacaagcatcgcggacagggagggaaccgctcccgagcggacgtaacggtacagtgccgacgccccccatccgagcacgatcgccagcacgattgctacgccgcccatggtcggggtgccgcgcttgaccagatgcgacttcggcccgtcctgacggatgtactgcccgtagtgcagccgatgcaccagatggatcagcatcggcgtgcccgcgatggtcaccagaagcgagaccagaatgccaatgattaacgcgatcaactcagattcctcgcttcctattcgtggtcggacggctgtccgtccgctgtcgtccatcgttgcgccagggcgctcaggcccgaggcgtgcgaccccttcagcagcacaaccgtgtcgtcatggtctccggcaagagctcggaccaaggtgtcggcctgatcgatgtcgtgaacccaatgcacctccggcgtgttgccgtcactgtcgtcacgccgcttccgcgcgcccttcgcaagggcggaagccagcgcgtcgaaatgctcgtcatcgttgcccaccgcgatgacggcgtcgatgggcaggccggccgcgtactcgccgatgccctcatgcagcgcggactcgtcaccgcccagctccagcatcgctcccagcaccgcgatacggtacgggtcttcaccggaacgccaccgggcgagcccgtcgagaccggctcgcatggagtcggggttggcgttgaatgaatcatcgatcagtgtgaaagacatcccgccgcgccggaccgtggacaccgccatgcggtgcgggctgatgcgggactgacgcgacagcgtctcggcgatcgactgcagcggcacgcccagcaggtgggcgacgctcgccgcggcgagggcgttcatcacgttgtgcgtgccgcgaatcgccagttgcacatgggcggttccgccatcggcccgctccaaggtgaacgaggggcggtcgccgtcgtcggtccgcacgtcgctggcgaacagtgcgtccgacttcccggatgcggcgttgccggcgctggcttcggcgtcgtcgccggccatgccgaaccagaatacgtgtccttgcggcgccaggggggccatcgccgccacatgggcgtcgtcggcgttgagcaccgccagcccatcgggaaccagcccctggacgatctcgcttttcgcctgcgcgatgcgctcgacggagccgaattcgccgagatgggcgcatccgaccttgagcacgacggcgatgtccggaggggcgatcgtggtcaggcgcgtaatctctccgacatggctcgctcccatctcggcgacgaagaagcgcgtgtcccggccgaccttcaacgcggtcagaggaaggccgatctcgttgttgaacgagccgacgggcgccacggtggggccgagcgtggacagcagggcggccatgaggtccttggtggtggtcttgcccaccgagccggtgatgccgatcagggtgaacggcgttccgaccgcacgccgcgcggcgatgttcgccttcgcgagcaggcccagcgcgtcgaccgtatcgggaacgactatctgcgccaccggcgcgtccacttcatgttgtacgagcgccacgaccgcgccggattcaccggcgcgagcgacgaaatcatgaccgtccacacgctcgccggcgatcgccacgaacacggagccctcacggacctggcgcgaatcgctgaccgccgacgtggccagtgcatcggctccgtcttcgacgccgtcgcccgtctgcgggacgatcagcctgccttggaccgcctcggccacctgccgaacggtcataggcatcatcgttgcctctgcgttcatgccttgttttcctctccatgagccaattcgtgagatacgcgcagcgcactgcgaatgttgtttctgcgaatccccgccgccataaccatggcaatggcgagcgacaattcacggatactgtcgcggtccgaggcgaacggggcctgcgccgcgagcaggtcggattgcgcgtcggcacgggcgacgtgggtctgctcgtcgacttcgaagccgaagcccgcccccagctgccgcgcctgtgcgaggtcgtcccgggcgtcgccagccgacccggcgggctcctccccgctcgcccactgcccggacggagatgccgcttcgccgccttcgccagcacgcgaatcctcgccggtgccgctcggcgtcggctggcgcaggtctcgtgccgagtccaggccgatgacgtcgacgttcacgctggtcagcgcatcggatttgagtgtacggtcgttgagcgcgaacaccatcgccgccgcgccgtcctccgcgcagaccgacagcgtctgctgcacgtcgagtatcgacagcgggtaggtcaggtcgagctcgcgctccagcgacgtcgagccggatgatttcacgacgccgacaggattgcccagcatgtgcaggaaatccgctacgcatgacgcgtaccgttcactgcgtttcgggtcatccgagccaactacgaaaatggcgagtgcgttggacggggtgcccgcgatgtcgctggcgatgtcgcccagctgccgggacgtcaggcgcgcgcgcagcagtggcatctgcgcggggccgtcctcgtgcttcatcgacggggggaccagcgcagcgtacgcgccgcgggcccgggcctcctccagccgcttgacgtccacgctctgcgcgggaacatacagggatccgggagccacggaatcgacgtcgtccgcgatggatgtgacggtgacgcccgaagcgaagtccgggtcgagttccagcccgtacgtgtcggccagatatcccaacgtcatccgccgcgcgacggcttcactgactgcgctcatcgcttccgcctttcttccgtatgttccttgtcgacgccccgccggatttccggcgcggccccttaccagtccactgcaatagcatcgttgcgcgggctggaggtcggcacgttgtacttctgcataaggaattcaccaatcttggcgaacaccgggccagccgtcatgccgccgtaggtgccctgcgggtccttcatgatcacggtgatggcgaagcgcgggttgtccgccgggatcattccggcgaaatcggcgacgatcgaggtcagccggccgtcgcttcccgcgacctcggcggtaccggtcttcgccgcgatgcggtatcccttgacgttcaccaccttgctgtatccctcggccacggattccatggcgttcttgacctggtcggcgaccgactcgtcgatgacgcgcgtggaagagccctcctgcggcgtctccaccgtgccgtcggcgtgggtgaccgacttgatcagcgactgctgcttgcgcacgcccttgttgccgatggtcgcgacgacgttggtcagctggagcgcgttcacggagtatccctggccgaacaggatcgtgttgctggttcgcccgtcccacgattccggcgtgccgagctgcccgcgcgactcgcccgggatggacatgccgctggactggccgatgccgaacttcgtgaggtactcgtaccgctgcttcttcgtgtactgcgacgaagccatgaccacgcccacgttcgaggagttcttgatgatgccggccagagtccagtgctcgtcgccgtgcgcggacgagtcatggtattcctgcccgtccttggtgtacgaatagggaacagtgaacttgtcggtcgccttgtgcagtccggtctgcagcagtccggacatcgtgatgaccttgcccaccgagcccggttcgaagctttcgctgacggcgcgagacgcgttcagcttggcctggtcgctgcccgcctggtattcgtcggtgtcctccagggccagtatctcgccggtctggatgtcctggaccaccgccatggcccacgtcgccttggtcttcttctggccttccagcaacgcctgcttgacgtaccagtcgacgtcatggtccagcgtcagcgccacgtcggagccgttcacggcctcttgggaaccggtcagcgtgccggggatctcctcgccgccgttaccttgctggtagatgacgtaaccgtccgtgccggtcagcgcggagttctccatgctttccactccggcgacgcccttgccggaatcgtccacgccgccgagcagcgcgccgagctgggtgccgttggcgtagatgcgctgactgctcaactcgccatagaccacgccacccagattcaggtcgtcgatggcccgcttgaccgtcggcgtcacgtccttcttcaggatcatgtaccggctggtgccggtcagtttggcgccgagcgtcttcgcgtccatcttcagcacgggtgccagcagacgggccacgcccgcggatcccttgaccccgaccggcttgccgttgaccttgtggcagaatccggcctgcttcgccttctgcgtgtcgcagtcgatcggctcgaactgcgaggccgcccacgggtcggcgatgatcgtgtatcgctcgacgctctgcgccagcacggtgccgttcgtgtcggtgatcttgccgcgcatcgagtggacgatcaccttcttggtccgggcctgggtcgccgcctgtgcggccatctggccgtctatcagctggatggaggccagcttgaacaggcatgcggaggcgaccatcgcgagtatgacgccgatggcgatgcactggaagaggaacttgcggcatctggcgaaccgtatcattgcggttattcggccgatcattgagcggaccccttactgggtttgtacccgttgagatcgatggtgacggaatcctgctggggcaccatgcccatcttctgtgccttgtcgggcagcgacgagatcagctcgtcaagtttcgcctgatcgtcctgcacgtcctgggtgagcatgttgatgttgttttgcaccgtgttggattcgaaagagttctgaaccatctgcgtgcgcagcatcagggttatcagcaacgtggcgaccaggaagacgatggcgaccgtgacatggatcagtgacgcgccgcgcgcctgggtccaggcgatgatacgggccaggctgccggtggaccgggagccgttgcgctgggaggagccgtcgatgacgtgcagctgcgggcgggcggcggggcgtgcggcgccatccgagccgcgccccgccggtgccacgggcgccgcgttggagcgggcggttcgcaatgtcgaggccatcatcccctccttctcgatgtcgtgtttcgtgccgtcatgtcgtcatgtctgccgcggccaccgtgtctgccgcggttttcacccgcgtcccgggccgactcatggtcccgggcgacttgcgcgttctgccggaagcgctggcgccagcgcgcaggcaggggcctgaccagctcgacgccgcgcaggcgcaccgacgccgacctgggattggctgcgatctcatccggcccggcctggacggcgccgcgcgtcagcggcgcgaagaacggctgcgcgtcgtcggggatgaccggcatgtcggccggcgcgtccacgcgcagtccttcgttcatgaacgacttcaccgtcttgtcttccaatgagtgatacgactcgaccaccaggcggccgttcggggcgagccggcaggctatctgcggcagggtgccggcgagcttgtccagttcgccgttcacttcgatgcgcaatgcctggaacacgcgcttggcggggtttccggcgggacggtgcgcctgcggcaccacctcgtcgacgagcctgttgagctgggcggacgtcgtcagaggttcctgcgcgcgacggcgcacgatctcgcgggcgatctggcgggagaaccgttcctccccgtatgcgcggaatatgcgtaccagctcgcgctcggggtactcggccaggacgcgttgcgcggtcaggggctggctgacgtccatgcgcatgtcgagcggcgcgtcgtgcgcgtaggagaagccgcggtccgtctcatcgatctgcaggctcgacagacccagatccatgaacaccgcattcacccgatcgatgccctggtcgtcaagcacctggccgaacgcgtcgaatgcggcgtggacaggtatgaagcggtccgaaagtccttccccggcgatgcgctcggtggccatggcgagtgcttccgcatcccggtcgatgcccagcacgcgggcctgcggcgcggctttgaggaaggcgatggtgtggccggccagaccgagcgtgcagtcgaccgcgatggatccggggtcctgcaacgccggggcgaccagcgacacgcactgctcaagcagtactggctggtgaatcgaagcataatcagtcatcagaatcccaccaccggaagcacgtcgtcggctatgtcggcatagccttgttccttctcgttcagatatcgttcccaagcctcgcggttccagatctcggcgcgggtgcccacacctatcaccacgatgtcgtcgccgaggttcgcgtagtcgcgcagcatctgcggtaccagcactcgtccctgcttgtccgggtcttggtcgacggctccggacaggaacacgcgcaggtagtcgcgtgcggccttgtcgcccatcgacgtgtgctggatctggatggcgatgcgacggaactccgattgcggcaggaggtagacgcaccgttcctggccgcgcgccatgacgagtcccgcgccaagctgggaacggagcttggcaggcagggccatgcggcccttcgcgtcgattttcggggtgtacgtgcccagcaacagcgggggcagggccatcggctccggctgtgcggaggggttcgtggcgttctggacttgcgagtcgtctgccaacgttccacctcctaaccgtgaatccggatacaccaatccaccactgtaccccacttctcaccacaaatccccacgaaatggtttttccacatagttttaatgcgtatcctccacaaccgcttcggagcgccgttgcggcaggacacatccacacggcttcgtattgcccttgcgctacatttgaatgcctgagttttcaccgagagaacggacatcaatgccgggattatcaacgcaactgcacgaggaacagcaagcggtcgaccgcgcatacgcccgcttggacgccctgcgatcgcagacgcgcacgcggttggatacggtacgtgcggccggctcgcacgggtcccccacccagcgcacggaacgcgactcgttcgccaccatgtacgaggaccggctcacccagctgcgcgccatggaagaccgtctggtgttcggccgactcgatgacgtgaagggcgagcgccggtacataggccgcatcggcctgtccagcgagaaccacgagccgatactgaccgactggcgcgccgaggcggcccgcccgttctacgaggcgacgccatccaaccacggcgacatcgtcatgcgccgccatatcacactgaacttccgcgatgtcatcggcatcgaggacgaggtgctcgacgtccattccgagcaggtggacaaggcctcgaaggccgggacgctcaccggcgaaggcgccctgctggcatcgctcagttcgcgccgaaccggcaagatgacggacatcgtcgccacgatccaggcggagcaggaccgcatcatccgctcagatctcaacagggctctggtggtgcagggcgggcccggcaccggcaagaccgcggtcgcgctgcaccgcgccgcatacctgctgtacacgcaccggcgcaagctggagcgctccggcgtgctggtcatcggcccgagcacgacgttcctgcactacatcgaccaggtgctgccctcgctcggcgagacgggcgtcgtcagccgcaccatcgccgacctcatcccgggcatcaaggcgaccgcgacggacactccgctcgccgccaagctcaagggcgaccgtcgcatggcgcaggtcgtggccaacgccatcgcgctgcgcgaacgggttccgcaggacctgcccaccgtgcacgtgaacggcttcgcggtccgcatgctcgacaccgatgtcagggcggccatcgaccaggcgaagcgcacgcgccagccgcacaacaaggcgcgggagaccttcgtgcggaccatgctgatggcgcttcgggaccgttacgccgagcagctggactatacgccgtccgacgacgagctgaacgaggcgctgacgaaccttcgcctgaacgacaaggtgagggtcacgctgaacctcgcgtggctgccgatgaacggcacgtggctgatcgacaacctgtggtcccatccgctccgtcttcgcgcgctcgcgccgtggcttgacgacgatggcatcgccgcgctcacccgccccaagggcgccccgatgacgcaatcggacgtgccgctgctggacgaggccatggagcttctggggcccgaccccaagatcgcggcgcagatcgccgccaagaacgcgaagcgcgcccaggaggagcagttcgcgcaggacaccctgaactcggtaggtctcgggtcgggcatcgtctcctcgcagatgctggtcgaccagatgaacggcgagggcggcgagttcatcgcacagcgtgccgcggccgaccgcgagtggacatacgggcatgtggtcgtcgacgaggctcaggaactgaccgcgatggactggcgcatgctgatccgccggtgcccgtcgcgctcgttcaccatcgtcggcgacgtggctcagacgtctgcgctcggcggcacgcgccgctgggaccgcacgatgaaccggctgttcggcgagcggcggtgggatctcaacgagctgaccatcaactaccgcaatccgcaggaggtttcggacctggcctcggacttcgcgcagaaggcgggactgtatatctcgacggtcaacgccgtgcgcacgataccggacgccgtgcgcaggatcatcgtcgacggcgaatccgacacgatcgcgaccgcggcatcgcatgtcgcgcagctagccaagcagttcgtggatgcggacggaaccggtcgcgtagcggtcatcgccccttcccacatgctcgatccgctccgatccactatcttttcaacgcttccgggtacgctgggacagcaagagacggaccggctgtccgagcagcacgagtgggacgcgcagatcagcgtcggttccacggagtcggtcaagggacttgaattcgacgccgtagtggtcgtacagcccggacgtatcgagcaggatgctccctcgcgcctggtggcggcttcggatctctacgtggctatgaccagaccaacgcagcgattggttatagtgcggacaggggaagacgaaacagctttgcagctataaggtaggtaccatggcaaaagctctgttattggaaaacattcacccggatgcggcgcaatcgctgcgcgatcacggtttcgaagtggagacgcgcaagggcgccctgggcgagaaggaactcatcgaggcgcttgacggcgtgagcctgctcggcatacggtccaagacgcccgtgaccgcagcggtcatcgacgcatgcccgtccctgaccgcggtcggatgcttctgcatcggcaccaatcaggtggatctcgattatgcgggcaagcatggcatcggcgtgttcaacgccccgtattccaacacccgttccgtggtggaactggtgatctgcgacatcatctgcctgatgcgccgcattcccgcccacacgcatcacatgcgccatggcttgtgggacaagtccgcttccggctcgcatgaggttcgcggcaagaccttgggcatcatcggatacggcaatatcggctcgcagttgtccgtgctggcggaggctctgggcatgcgcgtcgtgttctacgatatcgaggagaagctggcgatgggcaacgcccaccgttgcgagacccttgacgaactgctggagcagtccgatgcggtgaccctgcatgtggacggccgcaagtccaacactggcttcttcggcgaggaccagttcgcccgcatgaagcagaatgccattttcatcaacctgtcccgcggcttcgtcgccaacctggacgcgttgaagcgtcatctggattccggtcatctttccggcgccgcggtcgatgtgttccccgtcgagccgaagaagagcggcgatccgttcgacaccgatctcgccgacgaggacaacatgattctcaccccgcatatcggcggctcgacgcttgaggcgcagaagtcaatcgggcatttcgtctcgcagcgacttgaggactactgggacaaggggtcgaccatgctttcggtcaaccttccccaggtgacgttggggccgtgcaagagcgctgctcgaatcgcgcatctgcatgccaacctgccgggcgttctcgcccgcgtcaaccatgtgctgggcaaggagaacatcaacatcgctgcgcagtctctcggaaccgagggcgaactcggctacgtggtcactgacgtatcgcagaagcccagccagaccacgctggacgcgctcagccacatcgagggcacgattcgcatgcgcgtgatcagctgaacaagccggtcatcggttttccacacggccccttccgctgttcgatcatggaaggggccggtcgcatatcaggcgtcacatgtcgacgtcggcatcgacatcaacattgattcgtgtcagcgcagtttcgaccagcgcagttccgcttcagcactgcttcgctccggcactgcttcgtttcagcaccgttccgtttcagcaccgttccgtttcagtgctgttccgcctcggcgtgcttttccttgcgcagatcgtctatggctcgctggaagtcctcaagaccatcaaaattctgatacacgctggcgaatcgcaggtaggcgacctcatcgagctcccgtagaggagccaatatcgccttgccgacatcgtccgaatcgacttcggcaagccccctcgccctcagatcctcttcgacgcgctgaccgagtgtgcgtagatcgtcttcgttgatgggccgtccctgacaggccttcctcacgccggacaccaccttctttcggtcgaacggctctacgtttccggaacgcttgcgcaccaacaacatggtgctttccacggtggtgaagcgtttgtggcatatctgacacacacgcctgcgacgaatcgagaacccgtcatcactgattctcgtatcgatgaccttggtatcggaattctgacaataaggacaatgcatgacctcagaatatcgtaagcgttgacaaagccccttccccatgtcaacggtcacgtccgaatccggaagcggccggcggtaaatgccgaagaagcgattcgagaaagcactcatggggacgcaccgctccgaattcgccggaatcagacaatcggcaccttgagctgctgccccacctgcaacgagacaccatcgagatggttgagcgatatcagatcatcgatggtgtcgcgcacatcgcccccatcaggagtgatggccgaggcatatgaccacaaggtgtcccccggctgcacggtatagctgtacactgcggagggatccggcgccgaccgggcgacctgcggcatcagcaggccgatcatgcacaggcacagcagggcgcccatcatcgagaacacgatcttgccgcgaagagtcaaacacatggtcgaatgacccctcttcgccatgcgaacaccatgctcgtcgcacactccgataatcacccgggaatcacgccgtcgcgcatcggaagaatccatattcctcaaaaacgttggaacatcgctgtttttgacatcgaacgccacatcgcgcatcgcatcatgacgacttgatgcacactggagccccgctgccgcaatcatttgttccatcatgtcgccctccttctcgaactcatgtttcatagaacaactgtactcatagtgacacagcggttcgacaaaagcaacacgccatatcgaacgaatgtttgttttcatggaacaaatcacgctatgattgaacgaagatgaaaggagtcgacgtgagcacaccagcacccacctcgaaaaacgccacgcggcaacgcgatgacgccctgaccgaaaggcagcatctggtgcttgatgccatacgcaagcacattgcggaacagggattcgctccgtccttccgagaaatcggcgaagctgtcgggctgaagagcccgtcatcggtcaagcatcagcttcatgcactggagcgcaagggctatcttcatatcagcgccaacaagggccgcgccatcgagttgtatgattccggcacggactcgcaaaccgccacggtactccccttccccggggacacggaggccagcgagtcgattctcgcatcccgtgacgtcccgctggtcgggcgcatcgccgccggcgtcccgattaccgccgaacagcacatcgatgatgtcatgcggctaccgcaacggcttacgggcagcggcaaactgttcatgctcgaagtgcacggcgactcgatgatcgacgccgctatctgcgacggcgactacgtggtcatacgcgaacagccgtccgcagtcaacggcgacatcgtcgccgcgttgctcgacgacgaggccacgatcaagacgttccgcaaggacaatggccacatctggctgataccgcataaccccgcatactcccccatcgacggcacccacgcgcagatcatgggcaaggtcgtcagcgtgctgcgtcgactctgaccgcagccaaccgtcccggaccttgcaattcaatacactcgcgcggcttgatacgacaatgggttgggtaatcgcccgatttcaggcaatcacccaacccattgtcgtatcaagccgcgcaatgcggcgtcccattcaggagtgcagctgttcggcgctgggcgaacggtacccctgcggttcgagctggaacgtggtgtggggaatcgagacggggaaatgctcgcgcaggcagtcctgcagttggctgagcacattcgccgcctgatccatgctcatgccgggttccaccacgacatgcgccatgagcatgggcatgccggtggacacggtgctcgcatgcagatcatggacggccacgacgtgggggatattctccagatgcgtacgtacttcgtcgagattcaatccgtccggggtctcctccagcagcactttcagcgcatcgcgcaacagcttcaccgcacgtggaatcatcagcagcgcgatcaggccgccggcgatggcatcgaagccatcccacccggtgagcatcatgaccacggccgacgctatgaccgccaccgagcccagggcatcattcaccacttcgaggaacgcggctttcatgttcatgttgtcgttatgctgcccggcaaggatgatgatcgagccgacattggcagccagacccagaatgccgaagaacagcagcagcccactgtccgccacatgttcggcggatcctccgaacagtcgcatccccgcctcgatcagcgcatacaatccgacgaacagcaggatcatcgctcccgcctccgcggtcagcacctcaagccgggcccaaccccaggtgcgggagctgttgggctttcgacgcataagcaccgccgtcaccgtcgatgcaatcagcaccgacatgtccgtgagcatatgcccggcatccaccagcaatgccagtgatccggtgatgatggcgccgacgatctccgccacgaacaccgtgccagtcaaggtcagcgtcatcataagccgtcgctggtgcgccttgctgccgcgcgtcacctcgttcaccgttccatgcgtgtgcggcatagtgtacctctccttctgcctgctatgtgaaactgtttcctacaatcattttcaatagccctagaacgacgaaaacctcggccgaagccgaggttttcaaacaacagggttcactatacaccgaatcgaacggcgcgccgacgttctctgtgagcagatgcgggcgaataccaggatgaggaggaccccctgccgataaacaaaaccacccccagtctcgcttcactcgatggcctcccgccggggggcaagatgagagcaccgccggctcctggccgacagccgcgccagcatggcaaggcgcgaagcaagactgagggcggttcatgcgccgatctgcaccggcgccccgtcaatcaatccgatatcagaagccgaactgggcagcggtttccttcagcgtctcagcggagcgcttcagggcggcaagctcgcggtcggagacaggggtgttgatggcggtgttgacgcccttacggttgagcagcgtcggcacggacatgcacacgtcggaaatgccgtggaagtccttcagcatggagctgacgggcaggatgcggttggagtcgcgcaggatggcctcgatgatgtcgacgccggacatggcgatggcgtagttggtggcgcccttgccgttgatgatcttgtaggcggcgttcttgacttcctggtggatctcctcgcgcttggcggcatcgagcggctcgtgaccgggcagcggggtccagtcgcacatggggacgccgccgatggtggcggaggcccacagcgggacttcggagtcaccgtgctcgccggcgatgtaggcgtgcacgttcttgacgttgacgccggtctgctgggcgatcaggaagcgcagacgagcggagtccaggttggtgccggaaccgaagatctggttggtcggcaggtcggacagcttctggcacacgtgcgtgacgacgtccaccgggttggtgatgagcatgtagatggcgttcggggcgaccttcatcatgttcgggatgatggacttcatgatgttgatggtcgcgccggcgaggtcgaggcgggactggccgggcttctgacgggcacctgcggtgatgacgaccatgtcggcgtcacggcagatctcagggtcatcggaaccgtcgatggagacggtggggtagaagctggagccgtgctgcatgtcgaggacttcggcttcgacgtgctccttggcgatgtcttcgaggacgatctgacgggcgacaccgcgctgggcggcggcgaaggcgagcgtggaaccgactgcgccggcaccgacgatggcgagctttgtgggcttaatgggtgaatccaccatgtttgctagacctctcttagcacagtgccccgtgtttggcggggttcattttgacaacacacttactgtatctacacatgatgacgtttgcgctgattgccgtagtcattatcgccccgaaggcaaggtgatttgcgtcacattgttgtgaacgctcacagacattgcgtcagcggcaatgggtagaacactcaatcgacatcatgctcggcatcgatgtgatcgctgccatcaccgtccgtctcatcgatcgccctatcgacgatctgggcggcgagtcggcggtccacatccgcctcgatccatatgccatcggcgcgatagtcgacggaatcgacgttgccgtattcgcgcacgcgcgacagcagcgaaccggcgtcgtagggcagcagcgcagacacgtgcacgcccggaacgggcagcatagattcgatgcgccgcagcaggtcgtcaaggccctctcccgtggcggcggacaccagactcgcctccggttcgagcgccgccagccgctcgcgtgtggccgcatcgattcggtcgatcttgttgaacacgacgacgcgcggtatctcctcggccccttcgatgtcggcgagcacgtcgttgacggcgtcaatctgcgagaacgggtcggggtgcgaaccgtcgaccacatgtaggatgatgtcggcttcggcgacctcctccaacgtggatttgaacgcctcgatcagctgggtcggcaggtttcgcacgaagccgacggtgtcgacgtaggcatacagtcgcccgtccttggcccgggctcgacgcaccgcagtgtcgagcgtggcgaacagggcgttctcgaccagctccgcggaaccggtgagacgattcgtcagcgaggatttgccggcgttcgtatatccgacaacggcgatggtcggcagcccgtaccgtcgacgcgaaccgcgcttgacctcacgggccggggccatctgcgcgatctggcgccgcaatctggctatccggctccggatgacgcgacgatccatctcgatcttcgtctcgcccgggcctcgcgatccgatgcccgcgtcggccccggccgcacggccgcccgcctgacgcgacagcgacccgccccaaccgcgcagacgcggcagcatgtattcaagctgcgcgagctccacctgtgccttgccttcacggctggtggcgtgctgggcgaagatgtcgagtatcaccgcggtgcgatccaccaccttgaccttggtggcatcctccagcgcacgccgctggctgggcggcagatcatcgtcgacgacgatggtgtcagcctcgttcacggcgacgatgtcggccagctcgcgggccttgcccgaacccacgtatgtggcggagtcgggcttgtaccgatgctgcagcagaccatcgcacaccaccgctccggcggtctcggccagtgcggcgagctcgcgaagcgactcctcggcctgagccgcggtggtggtcatgctggaccacacgcccaccagcaccacacgctcaaggcggaccttgcggtattcgacttcggtgacgtcctgcagctccccgagacccgcgacatgcttgagctggttgcgggattcgcgctcctcccactcctcggcgtcccgttgcccgacgtgcccatcgccgttctcgtccagcaagacgtccgactggtcggccagcacaccggtcagcaccggctcttcctgttcgcccggctgaccggcctgattcgcatcaacggtattctgttggctcaatggcacctctgctgtcactcatgctctctgctcgtcatccgccactcggtatccgtcactcgacatctgtcactcggcatccgacacgaaacgcccctgcaggcatgaaccacaccacggtggtccgcatcgcaggtgatccgcatcgcatgcacgatggtgagtacggaacgacgttctccaaacgcttgccattatctgtggattggcagacaaggcgtgcgatgaatcgggaagacggtttcgatgcgctggtaccgctttcgtgttccgtcctcgctgttcgagatccggcggaacacgccaacgaatcgatacgcctgaatccgcgtcaccgggtcggcggacttggcgaacgttatacggatgtcattggggtcgccgtcgccgaccggatccaccagatcggcgtcctcgttgtattcgtagatataggtgccgtcatcggacagccggttgttccaaccgtttgccacggccttcccgcctatggcgagcttcgggaaccagactcgatatcggtcgccgtaccattggcgcatcacgctggggacgaaccaggattcctgaaatctcttgtactcggaaccgcacagcgtgttgaccgcgtcggcgattcggggaaagccgacgtcatccgcaacgctgacggcgtccctcgtcttgtagaactccttgtaatcgacgtaggcttccgtccacggcgtgaactcgttcgcctgcctgcgccgttcgatctctgcacgtatccgccgcacgcagtcgtcgatggatcgctccacctgctcatacgatccggaaacatccacatgcaacgcccgatagtcctcgccgcgaatctgacgcagcacgtccgtgatggttatctcgcgctcgcggtcacgttcccgttgcctctgatgataggcctcatcgcattccaccccgatcatcgcctgaggaaaatacaggtccacgaacgaccgacgcccgtcaggccacaacaccagctgttgcgtgaccggcttgacatcgtccatcgccaaccggttccatatggcattgacgacgtaattctcgtaatccttgcgcttcgtcctcgaaagcgcacgaatcaggtatcccagtttatccgcaccactcatgatcccatcctttcgccattgatggcggaatccatccgcccgacaattgcattgtgcaccacgcaatgtcactgcggtagatatctaccggataattgcgccagaaagcattctcgaagaggcgcagcgctctcgaaggcataggaatccgcagccctcccccgctaaccatgcctttgactatcatggttccaagtcggaagccatcactcatctatatgcgggagaacgaatgaaaacgcagcatgcctcggacgcctcgaagcgggacgggaacgccaccgaacagtatttcgccgccgaaccgtcctccgaggacgttcgccgtcgcatgaaggtgacgctgcgcgggcaggatgccgtggtcgaggtgtcgaacggcgtgttctccggctcgcgcctggatctgggcacgtcggtgctgctgcgcgaggtgccggagccgccggagacggggacgctgctggatctgggctgcggatggggacccgtgtcgcttgcgctggcgttcgcctcgcccaaggccgacgtctgggccgtggacgtgaacgaacgcgcgctcgacctgacccgcgccaacgccaagtccaacggctgcgagcacatccatgccgcgtcgccggagcaggtgccggccgatctgacgttcgacgcgatctggtcgaacccgccgatccgcatcggcaaggacgcgctgcacgacctgctgatgacgtggctgccgcggctcaaccccgcaggcgccgcgtacctggtggtgcagaaaaacttgggcgccgactcgctgatcccctggctcgccaccgcgctgggcgacgattatgaggtgtcgaagtatcattccgcgaagggatatcgcgtcattgaagtgttgaggaacaagtaaacggatgaaattcacatatccttccgagctgccggtctcggcggctcgcgatgacatcgccaaggcggtgtcatcaagccaggtcgtcatcgtctcgggccagaccggttcgggcaagaccacgcagctgccgaagatcctgctggagctcggccgcggtacgcacggccggcagattgtgcacacgcagccgcgcaggctcgccgcgcgaaccgtcgccgaacgcatcgcctccgaaatgggcgtccatctgggcgacgagatcggctatcaggtgcggttcaccgacgagacgtcgccgaagacccggctgcgcgtcgtcaccgacggcatcctgctggcgcagatccagcgcgacccccagctgcggcaatacgacacgatcgtcatcgacgaggcgcatgagcgcagcctgaacatcgacttcctgctcggatacctcaccgcgctgctgccgaaacgtcgcgacctgaagctgatcatcacctcggcgaccatcgattcggtgaagtttcaggagcatttcgagcatgcgctgcacgagaaggttccggtcatcgaggtctccggccgcacctaccccgtgcaggtcgtctacgagccgctgggcaccgcgcccgcgctgatgcggcacgtgcccggattcgagaccggcgcgatgcccggcgaggaatcgtatgccgaactgtcggcggcgccctccgacggcggccgggaccgtggctcatctcgcgaacccgacatggacatgcccacggcggtcgccagggcgtgcgcggagctcatcatccattccagccatgagcgcggcgcccgcgacatcctcgtgttcgcctccggcgagcgcgacatccacgagttcgagaacgcgctgcgccgccattacggcccgcgcgccgacgacatgcgccactccgacgccatcgagatcatgccgctgttcgcccgcctgtcgtccaaggagcagcaccgcgtcttcgagccgcacacgcaccagcgcatcgtcatcgccacgaacgtggccgaaacgtcactgaccgtgccgggcatccgctacgtggtcgacccgggcacggcccgcatcagccggtattcgaagaccgccaaggtgcagcggctgcccatcgagccgatcagccaggcgagcgccgaccagcggtccggccggtgcggccgtatcgcggacggcatcgccatccgcctgtattcgcgtgaggactacgagaaccgtcctcggttcaccgagccggagatcctgcgcacatcgctgggtgccgtggtgctgcacatgctgtcggtgggcgtcgcccgtacggccgaggatgtgacgaatttcgggttcatcgacccgccggacatgaaggcggtctccgacggcttcaacgagctgacggagctcaaggcgatcggccgcaagcgcggcgaggtgacgctgacgcatgtcggacggcagctcgcccgcatccccatcgatgtccgtctcggccgcatggtgatcgaggctgcgaaatccagcacgcccgacacgttggctgccgtgctggtgatcgtggcgttcctgagccttcaggatccgcgtgaacgcccggacgaggcccgggatgaggccgaccgcatccacaaccggtatgcggatccgtccagcgactatctgaccgcgctgaacatctgggaccgtatcttccaggccgatggcgagccgagcaacaatgcgctgcgccgtatctgcaagagcgagtatttcagctggctgcgcgtacgccagtggaaggacctggtcaatcagctgacggagatgtgccgcgaactcaagttcaaggtcggctccccgcagccggcctcccgccccgatctggcggtacgccagctgccgatcaaccagcaggcggcccattcgctgtgctgctcgtgggacgaccgcggcattcacacgtcgatgctctccggcctgctgtcgatgatgggcatgcagatcgtgcgcgagccgaaggcctccgatttcgccggtctcaagggcgcggcgaaggccaaggccatcaagcgggctcagaagatggcgaagaacgactatcagggcgcgcgaggcactcatttcgcattgttcccggcctcggccgtggccaaatccaccccgcagtgggtgatgagcacggaactggtggagacgagccgcctgtgggcgaggtacagcgccgccatcgacccggcgtgggccgagccgctggccgggcagctgacccgcaccacgtatgcggagccgcactggtctggttcgcgcggctccgccgtcgccacggcgaaggtgctgctgtacggtctgccgatcatctcggaccgcaccgtgcaatgggggcgcatcaaccccatggaggcccgcgacttcctgatccggcagggccttgtcgagggggacgtccagcagcggttcagctatgacgattttttggcccgaaaccgcgacatcctggacgaggcggccgaggacgccagtcgcaccaggcaggtctcgcagtccgtcagcgacgaggacctctacgacttctaccagtcggtcatccccaatgacgtgacctgcgtcgccgacctggcgaaatggtggaagcgcgagcacggcgaacacccgcatctgctcgatttcgacccggacaaggtcgaacgcctgtcatcggcggagtcggtgagcctcgccgactatccggaccattggcatgcgctcggcacggacggccagccgatcgacctgcggctcagctacatctacgacccgcacgaccccgccgacggcgtgaccgtgcacgtgccgctcaaggcgctgtcccgtctgacaccggaacagttcacatggaacgttcccggactgctcgacgagctgatcgtggggctgatcaagtccctgccgaaatcactgcgcgtgcagttcgtgcccgcaccggacaccgcgcgcaagatccgcgcatggatagacgaccggtatccggccctgcccggcaccggcacgtccgacggccagggccacgcatggcccgacctgccgcacgtgttcacccaggcggcgatcgacaccgtgaacgctcagatccacccggaggtgctgaccggcgaactatgggagaagctgcccgcctacctgcggatgacgttctccatcgagcagcaactccccgcgccgcgcaacgcacgcggacggcggcatgcacgcggcccggtgaaggtactgggttctggcaaatccctgaccgcgttgcaacggcagttcgccgaacaggcggaggcatccgctcggcgcatggtcgaacacaaggcggaacaggccgccagccagggcaaactggtcgaacaggccaacctgctgcacaaggccggggcgacgagcgagtcgcgcgcggtgatgctgtggcggggcgccttggacgcgctgcgcatgccttcggagcgtatctcgtctcggtggctcggcaccgaggcgctgatgctcgcgtcggcgccatacccctccaccaaggcgctggtggaggacctgcagctggccaccgtcaaacgtctgctgccgaacatcgacacgctccccgacgacgatgcgctcgccgatgcggtgatgggggtgaccgaggtctacgaggacaccgtctacgcactcgcccatgatgtcatcgccatcctgcgtgcgtacgcgaatgtcgacaaggcgacctccggcaaggccgacctgccgatgctgtcggtgctgcaatcggtgcgcgagcatatcgccacgctggtgttccccgggttcatcggcgcgacgccgcccgccgccctgccgcgcataccgaagtatctggaggccgacctgatccgtctcaccaaggcgaagaacgacaagaaccgcgacgtgcgatgggcctgggaggccgacgaggcgcgacagctggtcgacaaggccgttcagcgtgccaagacggagcccgcgggcccacgccatgaggcactgacgaaacaggccgacgacgcgcgctggatgctggaggagttctacgtctctctgtgggcccaggagcttggcaccgcgaagccggtcagcttgcagcgaatcaagaaaacgctcggcaaatagcgctgtgcgcggcctctcccccgtcgccgcgcacggccagtccgcgcatccaacatatccccgcgctacaatgacggacgatgacaacacgtaagaagcaggggaacaacaccgggcggaccggaggacggaacggcggcaagcaacgcaaccgccggcccggtacgcccgccaagaaaaacatcaggggaaacaacaccaaaaacaccaggcacggcacagcggcacggtccgcgatccgccgcccgaagccgaaggcccgacgcaacacgctgcgccgctggtggaagcgggctggatggcgcaggcgcatcctcgcggtggcgggcaccgcgctggcggcggtgtgcgccgtggcgctggcgtggggcaccacctcgttcgtcggacagcgcatcgcgctcgtgacggccgaggaacgacagcagaatctgggcgaccgatacggtttcgacccgggcaacatcatctccgacggccagttcttcaacggctatgcgatgagccgcaccgaagtgcaatcgttcctcgatgagcacggcggcgactgcaccgggacgggatgcctgaaaaaccgcacgttcgacaccacggaccagcccgatgaccggtactgcgacggatacgacggcgccaagggagagactgcggcgacgatcatcgacaaatcgtcgcgatcatgcggcatcagccagaaagtgctgctcaccgtactgcagaaggaacagcagctcgtcaccgcgagcaagccgaccgacttccagttcaaggcggccatgggcctgagctgccccgacgacaacgactgcaacccgcagtacgcaggcttcttccggcaggtctacggcgcggcgcatcgatacaggtattacgtgcggcatgaggcatcatacggttaccatgtcggcaagctcaacttcgtcaggttccatccgaacacgggctgcggcggcgccaacgtggtcatcggcaacaaggcgaccgcactgctgtacatctacacaccctaccagccgaacgaggccgcgctcgccgctggagccggggaaggagactcctgctccagctacggcaacaggaacttctcgatcatctaccggggatggttcggagacgcaaggcactgagacagccattgccggcccgcatgcggaactgcggcagaaaaccgaccttcgccatgtggctgtaatgcggcagcaccgcgtaattcggcgcgagcgcacacaggatgttgccggcgaggaacacgccggcaacgtcagatgggtggcgaaccgcgacaccagattgccgaccgtgacctctaagacccgcaacccgtgggcgatgtcgggcaggatgcccacgaccacgaaatcgctcatgcccagcacgaaactggacgcgatcagcgtgacgaccggcagcgcgaagaagcgttcgctcccctgccgcccacggatggcggaaccggacatgaccgtacccctgctgtttttctcttcttccagacggaacatacattagcggcacctcctgccgcgcaaggccccgagacacgcaggagacgcgccgaagacgcacggcccatcattcaccggcgatttcgacggtcttcaccttccggcgctcgcgctgcaccggcacgccgcctacaataggagaagacatgcatcaccgtgcgcggccgagagacaagggaacaggcatgggattgttcagcaggcatcatgacgacgattatgtatcgccgttcgatgtggacgattcgccggcgtacatcagcatcgattcccagacctcgcaggtcgacgagccggcgtatcagcagcccaaaagcggccgaatcagccccgatgccgatcgtcgccgaccggcaggcaagccggccgccccgagccccgcagacaaaccagggccggcacggaccggagcgggcgacgctcccctcaatctgccctacaacggccatccatatcgcggcggctacggacacgtgcagtccaagagcgaccgcaaacccggcggagccacgaagcgccagcgccgatcctgggttgccgtcatcgccataatcgtgttcgcgctgggatcaaacctggtgagtcatatcatcagcacaggcggcagcagcgactcggacgactcatcgtactcattcaagtcgccctcccaagacaacaagccgacccgcgtgaaaaccggcgagacgacatcgttcggcaaccggaaggccacggtcaccatagccaaggcgaccaccggccccacggatcacgacgggcacaagacggtgatcatcacctaccattggaagaacaccggcgatgccaatacgaccttcggggaactcgccatggacctgcaggtgtatcagagcggcatcggcctgaacaaaacctacctgcacagccgcggcggctcatccatcgaagggtacaagacgcagtcggacgacatcaagatcgccaagggcgaggaaagcgacgcgaccatcgcgtaccagctggacgacgcgacgggcgacctgtacgtcgtagccaatcaggcgacccgctaccatgagggcatcgtgtccgcgttcaaggcaccgaccagcggcacgcaatacgagcaggtccagcctgacgacatcgctcccgccccgaaagccgccgaggcggagaagcgcaagatgaagcggatcagcagctacagcggggacgccctcgtctccatcgacgacgtgacgacgggccccgacgactatcagggccgtcacaccatcatcgtcaccatcacatgggtgaaccaatccgaggccaatgagccattgtccaacgccgcgaagctcaccgtcacgcaggacggctcccagctggaaatgaactactacaccgagccgccgctcccacaagggtacgagaacatgagtttcagccgctccgtccagccgggggtcctggccaaggcgacggtctcctatgtggtcgaagacccgggccagccggtcacggttcgcctgtccagcacctacgggagcaacgacatggtcaccaagaagatgacgccgcgcaaggtcgagtgaccgcagcggcatcctgcggcggtcggttcggcaagcaaaaacggtgtggggatgatggccggatcagcagccatcatccccacaccgtttcttgtttgccggtagtcggccggtttcacgtcacgtcagagcttgggcaggtacttcttcaactcgtacggcgtgacctggccacggtattcgtcccattcctgatgcttgttgcgcaggaaatactcgaacgcatgctcgccgagcacgtccgcgacgaaatcggacttctccatgatcttcagtgcggcgtccagcgaatccggcagcggctcgatgcccatcgcctgacgttcggcgtcggtcagctcccacacgtcgtcgctggtcggctctcccagcgtcatctgctgttcgatgccgtccagaccggcggcgagcagcaccgaatacgccagatacgggttcgccaccgggtcgagtccacggaactccatacgcgcggagttgcccttgccgggcttgtactgcgggatgcgcagcaacgcggaccggttgttgtgcccccagcagatgtagctcggcgcctcagcaccaccccacagtcgcttatacgagttcacgaactggtcggtgaccgcgcagatctccgccgcatgatgcaggatgcccgcggcgaactgtcgggcggtcagggacatgttgaactcctggccggcctcgtagaacgcgttggaatcaccctcgaacaggctcaggtgcgtgtgcatgccggaaccgggcgcgtcggcgagcggcttgggcatgaagctggcgtggatgccgcgctccagcgagatttccttgacgaccgtgcggaacgtcatgatgttgtcggccgtggtcagcgcgtcggcataccgcaggtcgatctcgttctggccgggacccgcctcatggtgcgagtattcgacggagatgcccatctgctccagcatgttgacggtggcgcggcggaagtccatgcccgggctgcgcggcacatggtcgaaatagccgccctcgtcgattggagtcggcgccttcgaccagtcggtctggttctcgaacagatagaactcaatctccgggtgcacgtagaacgtgaaacccttctccttcgccttggcgagcgcacgcttgagcacgtggcgcgggtcacccagggacggctcgccgtcgggcgtgagaatgtcgcagaacatgcgagcggtaccctgcgggccgccacgccacggcagtatctggaacgtggacgggtcgggctgcacgatcatgtcgtcctccgacacgcgcgtcattccctcgatggcggaaccgtcgaagccaagcccctcctcgaacgccgcctccaactcggcgggcgcgatggccacggatttcaacgtgcccagcacgtcagtgaaccacaaccgaataaagcgcacgtcgcgttcctcgaccgtgcgcagggcaaactcttgctgcttatccataatccctcatggtttcacgtccgtgttacgagactcgttaacatgccatcggacacgccggggcatcgccggaatgtcgctcccgcgtcggcgttatcgtggagccatgagcgagaaccatcccatcatcgatatgtcatggcacatggccgacacgccgctggggcaggccaaggccggcatcgcgctgcgcaagaccacaccgttggagagccacgccgactggaagatcgtgtcgcgccggcgcgacgtgatcgggcttttggaggaacagtcggcgcagcgggtgccggatctgatcccgctgaggtactaccgcatgagcgattccgcgttcacgttctaccgcggcaccgcgctcatcatggcgaacgacctcgcgcacacgccgaccaccggcatccccgtccaggcggtcggcgacgcgcatatcggcaatttcggcatgttccgctcccccagcgaccggctcgtgttcgacatcaacgacttcgacgagacaaccacgggaccgtgggaatgggacgtgaagcggctcgcggtgtccgtggagatctgcgggcgggcgaacggcatcaaggagaaggaccggcgcaacgcggtcgcacgctgcgtgcactcgtaccgcgaccatatccgccagttctcgcagatggacttcctcgacgtctggtacgaccatctcgacgtggaggcggcgctcgaccattacgaaagcacggtgaacggcaagcgcaaccgcacgttgcgcgacgccgcgctgcgcgcgtcggtgcgtgattccgaccatgcggccgcgaagctcacctatcttgacagcggcgagaggcggctgcggttccgctcgaagccgccggagctggtgccgatcagcgagctgcaggactatgcggatctcggggtgctgcgggagaggctggacgcactgtatgacagctaccggcaaagcctgtacgaggaccggcgttacgtgctgaaccgttaccggtaccatgacaccgcccgcaaggtcgtgggcgtcggctcggtcggaacccgcgcctgggtgtcgattctcaccggacgggggcttgacgacccgctgatgctgcagatgaaggaggccaacgagtcggtcttcgaacggttcgtcggccgctcgccgtatgcgacgcatggcgagcgtgtggtgcaggggcagaagctgatccaatccaccgccgacgtgctgctcggctgggcgagtttcgtggcggaggacggccggccgcgcgactattacgtgcgccaattctggaacggcaagggctcgatcgacatcgatcatctgaacgcgctgggattgtcggacctgggccgcatgtgcgcatggtgcctggcgcacgcgcatgcccgcaccggcgacagcgtggccatcgccaactatcttgggggcaccgacgagttcgaccaggcgatagccgcgttcgcccaggcgtatgcggagcagaacgaggaggattactccctgttcaggaagctcatcaagaagggcgagctcccctgctcgaagaaaagcggcgcgaagaagtgagcaggggccgccgtccgcccagccgacggtgacgggtagcgggggcggcccctgtcgacagccgtatcggtcagcgggcgacttcgagcgcctcttcgagcgtgaacgcgcgggcgtacagcgacttgccgaggatggccgagtccacgccgaaatcggagaggatcttgatatcgtgcaggtcgtccagcttgctgatgccaccggaagcggtgaccttggcatcggtgcgttccgcgacctcgcgcagcaggtcgatgttcgggccgctcatcatgccgtcccgcgccacatcggtgacgacgtagcgggagcatccgaccgagtcgaggaacttcatcgtctcgaacaggtcgccaccctccttgacccatccgcgggcggcgagcgtgtggccgcgcacgtcaagtccgatggcgacgcggtcgccgtaccgcttgatgaccgaggcggtccattcggggttctccaacgcggcggtgccgatgttcacgcgggccgctccggcctccagcgcggcggacagcgagtcgtcgtcacgcacgccgccggacatctcgatgttgaccttgtcgccgagctcatgaacaatctcacgcagctgcgcgcggttgttccccgtgccgaacgccgcatccagatcgacgagatgaatccactcggcgccagcctcgacccacgtgcgggccgcttcgagcgggctgccgtagtcggtctctgagccggattcgccctggcgcaggcgcacggccttgccgtcgcgcacgtcgaccgcgggaagcaatgtgagtgacatggttgttctcctttggaatcgttgaagtcgttgaggctcggggcccgccgtccgcgttgccgggtgagtcggggttcccggcagcgccggctggtcatgccgttcagccggctacttcgagaacgtgccgacccagttgcgcagcagctgtttgccggcgtcggcggacttctcggggtggaactgggtgaccgacagcgggccgcgctcataggcggcgacgaatctgctgcagccatacgtgcaccacgtgatatgctcgtcgccgcccagatcgacctgctcggcgctcagatccttcgcggtggcgctcatcgccgcgtaggagtgcacaaaatagaaccgttcgttctccacgccttcgagcagcgcggaaccggacggtgcctcgaccgtgtcccatcccatgtgcggcacgacatcggcatccagcagatcgacggtaccgccgatcagtccaagtccttcggtggtgtctgcgtgctcgttgccgcgctcgaacatgatctgctcgcccacgcacacgcccagcacagggcggccggcacgcagacggtcgaggatgacgcggtcgcccgacacctcgcgcaggccggtcatgcaggcggcgaacgcgccgacgccgggcacgaccatgccgtccgcctcaagcgcctgccggtagtcggaggtcagtgtcgtgtcaaggccgagattggcgagcgcacgcaccatggaacgcacgttgccgaatccatagtcgaataccaccaccgatgtcatgtcgtctccttcagtctgaaaatccttggctgcacgggcacgggcggcgtccgccggccgcccgattattcgatgcgcgacgagccgcgcccgaacttcgtgtgttccgcgatgacggccatggcctggtcatggtcgagatccgcggactgttcgactttcatgccggtgccgatcaggccgtcctcgtcggtgatgccaagcagcagatcctccacgaacggcgccgtcgatgtgaacagcagcggcggggcgatcgtctgccccggcttgccttgcagatagacggtcgcctccaacttgtccgcacggttgacggcgagcaccagcgacatgcccgacacgacgatggtgaggtcgcgtgccgcgacttcgggcccgtcgccgtcaaggttgcgcaggatggccacggccccttccgccgatccgatgcagtcggcggacacgtccgacagctggcagaacgcggcaagcaggcgggcggacgcgacgcgcgtaatcagcacggcggccttcgccttgttgcccagaagcccttgcagctcgtcgtcgaacgcggccgcggtgtcggcctcctgcgcctgaccggaatccgcggcccccgcatcgtctgcggggctgtcggccgcggcgtcgttcgccggttcgccggcagccgcgttcgaatcgcggaattccttctcgaatccgtccagcgcggcctcaagttcctcgtcgctgaaatggatgtcatcgtcgaaaccgtcgtctccgccgtgcctgtcgtcgttgccgctcatcacagtgcgcccttcgtgctggggatcaggccctggatgcgcggatccggctcgaccgcgaagcgcagcgcccgcgcgagcgccttgaattcggcttcggcgatgtggtgggggtcgcggccggcgagcacctgcatgtgcaggcagatgccggcgtggaaggcgatggattccatgacgtggcgtaccagggagcccgtgaagtggccgccgatcatgcagtattcgaagccgtcgggttcgccggagcacacgcagtacggacggcctgaaatgtcgacgacggccttggcgagcgcctcgtcgagcggcacggtggcgtcggcgaagcggcggatgcctcgcttgtcgccgagcgcctgcttcaacgcctcgccgaacacgatggccgtatcctcgacggtgtggtgcacgtcgatgtcggtgtcgccgtgcgcatgaatcgtcaggtcgatgagcgaatgcttgccgagcgcgttcatcatatggttgtagaacggcacggaggtgtcgatgtcggtcttgccggtgccgtcaaggttcaggctgagttcgatgtgcgattcgctggtctcgcggacgatgtgcgcggtacgcgccatgatgtgctccttggtccttgatcctgatatgtcccgataagtcccggtttgcctgccggccagtgtgccggtcggcggtcgccgacgacgggtcatgacgttgatggtcgcgcgcgccgccggcgtttcgggagttgttatctgctttctacaatacgcaatgcttcggtcagcgcgttacggaattgttccatctccttgtcggtgcccatgcacatgcgcagccagccgtccgggccgaccacgcggatgagcacgccgcgcctgagcagctcgtcgaagatggcctcgcggtcgtcgaaatgcccaccgaacagcaggaagttcgaaccggactcggccacttcgagcggctcgcccttgtaggtctgacgtgacagccattcggcggtggattcgcggatctcacgcaagtgctcgacgcggctcagctgctcgtcggtgtgttcgaacgccgcgagcgcggcggcctgggtcacggcggacaggtggtagggcatacgcacgatgcgcatgcagtcgatgatgcccttgctcgcggcgagatagccgacacgtgcgccggcgaatgcgaacgccttgctcatcgtgcggctaacggcgaggttcgggtggttcttgatgagcgagaccgcgctcggcgtgccgggcttgcgaaactccacgtacgcctcgtcgatgacgaggatcgggtggacgccttcgcccgcgcccgccacgtcggcggtctcgcaggcggcgaggatgcgttcgatgtcggccatcggcagcggcgtgccggtggggttgttcgggctggtgagcagcaccatcgagggcttgacctcggcgatggcctcgattaccctgtcgacgttcagcgtgaaatcggcgttgcggtgggcgagcttccagccagtgaacgtgtcgcgcgcgtattcggggtacatggagtaggtcgggtcggcgcccaaggcggtgcggcccgggccgccgaaggcctgaaacagctggagcataatctcgttggagccgttcgcgccccacagttcgtccacgtcgagacgggtgccggattcgcgggcgaggtagtcggagaacgcctggcgaagttcgatatgctcgcgatccgggtagcggttgagcgtgggcgcgatctcacgcacgcgcctggcgatggtgtcgcacacggctggatccggcgcatacgggttctcgttgacgttcaggcacaccggcacgtcgagctgcggcgcgccgtacggctcctcgccgatcagatcgttcctgagcggcaggctcgccggaatcgcattgctgttgttctcactcattgctctctgttctttccgtctatagtcccgctgacgggggttgtattcgcattcgcacgcggcacattcgatccgctcatcgcccccgctggctgggctgtctgcgcggcagactgggggtcgaaccacccaagcagcccttagcgcagaccggcttccttctcctgttcgcgcagcgtggccttgtcgtacggatccttgacgaagcgcgacaggacacactcgccgtgggcgggcaggtcctcggagacggcgaaggcgttgatgcgcgcggcgagggccttcaggccctcctcgtcgtattcgatgacctcgacgggcttcatgaacgtgtgcacgccgagtcccgcagcgaagcgggcggtgccgccggtgggcagcacgtggttggagccggacatgtaatcgcccagcggcaccggggagtacgggccgcggaagatggcgcccgcgttcttgatgcgcggcacgacggcgtccgcgtcggcagtctggatttcgagatgctcggccgcatatgcgttggccgcgtcgatggactggtcgaggctgtcggtcaggacgatggccgactggcttccggacagcgacgtgtggacgcgctcggcgtgttcggtgcgcggcacgcggtagttcagggactcctgaaccttctcggcgatctcggtggaatcggtgaacagcacggagccggcgagctcgtcatgctcggcctgaccgatcaggtcggcggccagcaggctcgggtcggcggtcttgtcggcgatgatgccgatctcggtggggccggcgaccgcgtcgatgcccacgaacgcggagacgagcgacttggcggtggccacgaagatgttgcccgggccggtgatcttgtcgaccgggtcgcacagcacgtcgccgtcctgcggctcggagcccttggctccgtatacgaacatggcgatggcctgggcgccaccgaccgcgtagacctcgtcgacgccgaggatggcgcaggtggcgaggatggtcttgttgggcagtccttccgcgttgtcgcgtgcgggcggagtggcgatggccagcgactcgacgccagcggcctgcgccggcacggcgttcatgatcacggaagacgggtagacagccttgccgccgggcacgtacagaccgacgcgctggatcggaatccaacgctcggcgacgcgggcgccttcggccagatcagtgtaaaagtccttcggcacctggttggcggcgacggcgcgtgcgcgacgcacggactcctcgatggcggcgcgtacttcgggatcaagcgtctcaagtgccgcggtcatcgcctcgaccggcacgcgcaggtgctcgggacgcacatgatcgaacttctcctcgaagtctcgcagggccgcggcgccgcgttccttgacgtcgtcaagaataggccgcaccagatcggtggcttcggaagtgcccatcgcggcgcgcggcatcgcggcaagtaactcggcgcgggacatgttcttgccccgcagatcaatgattcgcatgatgttctcgctcataacgccctatcgtaccaatgcacgctgtcgtaatcctcccagaatcgccgtatcacccgcatcgtgagaaatcgcaggctcgtcggcgatgtggatagctgtggatatccatgcattcatccacatatccacattttttccatggttcatcacaccgacagcgcgaatacgctaccgtgacattcatgaacgatgtgatgctccagccgatgggcgagagaacgcccatgacgcaatcgctgcgcgaccgcgcccaggatgccatcatgtgctgcgccgcattggcgtggcgcatcggaggcaatgtgctgttcggcatgaccaccgctctcgccctgcagcaggtgccgttgccggaggcctgcgatctggacgcggagatgctgcacatcacctccagcactcccgacaggaggcggcgccgcattcccggcacgcatccgcatgtatggaagctgatcgccactcatcctgatgcgtgcgtaccgatcaagggcaatgtattcgcgttgcatcccttccatgcctgggcgcagctgtcatcacacgtgtccttggaggaactcatcatactggcggaggccatcatcaccgccatatcgaaatcatcgggcagatatccccgactggtcttgtcgtccttgcgcgagttcatcgacaatgcgccatactttctcgggaagaccgcttgccggaccgcactgcaactggtcaaggccaacgtgctgtcgccgaaggagagcaaggcgagactggtactcctccggcacggcctgcccgacgcggaggtcaactgccatgtcgacagggcgatgttcgattcgggcaagccaatgagcctggacattgcatggaagcatttcaaggtcgcggtggaatacgacggcgatcatcatcggaccgacaagcaccaatggcgcagggatcgcaaaaaacgagaccggcttcggcaattgggatggacgatcatcgtcataacagccgatgacatcagagacgaggtcgcatgtgccgaattcgcgctcaatgtcgcgcgtgagcttaccctccgcggctgtgacgtcgattttcgtgtgatcgccatgacggtcgaggagctggcacgccgggaaaaggcggctgaccgaaaaaagcgacgtgaatccgcggtctgacacgagtcgcatcatcatgccatgcaccggcagggccgcgccatccatgcttcgagattcaccgtctgcaatgtgagacgatcggcgtcgaggctgtaccacaccagcgagaaaacacgtcttttaggcattgtgtggcaattcgcgtgcctcacaatgcgatgttaaccttatcattctctggtatggtacagcgcgggtagacagctgaaaccacaaaccgccattttccaacggtttgctcgccacgtgtaaacatccctacatacggacgtggccacaccacgctcaaaaccgccgaaattgccctggtgtggcacaacttcgacagcccggtcacctctacaccggtccggcgcaggcccgcgcccggtcattcctgcagatagtacacggcatcgtcagcaggaggcacattcatgtgttcggccaggaaacatagatagggacgcgacgaatccggcttcttctttcccttgacatccgtcggacggatgatctccgcactgccgtaaccggcattcgagcaattgtcaaagccgatgatgccacccgggcactgatagtcggtgtcaggccccttcagttccacgccggcccccgtcaatcaggaacatccgggagcgggtcagagccgcgaaatcgatggagccctccccgcatacggtccgagcccctgaaaatgcaatgcgatcagtctcatagcccaccgtgtcggtgtccgcggatgctacggacgccgtgaatcccgctcccgaaagaagcgtcatggccactatcagtgccaccacgcaccgctttccttgaaaatagttgtctggtttttccattacaaaccagtaattttcctttcgcgacgaccgtgatatgagacaggttccgtcttgtgccatcatcgccataacttcctctgcgactgagaaacggtcatttatccagcagcgacgcaacaccttcacaaaaaatcacgattgtaatcgccttcatatttttttcggcggcggcaacatcggccccgaaccgtatgcctcgcccgcggcggatgcagcacgatggacgaactcagacggcgggatgacgtatgagatcgcgctctatccacgccatgaccaggtccgccaagcgatcgatttcggcatcggtgagctccctgccttggggaagatggtgccatttggcgatgcacccgcggcagcacgtggcggtggcatgctgcgcggtaaacaccggatgcccgcgccacggcgtctggcgcccgtcgttgcgcggattcgccgccccgatgcgggcgcgcagcagctcgcgggcatggcgatcgatcatggccttgcccttcgcccgcgcatacgcgcggtccttcgccgacaactcgaatttcgcacggaatgaggagcgcgaaagccggttcagcgtgtcatcgatccaccggcgttcggcaccatcgtccgcatcatccggcaagacccgctccatttcaccatccataccgcacacctccgcacaacccacgcccgcttacatctcgcccacagaccaagccgcagccgactgggggtgatcccgccgaccgtccctccccgccacaatcagatattgccgcgcacgtgctggtcggcccacgactgggaatgcatgaaggtcgccggatcggcgctgacgttgccatgcgggtcgtcgagcgcatcgatcgccgccagttcggccgacgtcaaatcgaaatcggagctggcgaggttcacccgcatgcgttccacgtgcttcgacttggggatgatgatgcgcccctcctgcgtgtgccagcgcagcaccacctgcgccggcgtgacatcatgcgccttcgccgcggcgacgacgggctcggattcgatgtcctttccgtggccgagcgggctgtatgcctcgacggccacgccgttcgccgcgcagaacgcacggtttcccggctggttgaaccgaggatggacctcgatctggttcacggccggggtctcaccggaatcctcgatcagcgcacgcaggtgctgcggcaggaagttgctgacgccgggcacacggaccgcgccttcgtcgcgcagtttcagcagcgcgcgccacgtctccttgaagaaccccgccgcggcgaatggccagtggatcagatacatgtccaccacgtcgacgccgaggttgctgcgggaacggtcgaacgcgaccatcgtcgaatcatacccctggtcgcagttgcgcagcttggtcgtcacccacaccttgccggccatgccggtggccttcagcgcgtcgccgacctctttctcgttgtagtacgcggccgcggtgtcgatgtgccggtagccgatctccagcgcctcctcgaccgcgcgctgtgtgtcctccggcggaatctggaacgtgccgaaccctatctgaggaatcaccgaatgcgccttgtcgttcagcgtcagctcctgagcctcggcactcccctgctgcccccgcgtcgtgtcatcactcaccatatgcctcgtttccccacggattcgcggcggacgatcgccgccgcccggcaccccacggcgccacacctgcgaaccagtactcatggtaatacgcggccatgcatgcgcaagcgtcatcgttcatctcttgcccacccgcggtcgggcacggcgaggaaacgccccccagtcccggccgggacctgcgatttgggacgtcctgcgggcgcagcattgcctgctcgcctgtcgattcgccttcgccggcatcattacaattgtctgcgacgcatcatcggcaatatcacaggagacaatggtcatggcgattcaatcgacgatcacgctgaacaacggcacggtcatcccgcagatcggtctgggcgtgttccgcacgccggacggcgacacgacggtaaacgcggtgcaggccgcgttggagaacggatataggcatatcgacacggcgatgatatatcgcaacgagacgtctgtcggcgagggaatccgccgttccggcgtgccgcgaggcgacctgttcgtcaccaccaagctgtggaacgacgacattcgcgcgcaccgcggcaaagaagcgttccaggagagcctcgaccgcctgggcatggattatgtggatctgtatctgatccactggccggcggacgtctggcagcaggcgtgggacgacctgcaggagatctatgcctccgggcgtgcgaaggcgatcggcgtgagcaatttccagccgcatcatctcgccgacctgctgaagaacagcgacgtgacgccggccgtcgatcagatcgaatcctcgccgcagttcaccaatcagccgctggtggacgagctgtccgccaagggcatcgccaccgaggcatacagcccgctgggcggcaccggcggcgacctgcttgccatccccgagctggccgagatcggcgcgaagtacggtaagtccgctgcgcagaccgtgatccgctggcacatccagcgcggcgtcgtcgtgctgccgaagtccacgcacgccgatcgcatcaggcagaacatcgacgtgttcgacttcgtgctgtcggacgatgacatggctgcgatcagtgccatggacaccggcaagcgcaacagcgccgacccggacaatttcgatttctgatggatccttatccgtgtggcgtatcgctctcattgagagcgatacgccacacgcaacaggcgatgatatgattaccggtagttatctaccgttttaatcacccaggtggcacggtatccgtcaagggagaggagacatcgtggctgcatcatcggcactccccaccgctcagatcgtcatcgaaatcctggaacagctcatcaagcacaccgaccccgagcacggcctcactgccgcggaaatcagcaaacgcatcaatgtatccgacaaaaccgtgcgcgggcatctcaaggcattgcagtccatgacgccgttcgaccgccatgtgggccacctcgaccggcgggatctggtcaacgcggaaagcgccaacccccgacccggctggtacatcgaaccggtcttcgacatcgcgcagatgcgcctgctcgtggacggcgcggcgctgtcgagctcggacggcgaatacctacgcgaactcatcgccaagatctacacgttcgccggcaaatccggccaattgcgcggcctcgaacaactcaccacgcccaagaactacaatacggagttcctcaacaacatcgagattctgaacgatgccatcgcatacgggcgcgtgatccggttccggtactgcacgtacgacgtcaacggcaatctcgtcccccgccgtaacggcgacggcgacatcaagacatatctggcggacccctaccacctgatgtacaagaacagcaaatactacctgctgtgccacatgcaccggtatgactcgctgtcctacctgcatgtggaacgcatccgggacctgtccatcgaggggccggaccactcactcaaacgcacgctcgacagcttcagccccacgccggggcaaccgttcgacatcgtgcggcatatgaacgagcgaccttatccgatggacggcaaggcgacgccgatccacatgaagatccacggggcgcttgaaccgctgtacgactggttcgccgacgccgatgtcgtccagaccggcgagcgcgaatacgatgtgcacgtcgtcgcgaacgaacacgcgaccctttggtgggcgttgcagtacgcggattcgcacatcatcgagatattgtcgccggcttcattgcgcaagatgctgcacgataccggggaatatctggcgtcgacatacgcgcaacaataagaggaacatatctaccggataagtgaatcggaccctatgttggaatccccgcattcggtgaggcgaatccgtctaccgaatggagagcaacccacaggagacgatcatgcccgccatcaatctgactgcatgtctgaacagggatcagacattcgaaacgctcgcgctgactcccttccgcgaagtgcctctatctcaccagtgaggatcatgccaatgaattcgtcatgacggcgcaggatgccgacccgcgacaagaccggatcaccctgtccggcaaccggtttaggcatatcgacatggtactcatcgacgacttccagtacttcgccggcaggacggccttgcaggagcaactgctgcagacgctgagagcattgcatcaggcggggcgatacagcccgcgatacgcagcgaaccgttctcattgggaaacgtgcgagccctgcggcccgccaaacgaacacggaacccttcagaggcccggaattccgggccttaccgaaatgttcacttgtgtggttacgtgaggaatcctcacacgtttcctaatgagaacggttcgctgcgaggccgatgccgtcagatcgccccgtactcgcgcagcagcatgccgatgtcggtcttgccgagtttcttgaggaccttcttcataacggcgcgctccacgacattgagcttcatatcggtgaccggggagccatcgcgcagtttgaccgtggcgttgagcaggttgcgcacgtcgtagacgctgccccacacctccggcacgccgcggtccacgtcgagcagcgtgtacacggcctccatgccggtgcgcatcgagtattcggtagtgaagatcgtgtcgcgcggtgtctcggcaaactggccgaggaacgcgaagttcacggcgccatccggcaccacgtccggccgatcaccggccgaacgcggcatgaagaacgcggtgatgtacggcatcatgaccggcacggtgttcgcgtgggatttcgcgagcgcctcgatcttgtcggtcggcacgcccatgtggtacagccattcctcgcagatctcctcgccggtgcattcggtcatcggcttcttgatatagttgcccggcttgtcggggaacaggccatacacccatacgcacagctggtccttgggctggtcacggaactgctgctggcggttgagcgtccagctcatcagccagttggagtcctccacggtcacgatgccaccggtcaccacgcgcccggagaacgggtcgcgcttgcagatgcgtttgatgtacggcggaatctctgcgtcgagcgtagtcaccgtggcgctcatccacttggtggcatccgggtccgagcagaatgtgtcgggatgcccgaagctcgggtcctgcttggcgatgcgccgccacatgtcccaaccgccaccgggcttgaggtccggattccatgcggccgacgaatgctgggagcccatcgtggagttctccacgcaaccgccgttggtgatgaacaccagatcgttctgcgtcaggtcgatggacgacttgtcaccttcgtggtcgatgtcgatgcggacggcgagtttcttcgtgttcgtgccgtacgggttgcgcttgaagaagccggacgtggcctggatcttctggatcgtgtcctgtccgaccccggtgcgctcgcgttcgggtccgttcccgccaccgatcgcaaactcgacgttctcgaccttggtgttgtagtggaactgcacgccgtgcgcttcgaggtacttcaccatcggcaggatcatcgactcgtactggttgtatcgggtgaaccgcaacgcgctgaagtccggcagaccgccgatgtggtggatgtaccgtttgatgtacagtttcatttccagcgcggaatgccagttctcgaacgcgaacatggtgcgccagtacagccagaagttggatttcagcacctcgtcgtcgaagaaatcggtgatcggcttgtcgtacagttcctcgtccggagtgaagaacagtttcatgatctccatcgaggccttgtcgctcagcccgaatttgccctggagtcccgcatcctgcccgcggtccttggtggcgcggcacagcgaatagttggggtcgtccttattgagccagtaatactcgtcgagcacggagacgccttcggtctcgatcgacgggatggagcggaacaggtcccacatcacctcgaagtggttgtccatctcgcgcccgccgcgcatgacatagccgaggccggggatgtcggcgccgtcgcacgccccgccggccaccgcgtccttttcgaggatgtggatgttcttgcctggcatctgcgcatctcgcaccagatagcaggccgccgacagcgccgcaagtcccgtgccgatgatgtacgccgacttgccgtcgacacccgccggcttcttcggtcgtgcgaacgcttcatagttgccactggaataatacatattccgcctccttgaggatattgtggatgtctgcgacatcattaccagacatgatgtcgcatttctttcgtccccgccatagacattagtcggtgttttgaaggatttccagaagcgtccatgccgttcatcgtgccgctccgctatcctcgtacacagcacatcagattgacggagaggaccgaacatggcattgagcaagaagcaggtcaagcagctgcgcgcgatggcgaatcagctgaacccgctgctctacatcggcaagaacgacctgaccgacgccgcggtgaagcaggcatcggagacgatggacagccacgagctgctcaaggtcgccgtgcaggacggctccggtctgacggcgaaggaggccgccgacaagctcgccggccagatcggcgcgcaggtggtgcaggtcatcggcaaccggttcgtgctgtaccgcaagagctcacgcaacgacatcgagcacatccgcctcgtgcgcgagtgacggcggccgaattctcgtgcgcgaatatggttgtggccccgacaccggtatcgcgtcggggccacaaccatattttcagcgcgcgcaggtcacttcttcaatgacagtgtcatagtcatatcggaatcatcgagggaaacgtcgaatgtcgcgtcaccggtcttgctccatgtgccatcaaccgtcgacccgctttgaccgggggcctgtaccgacatcgtcaatgtgccatcatccttgaagttggctgagatgcccatgcccagtcccatgaccgagcaggagaccgaccaggtgccgttcggctcgcccttggacgcgccatcggggatggtgacggtcgggctgagcgcgttgagaacggccgtgccctgttcctcgctcagaccggagctgccgatgacctcggacatcagggaattgccgatcgaatcgctgaacttcagatccttcagcgtgtatgaatggctgccattgccacttgtgaccttgtctatcgtggcgctgaccgtcatctttccgtcgtcattgcccggcaggtcaagcgacatcttcttcccgtcgacgctcagggtgccggtgttgccgccggtgctgagtgaatacgttccgttgacgcccggctgggacaggtgcaggagcaggaacacgccaccgacgaccagcgcggccacgatgatgatggcgagcacgatgatgagcggcttcttggatttcttctgcgcgaccggtgccacgggagccatggggactccggggacgcccggctgctggtattggccgtactgctgggaatcgaccggctgctgcggatacgtctgagcccgatacggctgctgctggtatccggccatttgcggctgctgctggtaagcggtgccgggcgccgcgggaacggcgggcgcgggaacgggaggcatcccggtcgtctgtaccggttgcggcggctgcgccggatactgcgctgattgaggaacctgtgctgattgaggaacctgcgaagccgaagtctgcggctgcgtcgtgtacgcaggcgtcgccggtgccgcagcggccggctgtgccgtcaccgccgtcgccgccgtcaattgtgcaccgcacgccctgcagaacaggcttccatcggcgttgtctgcgccgcaatgtgaacacactatcatcgttcttcccttctaggtccaggcccataattgacggcagccagcggccccgtttcgctctcattctacctgcatacgcccatcgtcagcggattccgtagcgcatatggtcacattccggctgatggtctcaggccgtcggcaggcagctcgggccgaacagactcttgatctcggcgaacaggctggtgtcgcgtttgacgcggaacctatcgccgaaggtcatcacctgtgcgttgcccttggcgtcgagcacggcaagccgcacttcgcagaatcccggatgccgcgtgatgatctgcgcaagctgctgcatgttgccgcgccccagggccaccagcggcaaggtgatcaggaacggacgctcgtcatcggtctccagcgcgaccggctgcatttccgtggcgcgcatgctgacggtctcgtcccgaacctcgacctggccgcgcacctgcacgaccgcatcctgtatgagctccgtgctcgccgcctcgtacactttgccgaagaacatgcactggatggagctttccatgtcctcgatggtgacgatcgcccacgggttgcccttcttcgagactcgtcgatcgacgttggtaatcagtcccgccagcgtgacctgctgcccgctgggcatggtgggcgcacggtcaatcagatgggcgatggacatctcccgcatcccggcgagcactgcttgcatgccgctcagcggatggtccgacacgtagaggccaagcatatcgcgctcgaacttgagcttgtccttcttgtcccattcctcgatgtccggcacggcgaccgtcgcatcccccatcgcgtcggcgcccgaatcctccgtgtcggagaacaggtcgaactgtccttccgcctgcttgcgcttgaggccgaccaccgagtcgatcgccgactcgtgcacggtgaacagcgcccggcggttcgggtcgatcgaatcgaatgcgcccgccttgatcagcgattcgaccagtcgcctgttcagcgcggtcaacggcacgcggcggatgaagtccatgaagttcacgtatttgccacggcccgtctcgcgttccgcgatgatgtccttgaccgcattctcgccgacgttgcggatagccccgagcccgaatcggacgacgtcgccgactgcggagtactcgtagaccgactcgttgacatccggggagagcacttggatgcccattctccgagcctcgcccagatacagggcggtcttgttcttgttggtcgccgcgccctgcagcagcgcggccatgaactcgaccgggtagtgcgtcttgaggtatgcggtccagtaggagatcaggccgtacgcggcggagtgcgccttgttgaacgcatagccggagaacgggaccaggatctcccagatcgcctctgcggcctcctcagaatagccatgctccttcatgccggcgaaaaacggcaccttctccttggccagcacctcgggcttcttcttgcccatggctcgcctgagcacgtctgccttgcccagcgaatagccggccaggatacgcgcggctgactgcacctgctcctgatagatgatcaggccgtacgtctcatcgagcacctgcttgaggggctcgtcgagctcggggtggataggcgtaatcttctgcaggccgttcttgcgcttggcatagttggtgtgcgagtccatcgacatcgggcccggtcggtacagggcaataagtgcggagatgtcgttgaagttatcgggcttgagcgtcttgagcagcgagcgcatgccatcggaatcgagctggaacacgccgagcgtgtctccgcgcgacagcagctggtacgtctcccggtcatcgagagggatcttcgtgtagtcgatgacgcccttgccgttgtgctcgatgttggtgagcgtgtcgcggatgaccgtcaagttggacaggccgaggaagtccatcttgaccaggccgagcgtttcgcacgtatggtactcgaacgtggtggtgacggtgccgtcggtgcgctccagcagcggcgaggtgtcggtgatcggcgcggaacccatgatcgtggcgcacgcgtggactccggtctggcgaatcagcccctcgatgcccttcgcctcctcggtgatgcgcttgacttcgggatcggagtcgtacagctcgcggtattcgcgcgcctcggcgtagcgcttggcgctcgggtcgaagatgtcgtgcacgctgatgtccttgcctccggtggcggccggcggcagcgcctcggtgatacgagtgcccatctcaaaggggaatcccatgatgcgcgcggagtccttgagcgcctgcttggtcttgatggtgccgtagatcacgcattgggcgaccttgtcatggccgtacttgtcggccacatagcccagcacgcgcatgcggccttcgggatcgaagtcgacgtcgatatcgggcagggacacacgctcggggttcaggaacctctcgaagatcaggccgtgcttgagcggatcgagctcggtgatgcccatcgcataggcgaccatggcccctgcggcggagcctcgccccgggcccaccatcacgccgtgctccttcgcccagttgatgtagtcggcgacgacgaggaagtagccgcagaactgcatctggcagatgacgccgcattcgtagtcggcctgcttgagcacctccatcggcgggttgccgtcgtagcgcttctccaggccctcctcgaccttcttgaggaacagcgaggtctcgtcccaaccttcggggcagtcgaactgcggcatgaacgcgccatcctcatggtcgtcgaagatcacgttgcagcgttccgcgatctccagcgtgttgtcgcaggcgtcgggatggtccttgaacagctcgcgcatctcctcggcggatttgatgtagtatcccgatccttcgaacttgaagcggttggggtcgtccagcgtggcgccggagttgatgcacagcatggcgtcctgggcgtccttgtccgcctccatgacgtagtgcgagtcgttggtggcgagcaggggcgcgccgagcttcttggcgatggtcagcagatcgccggtaaccttgctttcgatggacaggccgtggtccatcagctcgatgtagaaattgtccttgccgaagatgtcctggaactcgcctgcggcacgcagcgcctcgtcgaactggcctaggcgcagacgggtctggatgatgccggaggggcagccggacgaggcgatcacgcctttggagtaggtggacagcacctccttgtccatacgcggatatcgcatgacacggccttcgaggttggcgacggacgacgccttgatgaggttgaccagcccttcgtcgttctccgcccacatggtcaggtgggtgatcaggccgccgcccgagacatcgtcggggttgcgggcatggccgggaaccggggtccagttggtgtcccatgacacgcgcgtcttgtcctgccgcgcggtttcaggggtcacatacgcctcgatgccgatgatcggcttgacgccggaatcgaccgctgcacgccacagctcgtaggcgccgtgcatgttgccatggtcggtgatgccgaccgccggcatgcccagctccttgacgcgcttgaccagatcgggcaccttggatgccccatccagcagcgagtagtgcgtgtggttatgcagttgcacgaagtttccagccatgcgttccaccttacctcatgccgcactcaccggtagatatgttccgttaatcctcgccggaaaccctcttccgcagcacgacacacaacgtcaatcgtttgacgtaaatcgattgacgttctattgttccagtacaaaaaaaacgattccccacaacggcacggcagccgtgcggagaaccctcagcacccaacaagacctacccgcacgggcgcgctgatcggctccatcgtgctgtcggccggcttcatggccgcctgcggcctcggcatgctgctcatctacctgttccgggtcccgtccgagcagaaggacgagctccgcaaggaggccgacccgaacggcctgtgctactacaagggccgctggcacgtgttctaccagctgcacccctacggcacccagtggggcctgtgccattggggtcatgtctccagcgaggacatggtcacctgacgccgcgagcccatcgccttcgccccgtccctcgaacaggagaaggacggcgagttcaagccggaaaccgagttccgcccgtgggactgcggccacaatttctacgcgccgcagtcgttcaacacgaacgggcggcatatcatgtacgggtggatgagccccttcgtcgagccgatccccatgcaggacgacggctgttgcgcctgcgcgtgttcgtggaccgcggcagcgtcgaggtctacgtcaacggcggcaagcaggtcatgagctcgtacagctacgcgcccaagggtccccgcgcgatcgggctcgtcgccgaatccggctcgctgaccgtcacctcgctgacgctgcatcatctcaagtcaatcggcctggactgactgaggccaatccgctgacgcgatcgggaagacacgccgcaagacggtaccaagccttcaccaatcgcgtcagcgaaatcgcctttcagctgctaggctttcctgtgcaaggatgatgatctgaaaacggggaatcacatgggattgctggacaaattattcggtcgtgacacaccgtcccaggaaatcgtagggaaagtggacaaagaggggccccgcaaccccatcgaccagcttggcgtcaccggcagatcccagcgaaacgccgcctacgaggacaccgcgcacatccccaggatcaccgactacgtcgccgagaaactttcgcaactgctgcggtattccaccgaaatgccggtgctgcgtctgaccgaggacgactcccccgcacagatcaccgacagcaagctcggcggcgcgttctacgtgccggaaggcatgaaggcgccacgcaatctcgacaccggggacccgctgtatctgctggcccagctgaacttcagccaactgccgcagctgcgcggattccccgcccagggactgctgcagttcttcatcgacggcgaggacaccctgtacggagcggactacgacaacccgcagtcgcaacgctcgtggcgcgtgcgctacctccccaacgtgccggtcaccgcactgcatgccaaccgtgtcgtcaaacccgcctggcatgacgacacggtgctgccgttcaacgaccccaacaccgagcgacggctagtcgcacaggccggcaagcagacgatcacgcctactgactaccggttcgagggacggctgcaaagctgcgtcagcacgctcaacgagtacgaccacggcttcttccgcgaacatgaggcggagattcgcgactcgctcgccgcgctgctgatgtcgggcgggcaccaggtcggcggatacccgatcttcacgcaaagcgacccgcatgatgacagggatccgctgtggaacaaggcgaccgacctgctgctgcagatcgattcgaccgacgacgtgtcgttcggcgactccggcgtggcgaacttcttcatctcccccagcgatctggaacggcttgacttctcacgcgtcctctacacctgggactgctactgagcagctttcctcttctcgcccccgctggcggggctgttgagcggagcgaaactgggggtggtcttgacgcccgaggagcgctctcccggtcacctcacaacagacccgccaacacagggcgaaacgggaatcctatttcttcacgccgccgaatctgcgatcgcggtggatgtagtggtcgatggagcgccagaggacatcgcggccgcaatcggggaacagttcgggcacgaaatcaagctcggcgtaggcggcctcccacggcaggaagttcgacgtgcgctgctcgccggaggtgcggatcaccagatcgcaatcgggaatgtcggggttgtacaggtggtcggcgatcatcttctcggtgacgcggtcgcccttgatgcgtcccgccgccacctcgcgcgcgatctcggcgcaggcgtcggcgatctcggcgcggccaccgtagttgatgcagaacaccacatcgatgaccttgttgtgcttggtgcgctccatggccacctcaagctcgtcgatcaccgacttccacagcttcggacggcgaccggaccagcgcactcgcacgccccaatcgtccatctgcgcgacacgacggtggatgatctcacgcgagaaccccatcaggaagcgcacctcctgcggtgagcgcttccagttctcggtcgagaacgtgtacaggctcagataccgcacgccggcctcgatcgcaccggcgatcgtgtcgaacaccacgggctcggccgcctgatggccgtccgtgcgcaccagcccgcgctgctgcgcccaacggccgttgccgtccatgatcacgcccacatgacggggcaccttgttcttcgggaaatccgggatacgcgcaggatcggaaaatggcgccgccggaatgtccagcgacgtgtaatcgacgttttcaaaagccataccgctaatctagcaagcgcaaggaacgaatggggcgttccagataatactcgccccagtcttcaacaaatcgcaacacccgcgcatccggcggagccccgtcaagcactccccaatccccgtcgaccgccgccgagagctgcaccacctcgtccgggtcgatgcgtttcgcatcgggcgtgcggtcgatcgaacacatcagcccgccggcggacggggagaagaacatcgggcccgacatgcggctctccccggcacccccgtcatcgccgctctccccggcgaccggcgagacggcgacatgccgtccgcacaccacgcatgaatgcagccgcggagtccacccggccaaagccaacgcacgcagcacataggattccccgatcgccgtcgccggatgcgcgtgacgcgccagcgcgttcagcccgccgaccagcagacggtactgcgcgacggcccgctccccttcggcggacaccagtttgtcggcggtctccaccatgacattggcgatgccgtacgccccgtaatcggcgcagatcggagccgcatacgccgaaatggactcggcctgcgacaccacgtccagggtccgtccagtggcgatgagcacgtcaactcgcatgaaaggctccagccgaccgccgaaccgtgatttcacacggcgcacgcccttcgccacggctcggatcttgccatggctgcgggtcagcaaggtgacgatgcggtcggcttcaccgagtttggccgtacgcaacacgacgccttcgtcacgatacagcggcataagcgcttcctcccgttcctcgcgtatccattggttccgccaccgttcgctgcggcgaacgccgtcagtagacgaacaatccccagaacgcgaacatcagcagaaccgacagcatggtgacggccgtcacccagaacagcacgcgtccaagtctggtcgaggcgagcaccggatcacggcctgtcatcacatccccgatcgcgcccttgcgcggagggaaccggatgacaccgcgcagcgacgccacttcgatcagacgggccaacacgcgggaccacgcccacaccaccactgtgcacaccacctggatgaccggccagctccaatacatgagtccgggcttctctggcggggcaccgccccaggcaatcttcaccacacccatgatgacctgtccgagaccggcgccgaacagggccagcgtggccacggtagtgaccgtcagagtgagcagctggttgccgaaaccatgcgagaaccccagcgccggaccggtgcgacggatcatcgcgcgtatcttcaccaccagcgcgaccacggcgatgaccagcgaaagcaccatcatgaacaccatgaacacgtgcagcagcagcccgtacaccgtcaggccgcgattcgccttcaggtctttcggcactgctatcgactgatacaggttcacgcctcccacgcgctcgctcgtctggcgcaggcccttcgccgtgccgaccgcccaatccaccacgtcagcggcgtactggtccgcgaacggcgtcccggtttcggattcgtcgcccaaccggagcacatgattggccacgggatagccgcggatgctcacgtcatggttgcccgcgcgcagggccatgtccacgatcgcctccacgccctccacctgggcggtcatcacgtccttcgatccatacgctaccagcgtcggaatcgaatacgcgctcggcttgagcgtatggacgtcgggaagcgtgacgccgaacagcgcggaatcgatgttgaacacgcgccggactatcgactggtatccgtcatgggctccgaccagcgcgaaatcctgtgcggcgaggaaccctatcgcctgtcgcggcgtgaacaccatcgggctgagcagcacctggaacgcgatgtccttgtccatgtccagcagatatgacgacacccatgtcgattccgaggtcgcgtagatgccgacctccctgtcatccacgttgtcgaggccgcgcaacatgcggatcacttcgtcatagacggccgccgagcccgtataatcgcgcgttatgtcgttcgtggaccataccggcttgtcgagcacggcggtgacgaatcccgcggacgacaggtcataggccatgtcgacgaacgaatcgacggcggaaccgtagcccgcgccgtgcatgaacaccatgccgggcagcttcccggagacgccgacaggctcgcggatgatgacatgcgtgcgttggatctcgcccgttgatggtctcttcgcgtcgaaccatacagaccgctcgctcacctcgtactcgccgcgcttggcgaggtgaacgccgcccgggttgtcgaacgtcacgccggtatcggcggacagtgtcgacaaagtctgccctgtgggctcattgttccacggcatggccgtcgcattggagacgaacaccagcaggccgatgaggatgatgaaaatcggcacggtgcacatcagacggcgccatcgcgtccaggcggccggcgacgccttgtcgcccggttgccgccgcgatgcggccgattcgtcggatacgcgcgacttcccgtctgcgggacgttcgccgcggcggatacgaaacctgttacgctgccgattcaacacgcaaccatactagccaatccgccggtcttctgcgctgtgagctgacgacatccggccgcgctcaggccgtccggccggatgccggcggcgacggcggccggacgccgatgaaaaacctcagcgaacggcgttcatcgcgttcggatgctggatggggatgacgacagggccggtggcgcctaccggcacctgtccgtcggcctccatctgggcggcgatgtcgttggcccgcgcgagcagcgtctcgacgatctggtcttccggcacggtctcgatgaccttgcccttgatgaagatctgtcctttgccgttgcccgaagccacgccgagatcggcctcgcgggcttctcccggcccgttgacgatgcatcccatcacggcgacgcgaatgggcgcggtgacgttcttgagtccctcggtgaccgcgttcgccagctggatgacatcgacctgggcgcgaccgcagctcgggcatgagatgatgtcgaacttgcgcttgcgcagtcccatgtactccagcagcttgcagccgaccttgacctcctcgacgggcggtgcggacagggacacgcggatcgtgtcgccgatgccttcggccagcagcgcgccgaacgcgaggcatgacttgatggtgccctgccatgccggccccgcctcggtgactcccagatgcagcggccaatcgcccttggatgcgagcagccggtaggtctgcaccatcgtaatcacgtcgtggtgtttgacggatatcttgaaatcgcggaagccgacgtcctcgaacatgtgggcttccttgagcgcggaggcgacgagcgcctcgggcgtgggaccgccgtacttggcgtacagctccttgtcgagcgatccggcgttgactccgatgcgcaggctgacgcccgcgtcggtggcggccttgcagatgtcggggccgacctggtcgaatttgcggatgttgccggggttcacgcgcacggccgcgcagccggcgtcgatggcctggaacacgtacttcgactggaagtggatgtcggcgatgattggaatcggtgatttggcgacgatctgcggcaaggcgtcggcgtcatcctggctgggcaccgctacgcgcacgatgtcgcagcctgcggcggtgagctcggcgatctgctgcagcgtggccggcacgttcgcggtgagcgtgttggtcatcgactgcacggagatgggggcgccgccgccgaccggcaccggcccgaccatgatgcgacgtgatttgcggcgcggatgcaacgggctctcgctgatatccggctctccggtcttgcggaacgatcctgtcacggccgacgccgttcctgtggtcgcggacgtctgtgcactggtttgcggcaacgcgctcatgctgatgattggtctttcctgttcgattatgcgcgacaccacatccatgccggggcatgactgattgatcgcatggctgcgccatgccatcaatccgggcgcggtcgcgcgaatgattcacttctgactgtttatcaaatcatcggctcgccggcgcgcctcacgctcgacttgacccatttcctccacggatgcgaacagcgggttgccgcgaagctccccgtccatcgcgtcgacgacctccttgaccgtgtcgacgatgcccagatagggcagtcgatggtcgaggaaggcatgcacggcctgctcgttcgctgcgttgagcaccgcggtatgcttctccgacgcgcgtaggcactcgcgcgccaacgcgacggcggggaacgcctcgtcgtccagtggctcgaacgtccactcgctggcatgcgtccagtcgcacgccgccgcgacatcacccagacgatcaggcgccgacaggcccaaggcgatcggcagccgcatgtcaggcggggacgcctggcagacggtcgctccgtccacgaactccaccatcgagtgcacgatggattgcgggtgcacggtcacgacgatgcgatccggcgccacgccgaacagacggctcgcctcgatgacctccagtcccttgttcatcagggtggacgagttgatggtcaccacgggtcccatatgccacgtggggtggttgagtgcctgttcaggggtgatgtcgctcatgtcggcgcgcttccagccgcggaagggaccgcccgaggccgtgacgaccagtctgctgacctcggcgtgggtgccggaccgcagcgactgccagatggcggaatgctccgagtcgacgggattgatctggtcatcgcgcacttgcgcgccgaaaagcaggtgaccgcctgcgacgaccgattccttgttggcgagcgccagctgagagccagccctcagcgccgcaatggatggttcgagtccgaccgagcccgtgatgccgttcaacaccaggtcggcaccggaaccggcgatggcgttgaccgcctgcggcccggcctgaatctgcgtgtaccgagctccgacctcctcgagtgcctcatgcagcgccggaacggcggcctcgtcatatacggccacctgcggcacatgatgacgtgcgacctgctgtgccagaagccgcacatgcgcgcctccggcggccagaccggtgacggtgaaccgctccggatgccgactgatgacatccagaccttgcgtgccgatcgaaccggtcgatccgagaatgacaaccgtattcctatactggctcattgcaatgcttctttatgtcttctgtggtgtatctgtcttcccgcgccgacgaaatggtcagtcgttgtccttgccgaaaccgctcagtccgctataaaactcgcccgtgttgagcgtggggaacgacaggtcggggatgtcgaaatcgagcttgctttccgggctgaggtacatgctggagaataggtcatccgacgatgacttgtgagagccatcggattgcgtctgcgcggcatcgtctacggcatgaacgggaacgttcgccgacggcgacgaggacggcgcgaacgacggcagggcctcgacactggcatcggtatgggcgtcggaggccacgggctgatcgaagaccggcatgggggccggcgcggagggagcaacggcgggtgcggctgcaactggctccgcgggaaccttcacggacttggcgacgcgttcgggagcctgaggctcggcgactgcggccggctgatcggataccgcggcgtgcgagggggcgaacgatgccggtgccgccgagatggccggagacggaatctccggtgccggggcaggagccgcggcatgatccgcgctcacgttgctcgagctcacgcttctgccggtgcgccgggacagcgccgccaacgacgactgcggctccggggcggaggctccggccgagaacgtggacggaagcgctgaggcgggcgcggatacgaccgtaccggacatgccggcgggagcgaacgagggaggaacggactgcgcatcagccgcgacgctcggctcgtcggccgtctgcgatgagaacagcgcctcctctgcctcatggagggcatggaacgattcgttcgcgggcgcgaaggactgaggctccgcttcctgccgcgccggcgacggcgcatatacataggcgttgtccgcgccgaacaacggcgtcacacccgcgtcggaggcgctccttgcaccggacgaacgccggctgccgccggattcgtgaccgccaccgacataatcggagacgcgcgcgaacgattcgagacggctgagcaactgcacgcacgagttgaggtaataatcgacctgacgctcgtcatagccgttcttgcccttgcgctgcgtgaacaccacgttggagacggcaccggaattcagatcggcgagcttgcgcacgtcctgttcgctcacgccgtccacgccaaggcctgcggcggccttgtccacgatctggtcgatcagtcggtcgacctgcttgcggtcgtacgacggccggcgatcatgtccgcgcgcgaatcgctcccccgtgccgcggtcggcgtgctcacatacctgacggtacagctcttcggtctgggccttccacgccacacgaccgtgctcggtaatctcccgcgtcgtctgcttgtcgaccacggcctgctccagccgggacagcgccgcatcaacctgggtgatgtcatacccgcccttgctcagatcgaaggacacgttctggatgtcctgctgcgtgagatgggcatcctcgctctcgtagagcgcatgtgcacgatccaggaaagcgtccacctgatcgggatcgtatccccatttgcgcttcccaacgcgagcgatccccgatgcgcctttatctgccccgtcttgatgcgccattggtgtatcgacctcctacggatagtacttctcttgcacactttacgtgagtgttgagacgcagcttcacatttggcccagcaaaacggcatcctcacacgtctttcgcacgattacggcatatatcatgcgccggcaagcacagcatcgccacggttcgaccgacggcggaattccacccaacgacactcggccggcgtcccgatacagactatacgatacagtgtgagtctgcgggcaattagctcagttggttagagcgccacctttacacggtggatgtcaggggttcgagtcccttattgcccacacattacgaaacggcggaacaccgccaatatcaggcaccggtgtgaaactgattccggcatacgcgccgcctgaggacggcaagccgcgcaacgcagtggacgagaaatggatgaagctgaccaacagcgctcgccactatctgtcacgcagggcaaacacccgggaagacaccgtcgatgaatctgaatctcgtcatcgagcgtgaatgctccagagaccatcagacagccctcagacagttcctgtgctgcaagccaggagaccccgaatgggcgatggacccacaggatatatacgcggtctcagcgtgcgcaagaccccgaccggagttatgcgcacgcttcttgtcatatccggggacattcccctgcatgatgaagtggccggcttctgcgaatacggtgtcggcgcggaaaccaccgaggagcacgaaggcatctaccagatttcgtacatcgccaccgagctgaaggtacggggcaacatctcggagacacgctgctcgcctcggtgattatgaggcttcgtgatgatgcgtggcgttccaatcgcacgccgctcgtgctgactcaagtggatccgcgcaacaggccaagcatggatttgttctctcgcttcggattcatggatgaggggccagaccccgatgacccggaataccatctgctgcctctggaattcaccggcaccaattacgtaattggtgatcagcagggctttcctgccgcttttccgcaatatatctatcgcgttcgtccgtgaccttttcgacttggctgtcaatacttgattgagtaaaggcgaagaagaaatcgatcgcactccaggcaagcaggcaattcccagaatcagaaccacgatcgccgtaacgagactcctcacattgttaattcgcttcctgatccttatcctccaattccctgttttctttgagacaacataattcttcgacagtcacaccgaacacttccgcaattcggtaggccaacattagcgatggactatattgttccttttcgatggaaataatcgttctgtttgaaacatggaccaagtcggccaattgctgttgcgtcagctttgattgttttcgcagttctctcactcttgtcttcaatcaattccttccataacatgaagcttacttctcatgaagttaacttcatattaccgccaagacgcgaatacgtcaacagaaaaagtgaagtaaacttcaccaacccagaggtatgcgggagatgaattcgcgcggctccccgctgacggggtcggtgaagcgcaatgaccgcgcgaccagttccagcggcgtggagaagtcgtcataggcgcgttcgacgatacgcggatagaaatcatcgccatggatcggcaaccctatcgagttcatgtgcacgcgcagctgatgggtcttgccggtgagcgggtgcagctcgtaggcgcgcagaccgttcttcccgtggcataagcgcccgcccatcgagggatattctcccgccgcgagatcgatcaccgtctcggcattgacggtctgcggctcctcgaacgcctgcagcacgccacgcagcttggtgatgtgcgaacgtcggcgcagcgggaacacgacaggagggtccagccgctcgacggtgccgtatcgcggccgtgtcgtcggccggcacggagccaggcattcgtaggtcttgctgatcttccggccctggaacatcatctggtatgcgccccgcagcgctggatccctcacgaacacgacgatgccggcggtgagccggtccagccgatgcgcgggcgtgatgtccggctcgtcgaacatctcgcgaagccgaatcagcgcggtctgccgataccacatgccgcgcggggtcgtcgcgaggaaatgcggcttgtcgatgacgatgatgccggcatcctcatacaccacgtcgatatcgaacgggatatggggctcctcactcacccaccggtgcggtctgtccaaagcgctttccgcccgtcggctctcaccgggagcgcatgttcttgtagcgcatggcacgcagcgcctcgcgcttgtcctgctcctcacgcagagcctgacgcttgtcgaactcgcgcttgcctcgtgcgagggcgatctcggccttcgcccgaccatccttgaaatacaggctgagcggcacgatggtgtaccccttggcctcgatctgacgggacagtttgacgatctgctgcgcatgcagcaacagcttgcgcttgcgcttgggcgcatggttgttccacgtgccgttgagatattcggggatattggcaccttccagccacatttcaccccgacggtcaatggagacgaacgcctcggcgagcgacgcccgtccctcgcgcagcgacttgacctcggtcccggtcagcaccagtcccgcctcgtgacatcacgcgcccgaacaaggcggtcgccaaccgtgtggtcggcgatgtcaagggcaaggactgcgtgctcgtcgacgacctgatcgacaccgccggcaccatcgccggagcctgccacgtgctgcgtgacgcgggcgccaagtccgtgaccgtggtcgccacgcacggcgtgctgtccggtccggccgtggaccgtctcaagaactgcggtgccagcgagatcgtgctcaccgacacggtgccgattcccgaagagaagcgctgggacggcctgaccgtgctgtcgatcgcgcctctgctcgccagcgccatccgcgcggtgttcgaggacggttccgtcgcggagctcttcgacacgtaccccgagcaccacgggcagggcttcctgttcgcatgagcttcgatttgacgaagtcgcgaggtatggcataataaaaacttggcgggttcaccgccattcccccatggtgtaatggcagcacacgggtctttggaaccctttgtcttggttcgagtccaggtgggggaactttcgcgcccggttccgcggcaatccgcggccgggcagcaatcctgcagtcggcagagaactggagtcgcaccgaaatggcactatccgccgcaatcatcctcgccgcaggtgagggaacacgcatgcgttcgtccaagccgaaggtcctgcacgaattcgcgggtaagaccttcctccagcgcgtcatgacatcagtcggacatctggagcccgagacactggccgtcgtcgtgcactatcaggctgaccgcgtctccgaggcggcacggtcctacgacgcgaacgtcgacatcgtcaaccaggacgacatccccggcaccggccgcgcggtccagtgcgcgatggcgcagctgacccaggaacgcaacctgcatggctcggtgctgatcgccgcgtccgacatgccactgctcgactccgtcacgttgaagaagctcgtggcgttccacgagcagagcggcgacggcgccaccgtgctgaccacgatcctcgacaacccgaccggatacggccgcatcatccgcgaccgtgacggccacgtgctgcgcatcgtcgagcagaaggacgccaaccggagcgaactcgcggtgcaggaggtgaacacgtccgtgtacgtgttcgacgccgatctgcttgccgaggccatcgcgaacctcgacaaccacaacgcgcagggcgagttctatctcaccgacgcgctggagaccgcgaagacgcgcggcacggtcggggcgttcgccgcgcccgacccgctgagcgtcgaaggcgtgaacgaccgcctgcagctcgccgcgctgtcgaaggcgcacaaccgtcgcgtatgcgagcactggatgctcaacggcgtgacgatcctcgaccccgacaccacgtggatcgaagacgacgtcgaactcgcgcaggacgtgaccgtgctgcccggatcgttcctcaaaggccacaccgtgattggtcagaacgcggtcgtgggcccatacacaacgttgatcgacgcgaccgtggacgccgaggccgtcgtcgaacgctcccgcgtgcagggctcgcatatcgggcgtgccgcgaacatcggcccgtggacctacatgcggccgggcaacgagctgggcgaggagaccaaggccggcgcgttcgtcgagatgaagaaggcgcacatcggcaacggcaccaaggtgccgcatctgagttatgtgggcgacgccgaactcggcgagcacaccaacatcggcggtggcacgatcaccgccaactatgacggcgtgcacaagaaccgcacgcacatcggctcgaacgtgcacgtcggcgccggcaacctgttcgtcgcgccggtcgaggtcggcgacggcgtcaccaccggtgccggttcggtcatccgccacgccgtgccggacgattcgatggtctattccgaaaacacacaacacatcgtcgagggctggaagcccgcttgggagcgttgatccaatgacagcagtccagagttccattgatgccgtgcgcgtcgccgcagtcgcggccgaccgcatgaaagccgccgacatcgaggcgttcgatgtcagcgacctgctcgccatcaccgacatcatgatggtcgccaccgccatgaacgagcgccaggtgatcggcgtcgcggaagaggtcgagaaggacgtgtacctcaagtgcgggcatctgtccccgcgctcgcgcgaaggcgtcgacgaaggacagtgggtgctgctggactacggcgatttcattatccatatcatgcatcaggacgcgcgagagtactatcgcctcgaacggctgtggcgtgactgccccgtcgtcgagctgcctctcgaacaccccgagacgacgggcgacgaatccgccgacaacggcagtgacggtgacgatgccggcgaagctgatgagtgacgtctcctcgccgcaggcgatgccggagcacgtccgctccatcacgctgatacggcatgggcgcacctcatacaacgcccggcattgcttccaggggcagattgacatccccttggatgagatcggcgaatggcaggtcaggcagaccgcgcaggcactgcgctccctatacgtcgaatcgcacccggaacgccggcagctcgtcgtggcatccgacctgagtcgtgccatggccacggcgcacgccttcgccgacccgctcggactggtcgtgcaccccgacgcccgcgtgcgggagcgcaacttcggcgaatgggaaggcaaggagctggccgaactggagcgcgaatgccctgaggactaccgtgcatgggcggaatatcgcggtggcgaactgcggcatggtgccgagacgaaggccgccgtcggcgagcgaggccgcgcggcattggaggaatggtcgttcagcgccggagccgacacagatctgtacgtgttctcgcatggctcatggatcgcgcagaccgtgcagaccgtgctgggattgggggctatccaccccgatttcgccgacgtggtcagcatgggcaacgcgcactgggtgcggttcgtcgcagccgacatgcccgacggcacgttgcggtggcggctcgtcgactacaatcatggtccggcgctcgccgacaccgatcagtgggagcatccggccctatagcaggctcctgatgctgcgttctccccgtccgtccctctatccgccgttccctgtacgctggcagaggacacatcgcgtcccgaatgacgggctacgatgggagcataccgtcatcgacagcaggaggagaccgatcatggccaagaacatcgcagacggcgacatcatctggacgcagcgcaagcgcaactggtgccgcaccccgttcacgttcaccacgtacactctgacggccgacgagctggccacgcagagcggtctgctgcatcagagcttcgacaccgtcaagctgttccgcatcgtcgacatcacgatctcgcgcacgctgctgcagcgcatcttcggcttgagcacgattctcatcgacgcgatggaccagtccaccggcggcaagatcgtgctgaagaacatcatcgacggtttcgccgtgcgcaaggaactgcagcacgcggtggatgccgcccgcaatgtcaaccgcgtcagcacccgcgagttcatgggcaccggcgacggctactacggcggcccggacggacccgacctcgacggggacggatacccggatttcccggccagatgatcgctgcggcacacccggtcacgggaaacgggaacgggtgtgccggatgaggagaatgcgatgagcggctatggcatgagcgtcaacgacacgaccatctggtggcaggtgtatccgctgggattcaccggcgccccgatacgcccgtccaacgagggcgagcgggcgttgacgccacgactcgacgccatcatcccgtggcttgactatctcatcgacatgggcgcgaacggcctactgctggggccggtgttcgcgtccgagacccacgggtacgacacggtcgactactatcgcatcgattctcggctcggcgatgacgccgcattcgacaggctgatcgatgcatgccgtagccggggcatccgcgtgatgctcgacggcgtgttcaaccatgttgggcgctcgttcccggcttttagggacgcgctcgccggccacggccacgagtcgatgttccacatcacgcgaaatgcaggcgggggagtggactatcgccggttcgaggggcaccccgaactgccggaactcaatcatgactcggaagaggtcgtgcggctcgtcaccgatgtgatgttgcattggctgcggcgtggagcctccgcatggcggctggacgccgcctacgccgtgtcgccggcgttctggacgcgtgttctgcccgccgtgcggcgcgaattccctgacgtgtggatcatgggcgaggtgattcatggcgattaccccgcgattgtccggcaatccggcatggattcactcacccagtacgagctgtggaaggcgatttggagttcgctcgaatccgcgaacttctatgaactggattggagcctcaaacggcacaatgagtttctggagtcgttcgcgccgcagacgttcgtcggcaaccatgacgtgacacgcattgccagtcgtgtaggagatgccggagcctcccttgcgatgaccgtgctgttcaccgtcggcggcgtgccgagcatctattacggcgacgagcaggtgtttcgcggcgtcaaggaggaccgcatgggcggcgatgacgcggtgcggccggcgttccccgcatcgccggatgatttgcctggcacgggggagtggatgtatcgcctgatccaagggctgatcggcatccgccggcgcaatccgtggctcacccacgccatgacgacgccggtgacggtcgacaacaggcggtacgcctatgatgcggtcggccatggcggagagcgtttgcatgtcgagctgtcgctcgacccggcacctcatgcggtcgtcagcggctcggacggcacggtgctcatgcgcgtgcagcacggcgactgacggtcatccgccgattcctcggtgaatggatgcctatctcgctttcaaggggttgattcggtgacgctgaaacatctatctgcgtttcaaggggttgccggccaagtatccaagctccaggaaccgcatgacttcaatggcaatccggccggaatactccggatatcgcaatctggcaaccccctgaaacgcagatagatgttccttgagtgtggaatcaacccctcgaaagcgagaaagcggagcgttttcttttggttgcctgccggagagcgtgcgtaaacgaaaaaaccggtcgaaatcgaccggtttcaatctgtggagctaaggggattcgaacccctgaccctctccatgccatggagatgcgctaccagctgcgccatagccccaaattcatttatcggctgctttttgagccgattgataatttacctcaagtcggtatgaaaaccaaactgggcgtgtcgtacagcctccgtcacccgcgtcatccgtctcacccgcccaaagtcccatctgaggatggctaaatgggactttcgtcggataaggggcgacatatgggtgtggggaacgtggccggtgggccgcttatccggcgaaagtcccatatgtggctgtctggtgggacttccgcgggataagcggccggatacgagtgggctgcttgatgtcacgcctggttgccggacttgccggtgccggtggagccgccaccggaggaagaacccgatccggatcccgacgacgacccgctcgacgaggagccggagtcggaaccggaaccattggaaccggagttggagcttgctccgtcggagccggagtggcccgatccgttgccggttccgttgctgcctgagcccgacccggaggagtcggagcctgaggagtttccgttgccggttccggtggagtcggagccgttgctcccgttcgagccatttgatccgttggagctggaagacccgttcgacgaggaggagtcggaaccgttgccctgagtggaatcggtcgatccattgccactgttggtcgagctgttgctgtcgccggtcgagcccttgccggtcgaatcggtgccgtccttcgttgtcgaatccttggtgtcgctgttgccgtcggtcgtgtcgtcctgcggtgcctgctgcttgggctcggtcggggtgttcgactggcgcacccagtcgcggaccacagtatcggttccctgaccttgggtgatggcgaggatgacgccggcggtcgcgcctaccgccaccagggcgctgacgacggcgacgatgatggcggtgcgcttgttgcgcttcgcccgatcggcctctgacctgaaggtagcggacctggaggccgtgaatctggctgcggcaggccgggcggacgtgcgcatgccgcttggcgtggcggcgcgggccgaggacggtggcgccggcacggggggcatcccgctcgcaatcgtcgcatcggcgtccaccggggcgttgccgatcagttgcgtctcatcgccgtgcgacagccgccgtgcagcatccgaggcgacggtccgcggaccgtgaccgagctcgtgtgatgcgggggccggcagcgccaccggattggcgatgatcgctgtatggtcctgcgcattggcgtcggtggaagcggttgtatccgtatcagccgccgtctccgtagcgccgtcgtcctcgtcgcccgtcgtccccgcgacatcctgcagtttccggccggattcgtgcagtacgttctgatagatctgtgacgagaccgccgacacaatcgaaccgatcgccacgccgatcaccgaaccggcgatgccgattttcgccgataacaggaacgaggtgaccgccgccaacgcgcctgccgcgatagacgacagcgaaattcccttgaaaaagttcttcatgttgaacgacgctagcggttccttctcgaacttgacttatcttgcggcgaaaaatgctgaaaaattacacggttatagctgaatctgcacaatcgtgcgactgattcgggagaacggccatgccggcccggtcaaatcagcggacgacgatatcagtatggccggagccgacctcgaaatgataccgtgcgatgcccaggcagatatcggcctgaacgccctccaaaggctgcgcgagaaccgtcttgccgtcctccagcagggtgaagcgcaccggctgcttgcccaatgcgctcggagccagcgccaccgcgcgaagccccgacaggaaccaatccggagcaccggagaggtcgccgttctccacggccccgagctcttccataggcttgctgcgatgtgcccggcccggtctgttgccataccccaaggccagggcggcgggcatgcgctcgccctcgcctagccgccagcgtccgtcatggtcgtgcgtctcgtgcaacaccacccaacttgagtccatccccagctgcgtcgccgtcagggcaaggcgctcgccgtaatagccgaccttgcggtccagctgtgccgggtcctcgtcgtcggagccgatcagggcgatgcaatagcggacgttcttgaagcgaccataatgggtcgggcatcccccgaacgcatccgtgtcgtcctgcaccagctggacgtcaagcccgccgtcggcgttcgccgcgtccacggcctcattcagcgcgcgaagcgtatcgtcatcgatgggccggtcgctgaaatcgcggaccgcgtggcgccgctccattgcctcgacgatgttcatacatattctccttatacaggcttgcgctgccgctcgacgccgtccataatgaagacgatgacgggtcgcgatgaggacggtggcttcacccaacatattccatccaatatcctagccacggcgcgggtctgcgtgcattgtgtcgtccgtcgtttgcccggattcccgggccgggggccgcgcgcggccatccgcccgcgacgccgggcgcgggatatgcgggacgcacgactatgaagggcggaacgattatgattcggcgatatcgtgtttcgagcgggaatgccgcgggcggaagcggcggaaacggccgcgaggaaggccgagaggacggtcgcgatgatggccgcaaggccagtcgcgcggtcggccgcgcggtggccgccgcgatggtggcgctcctgatcgtgtccgccgttttggcgggttcatggctatggtcgcgccgcgacggcatcatcagcggggtgaaggcgttcggcgtgaaggcctcgtccatgtactcgcacgcgcgagagcccgacacgacggtgacgccgcccgacgtgtcgcagcgcaggtatcccgtgttgaccagcccggtggatttcaacggcaacggtgtggacgactatacggacatcatgcgcggggcccgcaaggatgcgctggcgcacccggcatacgacgacggctactaccagggcggatacccgcccgccgaccgcggcgcctgcgtcgatgtggtgtggcgcgccttccggaacgcgggatacgacctcaaggccatggtcgatgcggacatcgccgcggaccgcgcgtcctattcgtcggtggccgccaaacccgaccccaacatcgactttcgccgtaccggggtgctcgacgtgttcttcggcaaatacggaatcaccctcaccaacgatgtcaacgatcatgcgcaatggcagcagggcgacatcgtcgtgttcgaccgtgtcaagcatatcggcgtgatctccgacaagcgggacgctgacgggttctcctacgtgctgcacaatatgaatcagcagcggcgtgagaacgattatcttgcgttctcgcgccgcatgggcgtcaccggccactaccgctgggacgcgtctcgcgtgccgaaatccgtgttgcgcgcgtggaagggctgagacgccgcgcggcgcaggtgagattattcacagtcggctgatttcgctatgaggccacaggcgtttgaagtaggctgatatgtggaataaccagtgtgaccatcaccaaacgaaaggatcgtgcactatggcaacgctcaccgccgacatgaagacgttcatcgaaaacaacctcgcgtggatcaccaccgtcgacaaggacggcaacctcgatctcggcccgaagatgtcgatgttcgtgctcgacgacaaccacctcgcctaccacgagcgcaccgccggccagcactaccgcaacctgcaggacggcagcccgctggtcgtcgccgtcgccaacctggccgagaagaagggctaccgcttccgcggcaccgtgaccctgcacaccgacgacgacatctatgacgcccaggtcaaggtcgccgaggagaagggcactaagaagcccgccgccatcccggtgcttgagatcaccgagatccaggacctgtcctccggcgccaccgcaggcaagaccatcgacaaggactgaccgtcgacaggtgccggtcgtcggcgagaccgatgaccggcatgtgaccagaaaggcgcggttcgggcgatgcatgcccgaaccgcgcctttctggtctttcgataccggctttcgtgcaacgctgtcggctgcggccggcagcggaacggcgacggagggccggcgacggcttaatgtcagcggatgcggtaacgatgcccccgctgcgtgatgaagaatcccatgcgccgcatcttgcgcgtcaatgagtagagcgtgccgtccatgatgtcacgctgctcgaagatgcccgtgccgcagaccttctccagcagctcgtcgaagctgaggaattcgccgttcgcccggatcagcgtctccagtgtcgtgtattcgcgcgcagacagcgccagcggctgcttgccgctgcgatagaacgcctgccgattgcgcgtgtcgagcatgaggtcgccgtggatgagcgtggtctcgtccgcggctccgccggattccagcgcgcgcacgtaagacagcagttcgacgtccgagaacggcttgacgatcgtttcatccgcgtgaatgggcgggacgctggaagcgccgtccagagacgatgggggcgcggccggccgggcggcctgcccgtcggccttgtcccggcctgttttgcggatcgtcggcaacggggtctgccgtctgacctgcggcgtgtcgtccgggttcgccttcggcgtgcgcgggggagtggaaagcagcagcgtgcgcggtcgcacggccgtgccggtgccgtcgccggccttgccgtccatgagccgggacaggctccgtctggtctcatccaacagatcatgcgcagacaggtcgtcgatgatgaccagatccactggtgtgccgtgcggccatgcgccggcgagcgaatcgacatccgacgcggcagacaccgtgtgccgggcggattccagcgtgcctttcaccgcggaagccaacgccggatcgctggtcacgaaaagaatgtccattgcgcctcctgcctatgtagctactccccactgtagcccgtcgccgtgtgttcgggtgaccggtcgtcacaatatggggcgccgggggccgaggaggacacccgcccgggccccggccggccctcgccgcgtttcccgtgcttaccttttctgcggttctcttctccttcctgaggatgaatgccgcccgtcgtggccgaggcgcttgccgtccatatcggtctcatggcggatggcccggcggcctgcgactcggctacagtgaaaccaacaggggaggagcagacgatatgggattcttcgagagcttttcggcgccgttcatgatgtcggtggcgttatggccgctggtgtcgttcatcgtgaccgtgcccgtgctggccatgctgtaccaccgggacaaccggctcggcttcggtgcggcgctgtcggcgtacgcgacggtgctgtatctgatcggcctgctgtgcttcacgctgtatccgatgccggacgatcccgcagcgtactgcgccacccaccatctgcatccgcagctcaatccgctgcagttcatcggtgatatccgcgccgacgggctgacggcgatcctgcagatcgtgatgaacgtggtgttcttcgtccctctcggcttcatcatgaaacgggtgttccgctggaaattcgcggtcgccctgccggtcggctttctcgcgtcgctgcttgtcgagacgatgcagctgacgggggtgatgggtgtgtttccttgctcgtatcgtctgtttgacgtggacgatctgatatggaacacgtcgggcgccgtgatcggatacggttgcgccatgctgttcgaccggctgtttccgccgcggcgcacggatatgcagacggtcacccggccggggttcgtgcgtcgtttcgtggcattcctcatcgacatgggactggtcgtggtgtgcgcgacccctgtgggcgtcgccgcgatggtgctggtcacgatgatttcgggccgtcctggcgccgacgtgcagcggatgcggctgctcggcccgctcgggttcggggacatcgcgatgctggtcatgctggtgctgttcgaatgggtgattccgtggttcagacaaggccgcactctcggcggcagctacacgcatatgacctgcgagaccacgccgaggagcggcgctcgccgcgtggcgttctatgcggtgcggttcgccgcgatatgctgcgtggtgttctgcgggcgcgtgccgtgggcgggcgcggtgatattggtcatgggcgtgttctggctggtccgcggacagatgccgtacgacttgatctgacgtcgctcgccgcgtcgtcggtccagctttccgggacaatggaatcatgagcaacaacatacttgtcatcaccagcaaccccgaaaaggacagcatgacggatgccgtgggtgcggcattcgcggcgggcgccgtcgagcgcggcgcgtcggcggacgtgctggacctgtacgatgaaggattcaatcccgtgtattctgcggccgaccgggcccattatctcggccatgccccgatgcccgaggacgtcttgcttatccagcgccggctcgctcaggcggatgtaatcgccctggtgttcccgatctactggtatacgatgccggcgatggtcaagggactgttcgaccgcgtgatctgccgcgggttcgcctatcatccggacggcacccccggcgcgctcgcggacaagacggtgcgggtcatcatgctgaccggcggctcgcggcaatggtatgagtccgatggcatcggcgagtcgttggacaatcagatctgccggcagaccttcgccaagtactgcggggtgaaggacgtcgagctggtgtacgtcgacaacctgtccatgggcgacgattcgtccgacaagcgtaaggccgccgcggcccaactcgaaggcatccgtcaactgggcgccagcctggcgtgacgcccataagccatcaccgccgaacgagcctgcggccgatatatggtgccgctcgacccgcggtggctctcacacgcgcatgttcgggaaatgcaggcgcatgaagttgtcatcgaaagccgcctgatatgctgcgcgaaccagttgtcgaacaccgcgccgttggcgcgctgcccgtacaggaagatcgcgggcggcgtgaccacggagtcgatgagaatccacgccagcagtatggtcgcgagccgcgtgtgccacgtgtcgtcgatgagatgcacgagccacaggacgagcggcaggatgaaacggacgatcagatagcacaacagcccccagaacagcatgaacgggacggtggtgcgcccgccgatattcagcggctcgttcgcatagttccatgaccggctgcccagcagatactgttggatcagactcatcgcgagctccagcatgccgccggcgagaccgccgaccagcacgaccttccaccccaggtcgatacggcgcagcgcgatgacgatggccaacgcggagaccgtacacgtagttgaagggggtgaggatcgatccgttgcagtactcgaacatgcctttggcctggtatgcccagatgatcttgtgcacggtgccgatcagacctgcgagcgcgtagacgaacacacaatccgcccagtcgcgagggcggggctacctgcccaagagcttcgcgtccatcgaccgcaagaccggcaagccgaagacggcgaacatcgtgctcgccatcgcggccgagctcgtcatcatcggattgcaggtgctgccgttctccccggccgcgctcaaatccgcatcatgggtgatcgtggtggtgtggatcgtgctgggactggcgttgcgcctgatgagcctgcgctcccggcgcgagtgacacatcgccgtcgccgcccgcaagccgcaggtaatcgcggtcgtgggatttgcgtcggggtacgaaccggctgatgacggaaacgcccttgccgcggttcctcacatagatgaacccgatgacggagaacacgaccgcgccgatgaaattgacgatgagatcctccatcgtgtcgatcaggccgatgtcaagatagccgccaaggccgaggtcacgcccattgaccgccacctgcgtgatgtcgttgatatgaacggcgtgattggcgtgggccggatcgagcatcaccgagctgatcgaatgcacgacggcgtccttctgcatgtcgaatccgaacagcatgtccatcgagaattcgaagaactcccagaccacgccgatcgtcatcgagaagcagaacgacacaatcgccaggtacagcggcgacagctcgaacttcacacggtccgaacggttgagcaggtcgaccagcgaaaagccgatggcggccgcgaggaagccgttcatcgtgtgcagcaccgtgtcccagaacgggaagatctcatagaacgagctgatctcacccaggatctcagccgcgaacacgaacaccaatacgatgacctcaagcgcggacggcagttcgatgcggaaccgtacttggacgaacgcgggcgccagcagcaacagcaacgtcaggatgcacaggaacacggcctcatagtcgccgttgaagaacttcagcaccgcgacagcgatcaccagcacgcgcagcacgacatacaccgcgaacgagcctttgtgctcccggatctccatgcctatggcggcttccatggtcttccagcgtgcgcgcaacggcggtttgttcttcgatttgcccatcgctccagtctatcggcgacgggctgcgcccggtggcgggcggcgtgtcggtgctcatcgagcagctggacataccgtggcctgcgggcatgggcggcatggaagaatgcgctggtgaacagtcgcaggatggttctgctcgaaccgtaattgagcggcgaacggatccagccgtgcaggcctaccagtggaccactggtcgagtagccagaactcgccgagatcacgggcgatcatgtcgaacggcgtggcgcatcgggccttgtcctcccaagagagcacgaccttgtacatcagatgggcgttgacgcgcacgtcgatcggcacgtccctgtcgacgcacgtgatgcgcagcggcccgtagcggtagacatgccgtgatccaggatcgcggtgtcggaacaagaacgacatggacggctctccctgtgatgcattgtatcggacggcagaccgtcgaacagacgctgtcgctgttcggctccagcgtcgtgcaatacgctattttctggtacctggtcttgcggtcgaactccggcatggtcatgaccggagcgatggtcgccgccgccctgccgcaggcaatcgtctccgtgttcgggggtgtctgggctgacagatggaaccgcaaactgttggtcatgcttcccgatgccgtcatcgcggccgtgaccatatgcctgtcggcaagtatggccgtcggctggggcgataccgggctgattcttgtcgttctggtcatacgttcggcaggcggcggaatccagaccccggccgtgcaatcgttcatcccgcagatcgttccggaggcgtggttgctgcgcgtcaacgcgattaacggcacgttgcagacggcgatcagcatcgcctctcctgcaatcgccgcagccctcgtcaacctgatgccattgtggatgatcatgctcgtcgacgtgtccacggcgattgtcggcataggcttcgtcgcgctgattcgtttggatgatgcccgtcttcgtcgtccgggggagagctcggatgacgcccctgcgcgccacatcgatttcggtttcgtcgtgctctccaattccgctgacaggcttgccgcgcccacgtacacgctcatgcaaaaggagagcgacgtgtccatgcaggggcgagtattgggtctgctgacctcggtctcggcattcggagtgcctgcgggcatgctcgtgttcggcccgctcgccgatgtggtcgatgtacgtctgctgttcgtggtcggcggtctgatgaccgttccgatcggtgcctatgtgatgagatccgcgcggcgaaatcgggtcgctgagtgagtgactgacaggggttcatcgtgcgacacgcccgaattgtgtagcaggactgtcttacatgttctgcgggaatgacggaaaaaggccattttccgggatgcgtgcttgcagttctgctacgcaattcgggcgtgtcgcgcagcgtctcgctttgccggactcgccggcgatgtgcgaatgagctgcacgcacgggttgactgtgcgcgctgtccgtgagatggaaccaggtgtcttataccagccgggcggcgggtgtggatgtcatgacagcggccggaatcaggccagcgtcgccgtgatggtgagatctccggtctcggtgccggcccacacgccgtccgtgcggttccagcgcatgccgttcgcgcgcaacgaatcgatgccgtagcgccgtgcatggaccaccagccaggccgtcgcttggcggcatagccttttcccgttttcggtgtcggttccggccgacattgtgaacgtcagtgtcttggacgtggtcttgcccgagccgtcattggccgcggaattgtcggcggccttgtcgccgccgtcgtcttgcgtcttcgaggaaggctccagactcgacggctgcgataccatgacggtcgggaattcgttgcggaaatcactggtcagaccatccatgtccgcgtccgaaggctgcgccggctccagcgcgcacgcgacacccgcgccggtctcgccggtcagacccgccgcccatgtccgcgcaagattggtccagtcggcgtacctatccggatattgcgaacgctgcaccgactgcgccgcgtcctcgacggggacggactgccagttcggcaccttgaccagctcgtcgtagaacctgttcgccgcatacgtctcgtccatcagctgctctttcgcgccccacccctgactgggacgctgctggaacaatcccacggaatcccggtcgccgtagctcaggttcatcagccgcgtctcctgcatcgccgtggcgatggcgacggtcgcggcatgatcgggcaggccccgtttgactgccgccctcgtgatgatttcggcgttcaatgcctgttcaacggacagcatttccttgttgtcgccggaagacagcgtcgcggaacagtaggcgtccgacgcccggcgtggttcagggccggaagcgggccatacgaagcgcatcagtcgtggaatcgaggcgaacaaggcgatggccgcgcacagcatcaccgcgacgatgatcacggtccgtcgcatgccgtgacgcggccgttcccgacgcgcggcgggtcgtgcgtgccatgtcggcgacagctcatgccggatcggcggttgcccatcacgaggcgagactgatcgcgttcgccgagccgttcgtcgtccggccatctgctcacctccagagtcgtttccgcgcagtgtatctgttttgcgtgtcgttacgtgtctatcgtgccatatgatgctgcgatgccatggcatcccgcaggatgatttgtgcggggcgtggcgagaagcatgttccgtggctgccgcgtgcctgcctgccgtggccgtttgccgtgcccgttgccatggccgtcgtgtcttccgccgttccggccatcccgcgaagcgccccatcatccccaaagtcccatttgctccgcccaagatgggactttgggcggatgatatcggataacaagcggatagaatactgctgtcatgtgacttatgctgcgcgtacagtggcaggtatgttggatcacatcacattgcatgtgcgggacgtcggacgcagcatcgctttctacgagcatgcgctcgcgccactcggctacatcgtcaaggcccaccacgagcccacgttgggtttcggcgtggatgacgggacgccgcactccgacttctacgtgtctgcgctggatgatgccgcgctcgcgccgccgcccacgcatatcgcgttcctcgccccgaaccgtgaggccgtgcggggtttccatgccgcggcgctcgccgtcggcggccgagacaacggcgctccgggaccgcgcccgtatcatctggggtactattccgcatttgtgctggatccggacggcaacaacatcgaggccgttgtcgactgggcgggatggttcgaaaaccatcgctgacaggcggtgcgaacgattgttgtacgactgtacaacagcgtcgggctgatgccggtacgttcgtacatcaggtgtttcggatatcttcgacggtcccgagcctgatcggcaggtatccatgccgatcggcggcacaccgcatgaccgaccatacgcctgcgcgacaggatgacggccatccacccgtggtacgcgccggtcgtgcgttggatgacaatcggctgcatgccggacgcgaaccgggccgtaaacgtctgcgacatcaacgggcagcagaaccaccagacgagaatcagcatcgaccattccgccagatggcggtcgcggctcagccacaaccacagccatgagaagttcgtgaacccataacttacgctcatccacagcagcacccagaacatgctgccgccgctgatcgaacgtgaatgcgtcagcagattgaacgcgccatagcccacggcgaaatacacgccgcccatcaccagcccgaccagcagcgtcatgtatttgcggcgccacaccagcaacgccgcgaaaccaatcagaaacgccacatccagccagatgtacgtcggcatgaactcccgccgcgcgatgacgtccgacacgtccatgaccccctccgttggctttcaccgaatgttcctgtgctcagggtatgcccaccgttggtcgggccggtgggagatgacgggttggttgggccggctgggtcggtgaaaatggcggggtcggcttgggctgtcgacgatgagtcgcggtttccgtgcgtttgcgttcctaagtgcgcgccgaaccggcaagtgcgcgcacatagcaacgcaaatggccctgtttgcgtccctaagtgcgcgcggtcgtcgtttcggcgcgcacttaaggacgcaaacgcctgttgcgttcgtctacacgcggctccgtcgtccgccgcggctcagcctgtcggcggaggctgcccgtgccggccgtgcgctcaaccgtatcggggaagaagcgccgatctgcggcagaactagaacagccgcatgggctcctcgcggttgattggacggatcaggctcggcccgtcgccctccggcggagcgacctcatggaaatgcagccgcgcggacagctcggcaccggccttgcgcatcggcgcgagcagacgggcgccgtcgattgaaggatccagccactcggacgtcataccggccggcaccagcagcggcatacggtcatgcaccgtcgccggcccatccaccgcagggcacgtgagaatcgtcgccgtcagctgccatagggatgccgcggaaggccgccgccacgaatacagcccggccatcgcaagcgccgtcgattccatttccgggctaaaatagaacgggcgccgccccttccactcgtaataccccgacgccggaatgatcgtgcgccgggagcgggtcgattccgcgaaggtggatttgacgtgagcggattccactcgcgcgttgtaggtggggtagggcagggtcttgccagaactccagctgggaatcagcgaccagtatgcgccggtcaggtgtcgatgcccgtctttgccctgcgcgatgacggcgatgttctgcgttggggtgatgttgtacgaggggcgggggagaacgtcgccgcgcacgtcttccttggccaccgagaattgcgccgcgatggcgtcccaatccaggtcgagcgcgaatcttttacacattcgtccagtctatgataagaatctgtgcaccgagaatgtctaattgcgaccgccacacacgtcgcggggaagatgcaaacggggctgaatgaggaggattatgcctattgcctggcatgagggcggtgtccatgttccttctgctgcgggcaatagcgctgcgtcggcctgttcggtagcttgatttcggctcggaaggtgccgggtgcgggcctgctgacggcgagcgtggcctgcatggcgtcggtgcatgccttggcgatggacaggccgagtccgtgcccgggcctgttggccatgcgggtgtcgtcgccgcggtggaacggctggatcaggtcctctgcgtccgcggcgttttctggaggtctggtggtgttatcgatggtgatgatggtgtggttttcgccggcttggacggtgcaggttatggcatggggctgcggagcaccttctccgagacgcgggttcggagcatggccttgacccttcggtacccgtacccgccctcggaggcggcgaacgccccggccgcccggcgcgatgccgggcaagcatgtcatcgagccgagcgaacacgccggcctcaaccggtcgatcaacagggtcttctccctgtccgacaggcgccgcaggccggcgcccgcgccgaacagttcggcggcccgcttccgccgcatgccgcccggcaacggacatatgatatcctttcgcccagtctccaagaaaacgtccgcaccctgttatccgggtgggctagtatggcggaaacgaaagggcgagaatgcggttgacggaagtgtggcgggcggatccggagcggacgtttgagctgttctctgagtttccggcggacgagaacgggttcgagaaccaggcggccggcatggaccgcgagcggttcgccgtgtatgtgcatgagcttgaagaacaatcgcgtggcatcggtctgcagcctggctgggtgccgagcagcaagtacgttctcatcaatgatgagggtgcgtatgtgggaatcttcaatttgcggcatcgcctgaacgacaatctgcgtgtcggagccgggcatataggctatggcatcgcccctcaatatcgcggccgtggatatgccacagtcggcttgcggctcacgctcgacaaggcgcgtgagctcggcattgacgaggcgtacctgagcgttcataaggacaaccgggcgagtcttgcggtgcagcagcattgcggggctcgcatcgatcacgaggatgggctggaatactatacgcgcatcagcacggcacccgaaccggggaacctgcccaaggcggaattcatgttccccggacctgaacgtgaccgtctggtagggctcattcttgccggaacgaagaccgcgaccgccgcattgatgattgaatacgaagaggatgacgaaccgctgccgcaggtcggcgaacgctcggcactggtggattccagtgaacggccggtggccatactcgtcaccaccgcggttgatgttattccgcttgggaagatcaccgaccggcacgccatcgatgagggcgagggcgacaccacggctgccgcatggaggcatacccacgagtccttctggaacgcgccggaataccgcaacgagttcgctgacccggatttttcgctgaacgatgactctcttgtggtgttcgagcatttcaaggtcgtgcgactgttggactcaatggcaaacaagacggcagacggctatgaacagcaagtgtgaggtgatcaggcaatttgtcgccgcgcatggcggtcgcgccgagctcatcgagcatgagacggcgatcgaagattcatatcatacgctcgccatcgatccgcgactcgtcgtcgaatgcaacgccatcgccggctgtttcaacggcgaggatttcgtcaagccgctgtgatttaagaaccgaagctgatgtccagctgctcaatcaccttacagtcagtccgggcctgctgttttcgacgataatggtatgggtgggtgaaacgaaaggaacggtagctgatgactccgattgaattgtcgacccgacgccgggtcacaggactgacctcggatgagttcgccaggctgttcgtctcattgcagcgtgaagtggaaggcgaggctgcgcgttggagcgcgacggacgtcgaagcctgggagttggtcggcccgccggtgaccgccgaacagcatctcatcgatacgttcgcgatggccaatgaattcgtggcgacgctggcggatcgtttgtatcacacgatcatgcccgtcacggaggggtcggtcatcaccgcatacgtcgatgacctcacgttctggggagcgcacccggacctaggcggagtgccgtgcgcattatggaacatcgccgcgttgcaagcagccgaatgggtgcgcaaggagaccggcaccatctgcgaactgcgtgcacgcgaaccgttggtgtgatggccgggttcgtgcctcggcgcttgtgcggcagcgtggcctcggtgacgcacaagcgcaggagactgtcatggtcacggtggtctagaatgtcgccgaacttgctgatgcgtggtgtgctctctcctttgcctcatggcgtatgaggaagttctcgaccaacgcgatcatcgtgtccttctcggcgggcgcggatagcgcgatcatcagcgccattgccgtcaaggcgttaccttccacgagcagggcgtcgtcgtcgcccttgggaggcattgcccgtgtcatagtcattgagcagctcgagactcggcagatagcattccagaatctcggcagtaccggcaatctatcaatatgctcaaacatttgttcgatggcgtgtcggcagtatgtttcggcggcatcgctcgcatcgataggcgacgcgttgcaacagttcgactcgcgacaaatacaggtgacgggcgcacgattgacatgatgggtggcaaggcgtgatcagaacgtagttctcgaatctcatccaagccgtcacggctatcgcacttttcgaaggctcagcacgaagccggccgcgcacggggccatgacgatggatatggcaaatgccgccgtaaaggtgccggtcacggtcttgaccgccgaggtgatggagggccccaccgcctggccgagcgtggtggccaggttgaggatgccgagatccttgccggcctcctcctttcattgccgacatcgatctctcagaccgcggtagcccgcaaacggcgtccgtttctgggactgagacggcccgagtggtacgcatgatggaaactgagtcgggaatcggcatgctgacggtcaattacgtcgtaatggaatggctgagcttaggcggatatgagaccttgcgatgggaggacggacggaccatgatcgccgcagaccgcacgttgctggagcaggccagagagctgcaggcactggcccagaccggattggcgtactgcaaggatcccctcgatcgggagcgttacgagcgcatccgcgcgatagcggtcgacatgctcgccatgcaggccgacgtgccggcagaagagatgcgccggccgctcggcgccggatacccgacgccgaaactcgatactcgcgcggccatcgcgaccccgactgggtgacgctgttcgagtgaatcccatcactgtgcgcgggtattgtcacgctgagacctgaatgaggagcgcatggccacaccagcgcgaaaatgacccagatcggcattgtgcggcaacggttctgccacacaatgcgatgttttccttaacattcgctggtgtggccagcgttgatttatcggaaccgccattttgcagcgttttgtcattcgccgtctttcgccgttattccaccgcgtgccacaccacgtcatattcgggtgaaaatggcctagtgtggtacggtccgcatgatctgattgtcggtcatgccgggaggggaatgatatttgttcggtgttctcgtcccggatcgggggagaacggcgaaatctttcgactcgtcgcgtgtcgcgtctttcggttgacgccgcgtaaagatctatcctgttggcagcgtcgcggccgctgagcgatgggtgcggctggatgcggaggagcgcagtcggctctcacggattcgcgaaagccgactgaggcagtcgcaggattccatgctcgccgatgccgagcaatggaggcggttgttcgatacgggagtcacgtcggattcgccggaagtgcaacggctggccgcgcagattatggacaagaacatcaaggccaaggccgccaaggcccaagtgccgcaggatgcggaagaacaggccgccatgccgttgtcagacatgttcggcgtcgtccgctctgctctgtgcggcgacccacgctttgccgatccgtgtggagcggcgctgtacggcagcaaggcgtgcgcagacttcgccaacgaggccactcgcattcacgttcagcgtcttgcgcagcagcttgaacgacagctggaccagcggccggctagtagttgatcatttcgagttccggccccatatcctcggtctgggtcagtccggtctcgtggaatccgatgtgtcggtagaatccctgagcgttggtgttgaaaccgacgacccacaagacgagccggtcgttgccgactgcctgccgtccggcttcgaccagagcgcggccgactccgtggcgatgctcggattccaacacgtacaatgacgccagttccgcggcctcgggccgattgatcgggggccgcggagtgcgcagcagttcgatgaatccgaccacacggtcgtcagccaacgcgatcagcacaacctggttggggtcggcggcgtggccacgggtcagcttgagtgcgaatgccggggtgatcgcatccacgatgtcctgcgggatatgcccctgattgagctcgcgccatgtacgcgattggacttcggccttctgcgtgaaccactgcggttcgatgggaacaatgcgggtcgtcatgtcttgcattatatgccgttgccgcagagacgcccgttcgtgaatcaggcgatccttcgccatctgccggggtgttcggcatcgcgccattcgcccgcggtgatgatgcggtagacgcagtcatagtgacggtcgatgagcgggaaataatcctgtttcgactcggcgacgacgtgcaggccgcacttggcctgaactcgcccggattgcgtgttctcggcgtagtggccgccccataccgcgtccttgcgcagcgtgtcgaaggcgtagccgagcacggcggtcaatgcttcgggcatgtatcccttgccccagaacggccggccgatccagtatccgagttccagcgcgctgtcgccaaggtacttgccgtagcgtttggtgagttcaggatcggcggcaacggcgtcggcggtgcggtggctgacgggcttgagcgcgatgctgcccacaggcgcgttgctgttcggcgcgccgcccttgatggtaatggcccagttgttttcgaccgcgaggatattgcgtatgtcatgcatgctgccttcgacgctggtgtgtggcggccagccgcatctcagcccgatttccgggtcgctggcataccggaacagcgatgccgcctcagccgcgtcatcgaccttccaagggcgcagcagcagtcgttcggtctcgatggtgttcatggcgatgcctctcgttcgtttgcctgtcgggtacggacaagaataacaccgtatcaggggggggcgtgcggcgggatgccaaaactcgcaggtatggggcctttcccaccgaaaacggtcgtatctccaagttttggcatcccgttgcgttatgtacgcttgacatcccgcgtgcgcaagccaatcatgggacgcatgggcatcgcaatcaaacggatatatgagtcgccggaggcgtcggacgggtatcgcgtgctggtcgaccgtctgtggcctcgcggcatgacgaaggagcgcgcggcattggacctgtggatgaaggacgtcgccccctctccccagctgcgcaagtggttcgggcacgatcccgccagattcgcggaatttcgcgcccaatacatcgcggagctcgatgccaacgctgctgccgaggaactgctgcgcatctgcgcggagtatcccgacgtgaccttgctgtacgccgccaaggaccctcaggtcaatcatgccctggtgctgcgcgattatcttgaggatgcgactgcggcgaaatgaaaacggcgccgacccgccacgacagccgggaaccatcgccgggaaacgatacgaatgaagggacaacacggatgaaggaactgtatatcggatcgcacctgtccacggcaggcgggtggagcgcgctgctgaaacgctcgcatgaggaacacggcaccacattcgcgttcttcccgcgctcaccgtacgggcggccatccaaggcgctcaacccatccggggccgtcgcattcgcgcggcagttgacggccgagcattacggcccgctcgtcgtccacgctccctacgtctacaacctcgccggcaaggatcccgacaagcgcgagttcgccatacgggcgctcgccgaggacatccgactgctgacgccgatccgtgagaccgggcaggagatatacatcaacatccatcccggcgcgcacgtggggcaagggcccgatcgcggatgctctctgatcagcgacggcctcaaccgcgtgttcgggctggagccgggcatcatggtgctgctggagacgatggcgggcaagggcaccgaatgcgggcgaaacttcgaggagctggcgaccatcatcgacggcgtcgatgacaaggcgaacgtgggcgtcaccgtcgacacgtgccatgtgctggacgccggttatgatctggtgaacgacttcgacggcgtgatgcggcagctggacgacgtcatcgggctcgaacgcgtcaaggcggtgcacgtcaacgactcccagttcggcctgtcatcgcacaaggaccgccacgccaacatcggcgacggccacctcggcattccgttcttcaccagaatggtcaacgacccgcgtctgtcacggttgccgatgatcctcgaaaccaaggaactgaccgagaccaagcatcgcgaggagatcgccctgctgcgcggtctcgtgcagtgagcgtaccagtgggcgcggccgcgttctccgtggcggtgacgcgacgggagacgccgatagcgccgtcttgtgctagcgtggtttgtccggcgaacgtgacgcgcgccgagccaggacgagtggaaagcgaggcctttcgtgggtgatatccgacgggagatggaacggctgaggccggtctatgaaaccggcgtgctgagactgctgctccgtcagaattcgatgatgtacgtggcgctgctccgcgcggccttcgacccgttgaccggcgagctgccccgtgagaccctggaggaaagcttctcgcaaagcctgtcccggctcgtcgactccggcgaataccagctcagggaggatcagaccatcgcggacgcctcccggcgcatcctcgccgacctgacccgtgagggcgatgacgattacgcatggctcgccaactcgcatgacgccgcgtcgcaccggttcctgtaccgtctcaccgcccgcgcccatcgtgcgatcgaggcgctgtcgcggcttgaggatgactcccgcacgctgtcgggcgcgcaggcgaactcgatcatcatggagatcgagcatgcgcgcatgcagcttaccgccgaccccggcgagcgcgtggcgttgctcaaccgggagatcaaggcgcgcaaacacgagatacgtcagatacgccacggtcagcggcaggcggcgctcaccgaatcgcaggtcgaggacgtgattgcagtgattcacaacacgctgcgcggcgtgcccatagacctgcgtgaactcgtgctgaccgaacgggacaacggtgacgcgctccgccgccgcatgcaggcgggcgacatgagcgtcgacgacatcctgacctcgtaccacgacgaataccgcaggtccttcagcgagtccgacagcggaagacgcttcgaggacgcgtttcaggtgatcatcaccgacgagggacggcagcagatcgacgcggccctgcgcgacatcgcccacacgccgtatctggccggcgagtccggcgtcctgctcgatcaggtgcgtgccgagctttcgcgcatctatgacggcatcgaggcggtgcgtcgccagatgcgcgtatccgacgaggcgatcagccgtctggtgcgacagcagaccgatacccgataccgcacgatgctcggcaagctcaaccgtctgtatgcccacgtcaacgccgacgcgaaggcgcatcagggcgacgatgcgagaccgtaccggaccgataccgcggccggcaggttccctccgctgccgtcgcgccccgcgcgcccgatggtacgaacgaccaccccgggattgtccgtcccgcagacaccgggcgatgcgaccgcgcccgacctgcgttcgatgatcgacaacgggggaccgcggctgcggcgcatggccgcgctcatcctcgaatcgcccgtctacgcggacgacgggaacggcgccatcgacatcgtcgccagcttcaacgggctgccgaaagccgagcggaaggaaagcgagctcgtcggtttcctgggagagctcggctgcggggacggagccggcgtcgcatggcattgcatatcggcagacggaagcccgagggactggatcaccggcccagtgctcgcacaagaggatgaattgcacgacatcgtgaaggaggactgacatgagcgacctgacgaacgacgccgcccagccggacgcggacatggacatgattgacgacgacatgaccggtaccgacagtgccgataccgacagtgccagtaccggcgcggatgacatgggtgcggtggacgtcgaatacgatggcgcggacgcggaaggcgcggtcaacccatacgccctgttcgagggcgacacgggcgacatgaccgccgacgcgcgcatggtggcgatcatgctcaaacgcgagcgctacatcagcggacgtttctatgacctggcgctcgacaaccgcgcggcggtcatccgttcgctcaacaacgacctgctcgatctggtcgtcaacgagcactaccgcgtcatgtacgccaccgcggtgagcgggccggacatgacgctgcgcgcgctcaagacccgtgcgagcctcaaacgtgaggaggcggcgctgctggcgttcctgcgcatccgcgtgctcgaatacgagaacgcccacgtcgcgccggacgaatggctggtcagcttcgaggagatccgagcggcgctcgccaccggcgccgggtacctcgcctcgcgcaacgacgaggagggcgtgctcaggcaggtgggtgcgatcgtgtccgtcatgtgcacgtacggctatctcaggcagctcgacgatgacgagacgatgtaccgcatcacgccgctggtgccggtggtgctggaccgtcagctggcggacagctggctcgcagtcgcggaccgggacgacgatgacgagccggccggtgacatggccccggccggctcgcggtctgcagccggcgatacgtcgaacgccgatgcgagcggcgccgatgacgatggcgattcggacgatgcgggacccgacgccgaactgttcgaggctccgctgttcgatgatgacgccgatgcggacgccgccgaggacatcaagggcgccgatgatgccaatggcgcgaacgacagcgacattgacgacgagaccgcctcggacggcggcactgcacgggaaggggagtgacgatgagcggcaaggacatgcagatgatcgccgaccgatggatgatggaaagcaggaggctcgtcaactggggatcctatgagggctaccatgagttccgtccctccacggactcgcaactgccggtgacgttgctcgccggcgcgagcgaatccggcaagtcgacgctggtcgatgcgcagatatcgctgctctacccgaccggcacgcccttcaacaaggcgtcgaattcggggcgttcggaacgaagcgactacacctacctgcgcggcatgatcggcgtgggaggctccgacggcgtcgacgaaccgatgtacctgcgcggccgggacgagtccggcgcgccccggtccatatggggcgcgatcgtcgacacctaccgcaacttcaccactggtcagatactgtcctgcggcaagttcctctatctgatgcccggcgacgggcgcggcgacgtccgacggctgtacctggcatgggacaagccgatcgacccgcgccgcatggacgtgttccgcgagtcgtcgttcacgcccacgcagctgaaatccacgtatccggggtgcgtcaccttcccgaacgccgaggcgttccacacccatatttgggatgtcatgggcctgagcgcggaggcatgccgtctgctggcccgcatccagtcggccgacgccccctcccgccttgacgacatcttcaaacagggcgtgctgggcgtgcccgaggcgctggacctggcccgtgcgaccgtggaggattacgagcgttacgacgcgaacttccgaagcatggaggaaaagaccagacgcatgggcaagttgcgtgccatcaccgccagctatgacgactacgagtcggcccgtgacgcggtccactcgttcgacgcggtgaacccggccacgaagtccggctcggcgacgatccgagcatgggcgatccgccgcatgatcggcgaggtcaacgaacggcagccgctcgacaggcgtctgcgtgacgagcgacgcagtgaggcgcgggctgccggcaagcgcatcgaaagcctgcgcacccgcatcgacgcggtgcgcgagcgcatgcgaggcctcgacggcggcgacctgacacggctcgacgcggaaatgcggcaggcggaacgcgcgctggcggacatcaccgccggcagacagcgcatcgggcgcatgttcgaggcggccggcgaggagttccccaaagacgagcacgcgtgggacgagcggcgcatcgaggccgtgacgttcatgcgctcatatgagcagcgcaagggactgctggacgacatgcgcaaccagacgtacgccgcgcacgcgtccgtcaagcagacgctgcagcggctgaacgacgattacgaacgccagaaatcgcagcgcacccgcatctcccgccagatggacgagacccgcgccatgctgtgccgggccaccgggctgggcccgagcgaactgccgtacgtcgcggagctcatggacgtgcgcgaggatcaggagcattggcgcctcgccatgaacgccgcatacggatccatggcccagaccatcctcgtcgacaagcgccatgagcgtggattcgcagccaaggtcagcgccatcgacccgcacgccatggcgcggcgcacctggcagttcgtcgacaccgaacgcgggggagccgggaacgggcccggcggcgcgaacacgggtgcgaccggcggaacggccggagaggtgtggctgtcctcgaagctgcgctaccgcgaggattccccgttcgccggctggctgcgcgagcagaccagctccgagcgtctcgacgccctgtgcgtcgacggcatcgacgactccgaccatgccgtgcggcaggtgcaggccgacgggcagatcaaatccggcaaacgcggccagcatggcatcaaggaccgtcagcaggtcatcggattcgtcaacgaaagctatttggcgcaactgcgcacgcgcatccaggacgcgcaacgccaatgcgacgagaccgcgcaatcgtacgcgagcgcgaaggaacaggccgaccgcctgcagcgagagcgcgaactcgccgaccagctcgcatacaccgcatgggagaagatcgacgagaacagcgcgaaggcggcgatcgccgacatcgaacgcaccatcgcctcggtcaggaacaatcccaagctcgccgaactcgacacgttgcaggagtcgctgtccaaggagctcgaccgctcgcagcgccagcgcatcgacatcgaacggcaggccgagctcgccgatcaggcggtgaacgcagcgcaggcatggctcgacgagcatgccgcgcagccgcagccgcaaccgcagacgcggccgctcgatggggaagcggcggacgtttcgccaaaagccgtcacgaacggacggactctcctgacggacgaggtggaggaggcgctcgccgaatcgtatgagcagcgtctctccggtctgggggatgcgacgacccgcgcccacatgatcatcggcgcgggggcgccgcagcgtatggctcagggggataccttcgccgaccgtatcatcgccggcatcggcaaggacctggaggcgcgcgtctccatgctcgaaggtcgtgcggcatcggcccgcaccgccgtcgaggcgcggatgggcgcttatatcgagatgtatgcgggcggtgacgatacgatcgccgccagcgtggacgactaccggtattaccaggacgagttggaaagcctttcgaagctcgccaccgtcgaagccaccgccgtcgaataccacaactgcctcgacaagctgctgatgagcttcctgaccatcaaacgcgcgatagacaccgacgccggagatatccacgaccagctggaacgcatcaacgcgatgctggacggccagcagttcggcccgcgccacggcagcctgtccctgcacgcggacgtgcggcgccccgagcgcgcgttctggtcggccctgacccgcgtgatcggcaccctcaacgaccgcaaggcggcacagacggatgacgatcttgacggggcccggtgcgcgttcgcgtcctgcgccgcgatgatcgacatgctgcgccgcgagatcgggcagatcagggacgtcaacggcgtgaaaagctacggcgcccgcaacctcgacccgcggtgccgatcctcgttctacgcgctcgtgcgccactcggacgggcaggtcgaacgcatcacctcgaccggcggacggtccggcggcgccctgcaggagctgacctcgttcgtgtacggcgcggcgctgatctacctgctcggcggcggcatggacaacaagctcaagccttcctacacgacgctcttccttgacgaggcgctcatcaaggccgacggccggtatacgcggcgcgcgctgtccgtactgccgagactgggtttccaggtcatcgtctccgcccctgaaagcaagacgggcgagatactggaggtctccaccaaggcatacgtgacccgcaaggaccccgacaccggctacaccacgctgcacgaagccagactggacggcatcgatgagacggaaggcgcagatgagccggaaggtaccgtcgagtcggatgacgccgccgaataggcggcgccgatgacgcggcaaaccatggccaggatccaggacggcctgcccggccggagtatagttgcactgacatccaaggagcgacagatatgagcgacgcgaacacccagaacacccagaacgccggcaacgccggacccgtcgcggcggcacccgcccagggcaagcagctgccggaggcatgcgagcacaccaccagacacagcatcaccgtcaatggcggcgaactcgactatgcggcgaccgtcggcacgatactcatcgacacaccgaaggtacccaaggccgcgagcatcttcttcaccgcgttcgacctcgtaaacggcgaaggcaagacagacccggcccgaccggtcacgttcatcttcaacggaggcccgggctcatccaccacgttcctgctcatgggttcgatcgccccgaagcgcatcaacgtccccgacgccgctccggtgccggccgccccctacgcgctcgtggacaacgcgcacacgctgctgcccgtctccgacctcgtgttcatcgacgcggccggcgccggattctccgagatcctcgacgcggccaagccggaactgtggtcggtggacggcgacgtcgccggcttcagcgcgttcatcagggcgtacctgagcaaacaccaccgctggaactcgcccaaatacgtgctcggcgaatcctacggcaccacgcgcggcgcggcgctcgcataccggcttcagcaggacggtgtggcgctgaacggactgacgctcatctccaacgtgctcgactacacgttcacgtccgacctgatcgacgaattctacgtcggatatttcccgtcctatgcgtccgtggcgaaatatcacggccgagccgcgtcggacgtcaagctcgacgagcatctgaaggccgcccgtgccttcgccgcggggccgctgcgtctcgccctggccgccggggactcgcttgacgacgagacccggcataaggtcgcacgccgatacgccgagctgaccggactggacgagcggtatgtctacgattccaatctgcgcgtgtccgatccgaggttccgcaaggcgctgctgcatgacgaggacaagatcgtcggacgctacgatggccgcgtcgccggctacgacctcgaccgcatgaacgacgaggagacgttcgtcgtcgacgacgcctggctcgaccccgcgtattcgagcctgtgcaacgcctatctgcgcgacgagctcggctgggaccgcatgccggagcgcaagggcttcgccgacttcgactggaacgccaccgagccgggcaagggctggatgtggtggcaccggatgcccggcgaatcgggctgggtcatgacccaaccgaacgtgttgcccgatctggccgcggccatcgcgcaccagccgaccatgaaggtgctgctcggcaacggcgtcttcgacctgtgcacgccgttcttccagaccgaatacgacatcgatcacctgatgctgccgaagccgctgcgccgcaacgtggccttcgcctactacccggccgggcacatgctctacagcagcgaggcgagcctcgccaagttcaccgccgacctcacgcggttctacgcgtccgatgtgagcggactgtccgcgatcgacgagcgcccggcggccgtggtcccgtcgatatccctgtagtcgcgggtgcatcgtgacgccggacgcattccgccatcggtgttacagccgatcggatataggtcgatgcctgtaggatgtgtgatggcacggattcatgcggcgacggtaaggacgaacatgattgacgaagtggtgtttctgcggcacggacggaccgccttcaatgtggcgaggcggttgcaggggcagatcgacgtgcccctcgacgtcatcggccagtggcaggccgaccagagcgcgtcggagcttgcgcgacgctactactgggcgaaggtggccaacatcgcccggcatccggatacgctggcccagccggggccgggggcggcgaaatccagcgacatcgaggaataccggcaggtacccgcatcctcgcgacgcatggtcgtcgtctcgtccgacctgttccgtgcgttgcagaccgcgcacgcgttcgccgatatgctggggctggacgtgaccgcggacgcgcgcctgcgcgaacgcagcttcgggcagtgggagggcatgacccgcgacgagattcgagcggagcatgccgacgcctatgattcgtggcgggtccacaccggcggcgagctcgcgttcggcgtggagagccgcatcgccacaggactgcgcggcgccgatgcggtgctcgacctggtgcgcggcatcaacgcggagcatgccgatgagccgaccaccctgatgctcgtcgggcacggctcatggcatgtggccacgatcgagaccctgctcggcatggaccccgacaacctgagcaacctggatggcatgcgcaacgcgttctggtcgacgctcagaccggtataccggccttcgggcggcgtcgaatggatgatgacggcgttcaaccaggggccggcggtcgctgctctgtgcgattgggagaacggcccgcagtccctgcacggcccacacatgccgatgtggaagccgatcgaggggtgaggccggcggcggggccggccgcggcggatttgcaagtcgtggcataagggctatccttgttgaggcttccagacgacgtgacatgccgcccgcggtccggtcatgttcggtagtgttcggttatgagaggtgggtgagactacatgttgaggatgttcagcacgattaacggccaagtggagcagatcgaaaaacctgagaacggctcctggctgtgtctgtccgaacccaccgacgtggagctcgccacggtctcccagcagaccggcgtcgacctcgccgacctgcgcgccccgttggatgacgaggaacgttcgcgcatcgacgtcgaggacgattacacgatgatcatcgtggacatcccgaccgtcgaggagcgcgggggccgtgactggtacgagaccatccctctgtcgatcatcgtcaccgaagacctcatcatcaccgtatgcatgcaggacacgccggtgctgcacccgttcatggagggaacgatccgagggttcaacacgttcatgcgttcgcgcttcatcctccagatcctctaccgcaacgccagcacatacctgaggtacctgcgcatcatcgaccgtgaaagcgacaagctcgaattcaagctgcgtcacgccatgcagaaccgcgagatcatgatgctgcttgagctgagcaagaccttggtctatttcaccacgtcgctcaaatcgaacgagatcgtcatggagaagctgaccacgctcgcgcgcatccagcagtacccggacgacgaggacctgctcgacgacgtcatcatcgagaacaagcaggccatcgagatggcgaacatctacagcggcgttctcgcgaacatgaccgacgccttcgcctcgatcgtctccaacaacctgaacaacgtgatgcgcatcttcacgatcatctccatcacgctgtcgatcccgacgctgatcttctccatgtacggcatgaacttcgtgccggggcagctgggcatgccgttcaccggcaagacatggggcttcacgctgatcatcgcgatatccgtcgtgctctccgccgtcgtcgcgtggttcctgacccgttcgcgcatgttcaaatgacgggaacggcatgacagggctgcaacacacgaaggcggggcaccggcgcatcatgcgtcgcttttcggcggcgctggctgcggtgctgtggactgcgggatccctgaccgcctgcggctcctcgagttcccggaatgatgcgaacggcgtgtcgatacggcagccggaggggcccacggtgtcgatcggcgtcgcctccgaccagcccggtctgggcgtatggcacaacggcgggtattcaggcttcgacgtggatgtggcccgttacgtcgccaaggcgctgggatacgcggacaagcagatcgtcttcaagccggtgacgccccgttcccgcgtctccatgctggaaagcgcgcaggtcgacatggtggtgtccagcttcggcatcaccgaacggcatgagtcggcggtgacgatgaccggcccgtatctaatcgtccggcaggatctgctggtgagggccgccgacgcgggcgacatcaccggcatcaaggacatgaacgggcgcaaggcgtgcgtggttgccggcagcgacgtgaccgacgccgtgcgcagccaggcgcccaaggcgtccatcgaggagcgtgacgattacgggcagtgcctgacgtcgctgctcatcggtgacgtcgacgccgtagccgcgggcgacgccatcctcaccggcctcgcgaccgtgaaaggcaacgggtacgtgcaggtggtcggggctccgttcggcgaggagcgatacggcatcgcggtcaagcacgggaacacgcagctcgccgacagcatcggtgacatactgagcgacatgatcggcgacggcacgtggcggcaggccgtgcggggcatgcgccggcagatcggctacactgtcgactccaagctcaatccgccggatcccgcggcatcgtcggacacggcgtcgtcggacccggagcagggcgacgaatgatgaaggccggcgggctgcgcgcggctcgccccgtcggcgtcgcacgtcgattatcgaccggatgcgcggcatgccatgacctgcgtgaggatggtgtccagttgcgtggcgataatccttgtctatgagtgacaacgagaagaccacgcaacccgcgtccaccgattccaccgaacccgcataccgttacaacgcggcactcgcgcaggacatcgaaggcaaatggcagaagatctgggatgacaagggcacgttctgggccgccaacgtcaacggcgacctcaaggacggcaagggccgcaacgcagacggccgcccggcatacttcgcgatggacatgttcccatacccgtcaggcaagggcctgcacgtgggccacccgctgggctacctcgcctccgacgtggtctcccgctaccaccgcatgaagggcgagaacgtgctgcacgccatgggttatgacgccttcggcctgcccgcggaacagtacgccgtgcagaccgggcagcacccgcgcgtcaccacgcttgccaacatcgccaacatgtcccgccagctgcaccgcatgggactgagtttcgacgaccgtcgctccttcgcgacgattgaccccggctatgtgcgctggacccagtggatcttctcgcgcatctacgattcctggtacgacgaggacgccgtgaacccctccggctccaagggctccgcccgcccggtcagcgagctcgtcgccaagttcgaatccggcgagaaggccatccccggccatgagtccgacggcaaggcgtgggccgacctcgaccaggccgaacagcagaacatcctcaacgacttccgcctcgcctacatctccaagtccccggtcaactggtgcccgggtctgggcaccgtgctcgccaacgaggaggtcaccgccgaaggcaagtccgaacgcggcaacttcccggtcttccagcgcgagctgcgccagtggtcgatgcgcatcaccaagtacggccaccgcctcatcgaggacctcgacggcatcgactggcccgagaaggtcaagctcatgcagcgcaactggatcggcgaatcccacggcgcctccgtgcacttcaccgtggccaccgccgacggcagcaaggacatggagatctacaccacccgtcccgacaccctgttcggcaccacgttcgccgtcgtctccccggagcatcacctgctggagaacgtgcccgccgaatggccggccgacgttcccgaggattggaagggcggttacgccaccccggtcgaggcagtgaaggcctacaggctcgctgccgaggccaagaccgccaaggatcgtgtggatgagggcggcgagaagaccggcctgttcaccggcctgtacgccaccaacccgattaccggagccaagctgccgctgttcaccgccgactacgtcctcatggattacggcaccggcgccatcatggccgtgccgggcggcgaccagcgcgattacgatttcgccgtcaagttcggtctgccggtcatctacaccgtcaagcccctgcccgaatccggcgacgacctggccaattacgaaggcaaggccccgttcgtctcccacgacggcatcgtgatcaactcctccgtcgaggccaccgccgccaagggcgacgcgctgagccttaacggcctgcgcgtcgatgacgccatcgccaaggtcaacgcctggctcgaatccgccggcgtgggcaagggcacggtcagctaccgtctgcgcgactggctgttctcccgccagcgctactggggcgagcccttcccgatcgtctatggcgaggacggcgccccgcacctgctgccggactcggctttgccgatcaacctgcccgacgtgcccgactacgagccgcgcaccttcgacccgatggacgccgaatccaacccggaggcgccgctgagccgcaacgaggactgggtcaaggtcgagctcgacttgggcgacggcaagaagacctactatcgcgacaccaacaccatgccgaactgggccggctcctgctggtactacatgcgctacatcgacccgtccgacaccgagcacatggtcgagaaggacgagttcgactactggatgggcccgaaccacaacaagtactcgggcgacgagggcggcgtggacctgtacatcggcggcgtcgagcacgccgtgctccacctgctctactcccgcttctggcacaaggtgctcttcgacctcggctacgtggattcggccgagccgttccacaagctgttcaaccagggcatgatccaggcgtacgcctacaccgatgaccgtggccagtacgtgccggccgacgaggtcgtggaaggccccgccggggctgacggcgagccgacgttcacgtggaacggcgagcacgccaaccgcgagttcggcaagatgggcaagagcctgaagaacatcgtcaccccggactacatgtacgagaactacggtgcggacacgttccgcctgtacgagatgagcatgggcccgctggacgagtcccgcccgtggaacacgcgcaacgtggtcggcggcatgcgcttcctgcagcgactgtggcgcaacgtggtcgacgagacctccggcgaggcgcacgtgaccgaggacaccccggatgtcaagaccctgaagctgctcaacaacacgatcgccgaggtgaccgtggagatggagggcatgcgtccgaacaccgccatcgccaagctcatcgtgctcaacaaccacctgacctcactgcccgccgtgccgcgcgccgccgtcgagcctctgatcctcatgctcgcaccgatcgcgccgcacatctgcgaggagatgtggtccaagctcgggcatgacgaatccctgtccgccgagccgtggcccgtcgccgacgagaagtacgtcggccatgacaccgtcaccgccgtggtgcagatcaagggcaaggtgcgtgccaagcttgaggtgccggttgacatcgacccggccgacctcgaaaagcaggcgcttgaggcggtcgccgaccggttgggtggcaagacgccgcacaaggtgatcgtcaaggccccgaagatcgtctccatcgtccccgccgagtgattccgccggcgacacgccgaaaatgtggataactcccgagccttcgaccacataggccgattcggctggacttcatgcccatgttccctcacgctggaagcatgggcatttctcattcaggagatcaaacggcgactcgacggttgcgcggcatggacgatggccgccacgccgggattcctgccatgcccgacgtaatcgggatcggaacatctgtcgcgacggatgccggaacgggcgtgcctcctcctccggcgccgccaccgggggatttttccagaccggtgccgtcgcatggcgagagtcataccgagaaacatgccgacgtggccgattccaccacgcctgccgtcgagccaataagccgtctgatgggtgtgcgccctgacgacggcatgcgaggccagtccgcgaagcgggacgtgccgcggctgagattccgcccgttccacgcggtgacggtgatgctggtgctgaccacggccctgtgcgcgagcctgacgatgctgctgcagcagtccctgcggtacgtgtcggctcaatcccataacgccgcgatgcagaacgcgggagggaaggaaacgggtatcgccgaaacgttacccggtggaagtgacggcagcgactccgtgaatggcgacgggtcgaactctggcggaacgggctccgatcaggagaattccggtggggcgggcgacgccgaatcgcaaggagacggcgtggagtcctccgcgggcagtcaggctgcgcagaacgggcgatcatcgcagcaggggagtgacggttcggacgatgaggccaccgcagatacgaggatcgatctcaataccgcgaccgcagagcagctggattccattcccggcgtggggccggtgaccgcgcagcgcattctcgatcaccggcgcagcatcgggaggttcaccagcgtcgaccagctgctggatgtctccggcatcggcgcgaagacgctcaccaagatacggccgtgggtgcgtgtgcgaggtgggggatgaggagacggtacatgcgggatgacgggcatatgcagggtggcggctgccacgaccgccgtcggaggaaccataccggaaggcgtcgcgactcgaccgatgggcatcgggaacgcccgtcatcgcgggccttcgccatccgccgcgaaaacggcggtagggacttcaggatgctgccggcggctctcgccgcgtggatggcttcggcggcggctcaccaatggtggcgatggctgaccttgatggatgatgacccgatgtcggtcacggggtatgcgattggtgcgttggctgtgatgctgctgccggtggtcctcgtgttgtgccgtcgctggcgtcacacgggctgatacgcccgttgcgagcctcgctcggggatgccgtggccgtgatggccgtggccggactactgtcggccgccgcggcggtgaccgcggacagtgtgcgctggcatgatgcggcgcatgtccaggcccgtgacgggcccgccgacgtggtggccgtggtgcgggtgcgctccccggccgtatcgtcgacggtgaggggttccgattgccaggttgacgggcgcgtggtgtcgctgtccatacggcgatccccggcgaatccgctgtcggaacgctcgccggtgccttcgcgcgccgatatccgcgtgctgttgtcgggagacgtctgttcggcgctgaccgacacggcggtctaccgttttcccggcacgctgagcacggcgtcgtatggccgtcagccgctgtggctgacctgtgacgatatgcgcgtgccggatgtggtttctgcgccttccggaacggcccgcatcgtcaaggccatgcagcaggggctactgcgcgcctgcgaccgcctgtcggatcaggcgcgcgtgctggtgccggggctgaccgtcggcgtgctcgggcaggatgcggtccgggtgcgcgataccgcatccggtgtggcgtcacatgggtctgaagaaggcctgtcatcggggacggaacgtgtcggcggcgtcgatgccgcgtatgcggcgctactcgaggagcagttccggcgcagcggcatcatgcacctgatggcggtgtcgggagggcatttcatggtcatcgcggggctggtgcgcaggctgtgctcccgcgtgctcgcccctcgatgggcgacaggactggtgatggcggtgtcggacgtgatgctggcgatagtcgtgttcccgtccgattcggtgctgcgcgcattgctcatgggactgttcggcgctgccgcggtggcggccggccgtcgaagacagtcggtgagttcgctgagctggacggtgatcatcgtccttctcatcgctccctcgatgtcggtcagctacggtttcgcgttgtcctgcgcggccgtattgggcatcgtgctgttcgccggccctttgaccgattggctggcgtgcatgctgccccgattgctgtcggctccgctcgccatgaccatcgccgcgcagtcgctcaccctgccgatacagatcctgatggatccgcaactgcctctcgcctcggtgccggcgaatctgctcgtcggcccggtcgtgggattcgccaccatggcagggctcgccgcgctgttcatatcctggctgatgccgcaatgcggatacgtcttggcctggattgcgggatgcggcacgtccgtcatggaacgcgtcgccgcgatggtgtcggacaacgagttcgcgaccatgccgtgggccggtggcataccgggtgcattgctgatggtgttggtcgaatcggcgtgcgccacggtgctgatactggccacccgatggttgcgtctgctgcgatccgacggatccggcgacggcggccagtcgttccgtccccgtctgcgtgaccggatacggatatggtggtcgcagaccgtaacgatgttcgacggcgacaccgacggaggagaccggccggtgccgcacacgaaagtcgcggcgggagccattcccgtcgcatcgatgacgggagcgcatgacggctcttgtccagctgtatgggaagatggagaccatggcaaacaaggcaggctcgcaagccccgttcatcatcgtgttcggcggtgacgcatatctcaataagcgaaccgggcgcgatctcatccgccgtgcgctgcacgatcggcccgacgccgagcgcatcgacttggatgcgaccggctgcgaccagtacgcattcgatgaggccgtcagcccttccctgctcgccgatgtcgccgtggtcgtcgtcgacaatctgcagaacgccgacgacaagctgagcgaatccatggtgcgctactgccgtcaggcatgcgccgatccgggtacatccagcatcgtcatctgccggcatgaaggagggatcaagggcaaacggctactcgaccaactcgtcaaggcgggcgcgtgcaaggagacggtcgccgacctgaagaaaccggaggcgaaactcaacttcgtgctgcagatattcgagggggagcaccgccgcgtcgagccattggccgcccagcagctcgtcgcggtgctcggcgagcggaccggagaaatggccgccatgtgctcccaactgtgcttcgatttcgatgacgaccccatcaccctggatctcgtcaaccggtacctgacctcgaacccgcaggtgaccggtttctccgtggcggacaaggccatagccggtcgcacggccgaggccatcatcgccatgcgttccgccgtcgaacagggaacggaccccatcgcgctgatcggcgcgctcgcgatgaaactgcgcaccatcgccaaggcatccgcagtcaaggccggcaccatcacgcaggcccaggcgaaaacgaacccgtgggtgctgaaaaacgccatgagacagctttcgggttggacctcggcgggactcgggcagtgcatccgcatgctcgcctgggcggacgaacagagcaaaaccaacgggggcgaccccgtatacgcgctggagaggtgcatcgaactgatcagccacaaaggaagggactgaccgcgccggagaacggcgccctgcggcgaggcgaccacggccgggtgcccgcagagcatgcatgacatgaacgacgacatcgaaattgaaacaggaacggcagggacgggaatgaaagaaacgatggaaacagcagaaacgggcaacgccggcgtgacacggaaccagggagccgacgccgcgcatcccgtcgttgtgcgcgtgcccaccgacgacgacatgcgcgaactgggccggcgtgtggccttgctgctgcacggcggcgacgtactgttgctgtcgggcccgctgggcgcaggcaagacgacgttcgcgcagggcatcggcgccggattgggcataacggaacccatcgtgtcgccgacgttcaccatcgcccgcgaacttgacggacgattcgccgacgggtcgcacgcccacctggtgcatgtcgacgcgtaccgcctcggcggcgacgcctatgcgcccggacaggacgtcgaggaaagactgctggacgagttggaatcgctcggtctcgacgaggagctggaggaccccggagccaacaccgtgatcctgatggaatggggcgagcagatggcctccacgttggctccggaacgtctggaagtccatatcgaccgcccgctcgatgacgggcaggacgacaaaaccgcgcagaggcagccgacaagcgatggcaccagagtcgtcacgctggtaccggtcggcccggcgtgggatggggcgcgtatctcgcgattcacgaccccgaccgcctgatgatggtgactgacggacgatgtagactcgtacaggttgcgtatgaacgggaggaacaaatgcaggcgactgatggttgcacgttggtgatcgacacctcgtacggttcgaccgtgggagtcgtggggcatgagcccatcgtggagaccgattcgcgcacccacgtcgagaaactgcaggtcaacatcgcccgtgcgatggatgccgccgggctcggtcccgcggacatcagctgcatcgtcgtcggcgtcggcccggccccgttcaccggactgagggcggggctggtcacagccaaggcgctcgccttcgccacgggggcccggctgatcggtcagaacatcctcgacccgcaggacgccatgttgcgcgccgccctgcgcggcgatgccgtcatagcggacgcggccggattcctcgcggatgtgtcgcatacggcgcaaaatggccaggcggacgggagactggagccggaacatcacatcactctgtgcgtgaatgacgcccgtcgcaaacagttgtacttctccctgaaccatgaggctggcgtgacgggctcagagacggattcctgccattggatcgctatggacatcgactaccccggccatatcgtggagcgggtcaacgccgaggtacgccgtcgcgcggagattggcggcatgcgatacatcgtggacgtggtcggtcacggggcggcccgatacgccgacgcatggcaaagcctggatgctctcggctcggtggtcgagggatccattctggatgcgggggcggccggcttggcgatgttcgccgagatggcgctggaacatgcggacgacgaagcgcccgtcgaaccgctgtatctgcgccggcccgatgccgaagtacccagcccgctcaaacacgtgctgaaccatgcgggcgcgcagagggcggactgatgctgcgcgaactggacgatatcgggcgggagacggccgtcggcgcgataagggcgctggaagtcgagctgttcggcaaccatgcgtggagcgaggcctcgatcaggcaggagctcgacgcgccggcacgcgtatacgtcttcgacgtggacgaggcggatggacgcgacacggaccgtgaacccgccatccgcggattcgccggatactggtatgacggcgacgacgcggagatcatggacataggtgtcagcaagacccatcagaggcagggcatcgcggtcgcgatgatgaatcacctgatatctcgcgcacgtcgacagggagccagacggatgctgctcgaagtcagcgtcgtcaacgacccggccatcgcgttgtaccaccggttcggattccagcgcatcggactgcgcaaacggtactaccagccggaaggcatcgacgcgtatgtgatggcgcttgaccttgaaccgcgcatcgtcgggttcagcggcaatggcggtgtggctggtgctgccggtgatacgtccgccgccggcgacatgacgaaacaaacaggacaggagacgcaaccatgagcgaaccgatcgtactgggcatcgaatcgacatgcgacgaaaccgccgctgcaatcgtacaggggcgcacgctgcgttccaacgtcgtcgcctcgtcgatggaggagcacgcccgttatggcggcgtgattccggaaatcgcctctcgcgcgcacgccgaggcgttcgtgccgtgcgtgtcccaggcgctctccgacgccgggttgggactcggcgacgtggatgccatagcggtgtcggcgggccccggcctcgccggatgcctcgccgtgggcgtttcgggtgccaaagcgcttgcatgggcggcgaacaagccgttgtacggcatcaatcatgtcatcgggcatatcgccgtcacgcagctgcaattcgggccgtttcctaaggatacgctggcgttgatcgtgtccggtggacacacgtcgctgctgcatgtgcgcgatgtcgcgcggcatgtcgacgtggtcggcaccacgttggatgacgctgcgggggagtgcttcgacaaggtcgcgcgtttgctgggcttcccgtaccccggcggtccgcatatcgaccgtcacgctcagctgggcgatcccaaggccatcaaggtgccgcagggcctgactcaggggaaggccggtgcggcgcatccgtatgatttcagcttctccggcgtcaagaccgccgtcgcacggtggattgaggaacagcaggcggcggggcgggacgttcccattgacgacgtgtgcgcttcgctggctgactccgtggccacggttctggcccgtaaggccatgcgcgggtgcgagcagtatgattccaagactctgatcgtaggcggagggttctccgccaactcgcagctgcgtgcgaagctgctcgaatacggcgagcgggccggagtcgaggtgcgcatccctcggctcaagctgtgcaccgacaatggcgcgatggtcgccatgctcggcgtgaacctcgtagaggccggcgaggccccttcctcgcccgattgccccatcgattccgccatgcccatgaacaaaatctgcatgtagcccctccgcctcgcggattgcacttgcctacaaacagcgggaactgtttgtaggcaagtgcaatccgggaggcccgtggccgcaggccatccccacttgcagggcccggagagctgtcgcgaagcgactgggggtggtcatcctcagcaatgcggcggatagtcacttgcgtccccacattgccacaccatcgatatttcgcgtcaaaatcgcattgtgtggctttccatctgccataccgcgcgatgtgagccttcacatcgcgcggtatggcagacattcgaatcgtaggacagccatttttgcaatgattcgggattgttctcgtctccgtcccttgccacaccatcttaaaaaccatcagaattcgcatagtgtggcacgcagaggcgcgcatacgacggcgcatgcgatgcatcggtgcgcaggtgcgggatgagcgcgggaagcaaaaaaccctcaacgtttccgttgagggtttctatggctcctgcggctgggcttgaaccagcgaccgtccgatatacggttctggctcgcagccgtagggctttttgcaacaggagtagacaatacaccagccttgctgttccttcaaatcggcgtgtcatcgcgcatgttcgccttgcagctggttttccgaagagcatcggccagaaacgcgcaatagtattccttgggaagtgatgaagaagtcacttcccttttctatgcgcttaaggagccccatgaggtattggaacgacaacaggaagagctgcgaacacgtcgagccacgggaggattggaaagaatccattgagaaatggatcgactggatggacgccatcggacgcacgaacgacaccctgcgcacccgctggtaccagatcgttcgattctccaaagccgtcgataaaagcatcaccgacgtgaccgaagacgacctcatattctacctagccggcatgggaaccgaaggcagacgcggagtacgcagctgcgtcaaggtcttctaccaatggagcatgaagcgagggctcgcccgccgcaatccggcggacgaagtgcccaccgtgcccatgacccttccgtccggctgcatctgtcccgaggagaacatcgaacaaggactcgcatcacccgacgagaacgcgcggctggccgtcatgctgggcgcgttctgcggcctgcgccgcatcgaaatgaccagaatcaacctgaagaccgatctggaggagaacgccgagggcatggtgctccacgtccacggcaagggcaacaaggagcggatgcttcccgtgccggcaaagctcgcttcggcattgcggaaacgcaccggcgtatggctgttccccggagacgtgcagggacactgcggcgtcgattacgtggcgaagaggatcaagacggtaaccggatacccgtcgcacagcctgcgccgtaggttcgccacatgcgtctactacaggaacggctgcaacatcgtgcttgtcagccgtatgctggggcacgccaacatcgccaccaccatgcgttacatcggcctcgtgcaggacgaaatgcgcaacgccgtggaatccaccacccgcaccgacatgagactgaccatgcccatgaaccaggtcgtcggaacagccggcagcgtctccacctattcccttagcgccgcgaggatcggatgaacaaacggtatacgccaacatgcttctttgcgcatattggcgtataccaacaccgctcaccgagtgttcccgagactggaaagcggcaacgcggctatgtctatccccagcgcatcggctgcggagaacaccgcttcaatcggggcttcgccccgctggagcagagcatcggcaaaccggggatcgataccggcctgggaggcaaggtcgtcggcgttccaggaatggttcgcggtctcttcacggaaggcggctgcgatatccgattcggtgcgggcgaaaagagtccggcgttcacgcggcgcttggaaacggctgaggtaacgcgcgtactccaattgcgcctttgtcggctcaggcaagttatagtccagattcgacatcgcagacctccttagcgttcagcgggttggactggagtcgttcgacgcaccgaaaatagggaatccgggaaccgcatcggccgacgatggagtgcctggagtgccgtacaacgtcccgatctgttcgatcgcccatgcgctccaacgtggggattcgaccgtggatgtcatcaggccggcggggaggaaccggcgcatctcgtcggcgaaggcatccgagccgatcacatcggcgacccccgccacgcgatcagcacggtctgcccaaagtccttcttcgccgtaatcagatgatttcaattccgcaagctccatcgcccgtcgggaatcgacgccgcctctcgacgccaaccagcacatgtcccacaggtcgcgtcgccgcaggtgcgatgcgcaggcataggagagcagcttgtcggcaagaatctcggtggggctttccacatcgaggatgatctgacccgacaaggccgggaacatcggatagttgaccaaggcgggacgatgctgcggctcgtacgcgggaatcgatgccacctccagcttgattgtctggctcggcagatccttgcgctgaccggccgtgcgaatcgctatacgccatctgcgcgtcagcccatcggcgtcgggtctcggctccttgacccggaccgtcacatcatcgcccatccccgagagcgaatcggagatgcaggagccaagccctttaagggtgtccatgtcgaacgaggtgccgccggcaaaatcaaggtcctcgctgtaccttggggacccgtggcacaggcgcagactcgtgccgccctggaacaccagcgaggagaagaaaccctcgcgcatcatggcatccaggattcgataatgcagaagttccttctcgaccacgggaagcagattgcccatgccctcgcccccggccaagacgatcccggccgccatagccttgtagtcataggtgccgtcagctccagtcatcatcgtcctccaattcgtccatgtccaccagatcgaggttgcgtccgacggccttcaggtcacgatacgcccactgtttcgacgcgagcggcgtcagtccgtcatcgcgggcgatcaggttcggcaggatgcgactccagctgagcttgcagtgcgtgaactcgatcaccccgtacgcggtgcggaactcgccctcacggcccgtggtcatgaacgtgaccctatccaccggaatctggctgatcacgttccagcgcgacagagcgctttcgaggctttcccacaccagctcgccggaacgcaaccgctttgcgacctgatgaagtgtcccctcgccgagatgggaggaatacgcgaacacgtagacgccacgggcggcacggaccaacgccttcgccgataccaggctggacagggttcggttcagtttctgcccctgctcacccagcacgacggccagttcgttcttgcaatacacgtagcacgagtacttggcatccatctcgcgcagctgatcaatcgcctcgctcctcttcatgcatataagtgtacatgaatatatgtaaaaacgcatattcatgtacacctatcacaatcctgaagcgttccaatcagagggaacgccctcgtgccggaccgtcttcgagactaatcccgtcgatggcgttttccgagaaagggttctctcttaatctgccgacgatttccgctacggcgcgctcttcctgatcaacgcattggacaagctgggaaatgaacggcttgggatcgccgtcaacctgccatgcttccagacttttcccatagctgcggccggcatcatgtttgattgctacgggccggtagccggcagccatgagcatgagattcagaatctgtcgcccggttcgtccgttgccgtccgtgaatggatggatgttctcgaacatcgcgtggaatccggcagctttgaggatcgggtggtctttggaaccgttcaccgcgtccacgagcgcttccatgtcctcgtagatttcaagtgggtcggcggtcttcactcgggtggcggtgatccttgcctggtagccgtaggggcggaaccgacccctgagcgcgggctgcatgtccaatgcggtgacttcatgcagcttttggatcatctcgacactcagcgtccgctcctcttcagcgaatcgttccgcataggccatgccatccgcaacgccacgggcagcgaagatgtatcttgccggcgagtcggtcggcacgaactcgccctccaacaccagttcggtgtcctcaagcgtcagcgtggatccctcgatcgcgttggagttgtagacatagcgggccatccattccttacggtaatcctcaagcgctgactgctccaccccatccaaaggaaacatctgcctgaaccgttctcgggcggcatcggaacgacgaagcaagtcggacacctccgcgtcccgctccagagagtccaagagaggaggaaggtttcggattttctcagtcagcgctggattcggcatatcggctccttaatcgatgcttccataagtctacaagcgcaggcgcgtcacatggacagtccgacgattttcttgccttcgagaaagtcctggaaaaaggccgtggaatcatcgttgtcgtccgatgattccatggcccttatccgtgtcgtttcttacgttcaccgggtcatgccgtatgacgatgactgttcgaggttcaacgggtcggccggatcgcatgcgccggcggaaagctcgtctttttcttgtttcgccggtgtcggttcgggcatcgcggcgagcttgtcgaacgtgttgaggaacgcgcctatctcgcggtcgctgctgatggggtccatgcccctggccttcgtcagggcgcgtatgaagtcgaggtgattgtccgcgaacgcgccgaaacgttcgaaatcaccgcccttgatgctggtcgtgtcctgctcgtacaggctcgtatattcgtcgcccatgcgttcggcgaagtccctcaccctggcatcgatgtcccattcgatgggcgggcatccagattgcacgcgtggggattgagggtgtgaatcccactgtcgtgggtttgatgaggtagtcgatgttgcggaagctttggcatcggcgtgcgttgtgctccgtacgttgtttcaaaaacgggtttcatcaaacggaacaaaacctgggacacttcatatcccaccccaggcctaatgacttgggtgcagcggcaacgctcatccgatttaggcagagtcgttgcaggatccagtgggtcacctggtccgtggtctttgaattgtcgggcgcgcaggcaaggccagcacggaagatcttctgcaagcaacgcttgttggtgcaccggtagcgtggaaggcgcacatgaagttgttgggtggccgacgatgggcagatcgaccaggctgcggatgacgtggtcgcggaatactccaggctgcccgcaggtagggcattcattgatcggctcgacgggttcggcttcaataacagtgacgtcaccgttttctgtggcaccggtgatagtagttcctagttttgcggtgcggcagatggtatcgacgatgacatttccgttaggctgcacagtaggtccttagttttgtacggatggattagatacctttttcctacaaagccaaggaccccaatatcttgtgccacgcccgaacccccggcgaactaatcaatgcactctaaaaccggaagagcccttttagtactactggtggatttcggttttggtggggattaacgccgccggcttcggtttttccgttgaggaggtcgttgactacttcccgatggtgaaatgggtcgatggtgaggtagagaggaaccagtcacctggaagagatcgatccagtcgttggtgtgcaatctgggaggtagggtcgcggggtcgattcctcgcgagcgcaaccatgattgtgtttctgaacgtgatgaaaacaaccctgcccttcggagaatttcccctatcccgcgtccccgggcagtgaaaacggtgtgcaccatcgcctgaaaggctttgcgctgctctatcggaatcttcgggtcacccacccggcggatcactaagatcccccccgtcaacgtttggctgtggccggaaagcagtccttggtacccgagaacccaggtgaaatgtgaaccatggggaccactgagccgtcatcatcgtgcttgcgcctaccccggcccggcggcgagcgacttcccactgcatgaggagtacagcgtcagtccatgctggcgcatgcagcaactttcgaagaatggcagtggtgaggtgaaagggaatgtttcccacaatgacgcagggagtggcgggtaaccggaagttaaggaaatcatcatggaccacttcgaccgccgccgaggaggtttcttgtgtgattttggcagctagttttgcgtccacttcaactgccgttatcgccctccccaagtgggccatcgggtgagtgagggcaccgcttcctggtccgatctcaatgatggggccggaggtttgtttcacaaggtcgatgatggagttgatgatcttgtggttggtgagaaaattttggccatgctcgtgacggccgtgtccgtatgcagacataaggtgtgctccttggatttgaaagggagccgggcatgacaaatagccgcccggctaaaggaccggagcggtttttaacctacggggtaggaaaccgccttagcggttggtgcgcaaccgcaagaaagcggtacctgaaatcaacatgggtctaattatatccatttaaagggttaagggtcaaaatgtgtgtctggctcggcgtgtcgcgggggttagatttggcctttttgaatgccgattgagtgggtgtagtcggtgtcgatagcgttgtcgtagagggctgggcgtcctgtttcgtggtcggcttggttctcggtttgggtcagggtggatactttggcgagttggccctggccccagtcggactgcctggcgattcgtactggatcgtcaggcagttccgtttttaagtagagccaccaatccagcatgcggcgttgtcgttcgcctgatctgccgcggtgggttctggcgagcagtttgagctgggcgttgatgccgccttctaagctgttggtggtggatttgatccgctcgggcgcaaggactcctgctggcgggttgaggtagacaaacagcatctcggaccgccaaagatggttgaggctgttgtaggccttgcgcacgttgtggtgggtccacacgcgggtccatgcacctgttttggggtctttgatcatggttttctcgttcatccattcccggtagatcgttgaaaactcgtgcagttgcacaccccacgcggcggcttcatccagtgtggtgatccgggtcagtttcagcgcaagtcggtagatggtgcgcccggcatcggtgcgtgggttggtggtggtgtagcggcggaccacgcgttgggcgtggacgaggcagcgttgaattttcgtagtcggccagcactttttgattgcgctgtatgcgccttggccgccgtcgatgacggcgatgagtggggcttcgatgcgttcaagcagcagttggtagtcgcgggtggtttcgtgtttgcaccagtgccaggcgatcacgtggtcgatggtcgccgcgacgatcaggcagccaccggcggtgtaggtgccatcgagaaatacctggtcgtagatccgcttgtggtggccggcggtggggtcaggcacatcaacgagccagcaccacttgaagcgccgcttcatggtggcgcggctaacaccgtttcgtttggctaggtcgtcgagtgatattgcggtggtgcaatgctcgatgaactgggtgaacactgccgcgttggtgatgtcgtttcgacgtttgacgctggaggcgccgcattgtttgcagcgccatctggtggtgcctttgctggtggtgccgttgcgtttcatttcaccgccgcagtggcagcgtggttggttcttcgacattgcgacaccacaccacgccgcgcatagcacatcacggctgccacaccgaggatttcccgtcgggggctagatatatgcttccggagcatatactttccggaaacctacaggtcaatccgtgaaaatccgcgattccggacacactttttgacccttaaccctccgaacgcgagttccacgtaccggggttccacggccaggccccgatcggttttcaggtcgttccagaagcggtccacggattccttgccgccgtcgtagtggcggcctgcggcgtcgaacggttcgccagcccatgcctgttcgtaggattccaatgcctcgcatccctggtcggtgagctggcgtatctccacctccacactgccgtcgtggtggtggccgcgcatcttcaggattccgttctcgtcccagatgtggtcgatctcgcagtccttgaacggggaatcatcgccgttcatcagatcatcgaaggtctcgaacgaggatatgcccgtgcgttcgccgtcccatcggcctatgcttccgaacgcgatcagcgggttgcctcccatcgggttcctgtacgaggagagcgccgactgggatccattgaagaaatcacgcagagcgccggtctccatcctgtaatcggtttgacgggattcgtccgcgaaggcatcgaacgtgatcgacgtgccgctctcctcgtacagccgccacaggctgtcggcgcgggtgctgtgttcacggtaatacgggtccccgtattgcgggtcgtagtcgtcagcgttgtagatgtaccgtttgcggggttcgggatcccgaatctcgtcgatccaattcatgtccatcgtgtgctccttggttctgttcgtcgttgccgtacggcgtcagtggccgtgtgtcgtttccatgccgtcatccaacgcgaggtcgagccctgcggtctcaggagacgtttcctgtgggtcggcccagccgacggcgaggtccagcgcgccgcgcaacgcctggccggaaagccggtacgtccaggaatcgtttgcctcgtaagggaaggattcgccggacacgatgccgcgctcgtcatgcaggctcacgtcgaacgttccgggtttggccgtgattagcgcatgacgggcggaaccgggagccgagacctccagcgcctttctgccgtcgggagacccggtggcggtgaatttgatatcggggtggtgcgcgaggctgtaggaagcgttggactcacacgccagcgggaccgtatctcccagcccgctgtctgcggccagctgctgtgggctgtaatccatgccctgcgtgtagtcgatgggctgcgcgtcggtgtagaagcatccgccgccatcgtccgcgtcgatcaggtcgcccacgagccggtccaggcgtgcggggtcgtcccatgcgctcacgagtctggcgggttcggcctggttcttccatgccatgtagcggtcgcgttggtcgccgcagatgccgtcgaatgattcctgggagatgaacgtgccgccgtccaattggtagcattccccgtccgggtccaacgcgcgctccttgaactccttttcggcggcggcgtacaggtgcttgtcgagcggttccatggccgcgtcgatgcccgccatcatctcgtccacgtgttgccgcatgtcgggctggctcgttttccaccatgcctgcaagtcggcgagcacgtcggcggcgttctcccgttcgcacacgtcgagcaggtcatcgtcgtaattttccaccgtccaggagtagaaatcccagtcactcgaaccggtcaggcgttcgatgcccttcatgcggtggaagtccatcaacccgccgccgtgctcgcgcacgatgcccgccaacggcagatcggcctcgtccatcaggcctttccagtattcggggacattcccgttctccatgtcgttctcctttccgaacgccttttcgatcacgagcgggtctcgtgggtcaacagtgcggtcgatccgcagtatctcgggcatgaccgcctcgctttcacggccgatgacgaacgtgccgataccggccttgacgcgatgctcgggaagccttcccgaaccgtcgcacatcaccgccggccggaacagcgaatccccgtaggcgagcgtcaccgtgtcgcccggcctggcgagaacccgttcgacggccatgcgtgagaggccgtgcgcgtcgagacggccggaacgccaatcgttggcctcggctgctgtcagggtgaaggaaacggaacgcccttcctgggccgaggtcacgtcgagcctgactggctgcatggcctcgaaaccgatccagatgccttccggcgtcctgtccggggctttcacgtcaatgtccgtgaacccgtattcggtcagcacgtccgtgaccctgatcctgagcgcgttgtcgggaggcagatcagggcgttcattgggaatcgggagcgaggacgcctcgaaccacacgtcctcgctcggatcggtgtcgaagccgccgtccgcgtcggaatacgccatgtggacgccgaactccaattccttggcatcggcggaagagaccagaatcgcgttccccagcacgagatcgcgcgcgttcctgcgcaggatggattgcatgtcgggcttggcgggattcccggccgcgagcaggtcgcggttcacaccctccatgtcaaaaggcgtcaaggccatctcgctcgccctttctcacttggaaaggccggaaccggccgtatcggtcatattcagcgggtccgaggggtcgcacgcctgcgcgcgttccgcgaacgaggtgacggcaccgggcagcacatatcccagatcaaggtcgatcgggctcacgccgtcgtcttcgccgacggacgctgcgggcattgcgcccatggtctcgcgcagcacgtccacggcgtcgccagtagcggcgcgcgcgtcgatgatccggtgcatcgtgtcctcaagcgcggcatggatatcggtggaaccctcctccacgatgcactggtatgagggggctccccagttcgtgccggtgccggaaatcgtgtagtccgcgatgcgttcgcccggctggacgagcgaggcgagatcgaacgcggccggcgaaccggtcttcgcgtcgaaatcatccagccattcgacctcctcggcgatctcctcgcgcgagtaccgtccgtcgatatcgctcggccagtccgcgtcctccagatagccgttgtcgccaagcgacacatcgccgtcgagcttgaggtcccggccgtacatctccatatcgatcagatagccgagccccgtatcgaacatggatcgcacggcatccgatgcccacccctggttcacggcggtccaggcatacttcgcctccttcgattcggccgaggacggcgcatcataagagtgataggggatctcgtccgagttcaacgcgaggttcgcgtactgcaacggggtgcgcggggccgcgtcaagatcgtcgcggaccatccgcaccttctcgtacacgtccgggtcgtcgtcctcgcgcgcctcgaacgcgcggcacatgaggttcaggtccgtcagcgactcgtattcgacgggattcgccacggtggcgagcagtccttccccgccctcgtagtcgtggatcgcgtactcctcgtaccggccgcccaatcccacctcggtcttcagggtgtcctgcaagcgttcggcgggcatgggcagcgtgatccacgcgccctgcaacacgccctccacgtatttgcccaggttggcgacgtacacgctgatctggtagtccttcaatccggccatgatgatgctccttcgctcgggtcttttatcgtgtggctgcggccgaggcagacgtatcggcaatgctcaacgggtcggccgggttcgcgggatcgtaggtttcggacgtttcggccttctcgccttcgtctttgcgggcgagccggccgtcgtccaccatcgcgtcgatgatctcccatccctcctcgatgctgcggtcccgcaattccctggccgagatcatgccgcgcatcgcgtccatgttctcgttgttgtcgggccagtcatggtccttcagccagtgccgaaggtcctcctccgtccagcggatctccgcaatcgtttcgttgccttgcccggcgttgctttgaccgggatgaagcaacgcctcagatcggagaccgaaatacgctttgtcttcctggaggccggacaggaagccggagggcgtgaacccgttgcgtgccgcgaactcgcgggaccagcattcgtcgaactcctcgtcggggtcgaagtcgaggagcccgtccgccatggcgcgcctcagccccttctcgtccgcctcggccggcaccgtgaccgtgaccgtggcgtggttgggggcctccagcgtcatgtacagttcgctgtggccggcgtcgcgttggatgaagcattccccgttgccccagtcgagctcgtgctgctcgatcagctccttcgccttgtcggtcagggcccgttcctgggacgtgtattcatcgggttccatcagcatgatgcgtccttccttcccttggatgatcggtgccgcgccgtccggcgggcatggctccgatcatcagcccatacgggcggtcgcgcggggcatggcgtctacggggcagatgattccgccgagatttgatgctcggtccctttacgtgtcccgctccttagtaccagttgtgggcgagccagaacgtcttggcggcgctggggctgccgtaccggccggcgatgtagttcaatccccatttgatctgggtggcggcgtcgtccttccagtcgtctcctgcggaggcgagtttcgacgcgggcaacgcctggggtatgccgtacgcgccgctgctcgggttggtggcattccactgccatcccgattccttgttccacagccatacgagcgcgtcatagtcgccgtctccccagtccttgtacgaggcgatcatcttccgggcgatggcccgggcctgttccggcgtggcgtgggtgccgtcgccgtcgtagtccaccaccacgtccgtggagcccgagtcggaactggagcacgtccatgccgcctccaccggatccgaagaggaggacgagtcggacgatgacgacgaatcggacgattcggaaccggatgacgtggaatccgtgccggcggaaccattggtggacacactgccgttgggcaggatgtagaccgcgccgacgtcgatcctgtgcgtgcggtggttgacgatgcccaggccgccgcgcccgttcatctcgctgatggtcacggtgccggccgtccggtcgaccgcctcgacgacggcgacgtggccgtacagggtgtccgcgtcggccacgccgggcgggtagctgacgatgctgccggccacgggatcggtgcgggtggtcttccatccggcggcggtggcgctggcggcccagtcgccgccgttgccccagtaggagcccacgtccaatccgattttatggcctctcatgcacgcccaccatgtgcattgcccgtccggataggcctggcacacgttgtcgggcccgtcggatccgttgaaccacgccttggtctgcgcgatggtcatgccgtcacgcacctcgccggtcgtgacgcttcccgtgacgcctcccgacgatccgttggagccgccgtccttgcagccgccgaggaccgcgagcacggtcaacggcgtgcatccgccgagcagggacagcaggcacgccgagagcatggccgcgaggatccgatggcggctggcccggctcattgcgtgttcctcagcgaccagaagggcttctgcccgccgaccacgacctccacggtccggcagggatgctggaccgtgccgtatccggtggcggagatcaccgtgtacgcctcgtcgccggccttcacctgatcggggtcgagctcgttggcatccttgtccagcaatgacgcgtcgagcgcggccgggcagtagacggtgacgtgccagttgccgtcgtccatcggcaagagcacggtgttgtacgcctggctgacggtctgctgcggatccgtcgtggatgacggtccgccgccttccgggatcgggaagctggtttccttcgtcgtccagaacggctgggactggatggcatccgtatccgagccctcccatttgccgtcggaggtgcaggtgtaggcgtagttgacgtacttgtcatcgtattggcccgagcatacggatccggcgtggaagcggcgctgggtccaccaccagcgcggcgcgtcggagaccggatggctctccccggcaccgtcgtcgccgagcagcgcgaacacgttcttgcgccattcgtcgtcgctgccgtttggatcgagcagcgcgtccaccgtttccaatgcggtgtcgatcgggccggaaccattgtgcagcgtgatgccgtccgcgttttcggagagcgtgcgggtgccgtccttgtgggtgtcaacggggaacgcggtggtgcgctgagaccagtcgccgggaaccgggattcccgccgcctccaggccggcgtaccgtcgcgggcccgaatccgttttccttttgcccgtggactcctgtttcgcgtccgtcgcggaaccgtggtcgtcgccggccgttgacggctggtggttggcgacgatgacgcccagcgagcacacgaggagcgcggcgacgaacaggcacaggacgcgcagcggtttcggcagcggacgcggttccggccggttcacgattcaccgccttcccaacggttcggctcacccggcatgccgccttccatgttttcttccatggccggatgctcccgctcggggttcacggttcccggatccgcgttttcgggcgacccgtcttccgccgacccgtcttccgcccccgtccaccgcgcgtctatgaggtcgtccgccgttttcagttcggcgctggtgtttcccgcgtccttcgccttcctgcgcagcagggtggccttctcgcgggcctcttccagacgttcctccaatgatttgatgttgacgcgcgccgccacgtactcgtccatcgcatcctgtttcgtcttctggctgtcgcgcaccgccttgaggatgctgcgtttcatgtcgcgcatggtgttctggttgttcgccacgacgatcttcctttcgctcgtttttccgtcaaggcgagtctgccttcccgtcgcgcgttccacggggcatggcgtctacattccccatggcggaaggcggggcgtgtagacgccgtgccccgtggccggccgttttgcggccgagaatcggaagcgtcgttccaatcaggtgaaaggaaaatcaatggaatcgtttctctctatgctcgccggctggttcatgggcctgtggacgtggctggtcgagctcaacgggatgctccaggtggtgctcgtgctgttgtgcgtggtcgcctcgggcgtgtgcgcgatcatcggcaaacgcatgggcagcccgatgatcgtggacgaaatcagcgttggcttatagctttcgggggcgtcctgccggggttcgatcagtccggagatgacgctttccagcacggaatgcgtggcatcggttttgaggtctgactgcgggttgagtgattctcgcgtattcatggccggctcggttcctcggaggtgtccgacgttgtctgggtgaggaagcgcatgcctgcgatgatgccgacggccgtacggtcgaccggagcccaattcagctgtggcattgcggaaggatccagccaacggatgtccgtgtgctcggtcagccgtggcatgccgttgattaggtgacaaatgaatgtgatgagtcggaccgtgccgaagtcgtaggcgtactcgctggtgcacacctcatcggcgacctcgatctcacagagcagttcttcttcgatctcccgatgcaatgcctgacgagccgtctcgtaaggctctattttcccgccggggaattcccaatatccggcgagagattttcccggtccgcgttgcgcgcataacaccgctccatcgcgtacgatcgccgcacccacaacgttgatgatcttggcatgagagtccatggttacccgggatacaacggcggcgtttgataatgcgattgtgcggacgggtgtcatgagtggcatgtgaagtgattgcaattgctgtcggaagtttcagctactgaaagtttgacacaaaccgctcggcaaataccaccaccagcaggtatgaccgcggcgccgcggttggaggtcggctgcccgcgatccttcagcgagacgccagcacaaccgtcaccatggcagctgcgccgcgttgctgtcggacgaaggggccgcaagattcgcgtcgctcgtgtagctcgtgcccggctccggtgcgacggtctcatgcggatccggaatcgctgcggctgcgctggctgtgctcgcgcccgtgctcgcgcccgcgtcaccttccagtcctctggccacctcatcgagaaaatcgtcgacttcgtcgatgtcgtatccctctctgaaacgcacattgctgaaggtcttctccttgatgcgccttgcgagcgagtggtcgtcggtcgccatgcggtcgacgatttcgtcaaggaagtcgtcgacctctctggcgctatacccttccttgaaccgcactgtggtgaacgttctcgatgtgatggcgtctgcgctgatcatgactgatcctgtctgtcgctggatatctcgcgcttccactctactctcgcctcgcttgttggaattgcgattatggaagcagcattgaagcccgccgcgccctctgccgtcacggtggtgatcaccagctgcaatcagggagcgctcatccgtgaagcagtcgaatctgcgcttgccgaattcggtgcgccaggacgcgacggtaccgctcctgccggtcagtttgcgccggtccttgaaaaatcatccctatatcaattcccgtcctgcccacctacaggacgggacgattcacctgctcggcgctagactgaagatgtcaatcgtagtcaaaccaaaggcggtcatatcatgattctcgtcaccaccacgccgtcggtcgacggttacgtcatcaatagctatcagggcatcgtgttcggtgaagtgatttccggcgtcaacatgttcaaggatatcggcgccggcctgcgcaacatgttcggcggacgcagccagggctatgaagaggagctgatgaaggcgcgcaacgaggcgattcttgagatgcagcagcgggccgaggcaatgggtgcgcacgccgtggtcggtgtggacatcgactacgaggtgcttggcgccgacaacggcatgctgatggtcaccgcgtccggcaccgccgtgcaactcgcccgccgcggctgaactgtgccggcaccagcttgtgtgccggcaccggcgttcggcgaaacatcgcacggcgacggtatcgtaaagcgttgcgccgcgaagcgcgacggatgataccggtggaaaggaccgtgtgatgactcaaccgcaggcatatgcagtgaccgagggtgacgggttgcccgtggtgttcgtgcatggcatgggcgtggaccaccgttcgctgatgctgctggatgaggcattcttgtgcccggagtcgggcgctgccgcgtcgcggtcgctgaagcgcatatatctggatttgccggggttcggccgcactccggcactgccggcacgcgcgtgcggtctgccggagatggccgactggctgcagtccgccatcgacgatctggtcggcgcgggggagccgttcgcgctggtcggcaattcgatgggcggtgcactcgcccgtgagatggtggctcgcgagtcatcgcgggttcgcgggctggcattgatcgccccggtggtggatccgcggcgcactcgtcgtcatgtcgccgagcatgtgatcgccgagccgaatccgacgctgatacacgcgctgcctcaggatcagacgttcgatttcgtaaccatgggcgtcaaccagtcattcgccgcgtggcgccgctatcagtcatatattttgccgggcatccgtctgtgcgaccgtgacgcctgcgccagattggacgcccgttattggctgaatgacgacccggagcgcgtattcggcacttatgccgggccgactctgttcgtcaccggacgacgggatcagatcgttggttttgaagatcaacgggccctgttgtcgcattatcccgacgccacgttcgtcacgctggatgatgccggccacaacgcgcacatcgaccagcccggagcggtgattcgtctgctccgggagtgggccggccggctgtgacggtaggcgtccacgcgatgtcgggcgcggcacgacgtatgacacgcgctacactggcgcccatgaccggtaaaatcgaagcctacgaccatctgcctgaaacggctcgtgcgatacgcgagcaggtgttcatccgcgagcgtgactggcggcctgaattcgacgagtgggatgccgtggccgtgcatctgctggcgttcgacgggaatcggaccgtggcgacatgccgattctatgcggatcccgaccattccgatcagccgggaaggtacgtgatcgcgcgtctcgccgtgctgcccgacgcgcaaggccgcggtatcggctcccaactgctggccgacgccgaacgccgtattgcgcacagtggaggaaccatcgccgcggtacattcggagaacgaccactacaagttctacgagcggcgtggatatcaactcaccgacgaactctacgacgacggccgccacggttggttgatcaaggcgctcatatgatgcaacttacgggttgaaatagccgaaatccgtgattccccgtgcgaaatcgccgttttcgggcccgaaaacggcatttttgcacggggaattgcccagaacggcgatttcaacccgtaatttacgggagcgagtgggggctctttgtagtaatggccggttatcacgtgatccgattgatctcgcaatcagttggtttcgcgcgacgacaacggcgacgacggaggacccggacacggcaccggggccgaccgggacgaatcccacacccacgtcaaacgggaccaaaccgaccagaaaccaaagtctaaaacaccacgtctagtccctaaaacccggtatccggcatatatgagaaaccccggagcgttggcgttccaacgttttccggggattctccatacgtgcgagtggggggagttgaacccccacgagcatacactcactgccacctgaagacagcgcgtctaccattccgccacactcgcagacaaagagataacttaccagcgatacgcggataatgcaattcggcgtgtcgcggtggggcgccgtaatgattgtcgcggcgggtgctgcggtgattgttgcggtgacgcccgccgcaagcacccgtcgcagcgctccctcacctcacccgcgcggcccgttcgcatagaagcgggcaagcgactcgtcgcggaattcgtcgaagtaaccgccgtcaatcgaggcacgaatatcgtccagcagctttacgaagaaacgctcgttgtggatcgtcgccagcgtgaacccattgaattcgcgggcgcgcagcaagtggtccacatatgcgcgcgtgtaatgctggcacgtgtagcagtcgcacccctcctcaagcgggccgaaatcgaacttgtgctgggcacgcttgacgttgtagcgcccgtcgcgcgtgaaaatcgccccgttgcgcgcgcacctcgcgggtgcaacgcaatcgaacgtgtcgccgccattctccacacatgcgaagatgtcgtcgaccgaggcgatgcccagcacgtgccgtggccggctttccggcatcgcgtcgcagatccacgcgcacgtgtctgcgatgatacgcttctcgatcgcgccgccgatgcccacgccgtcgaagtccagcgaggcgatctgctcggccgcatgcctgcgcaggtcctcatagttcgcgccctgcaccacgccgtacagtgcctggtacggtttgcccagccgctcctcggtcagccgctggtgctcggccacgcaacgctgcgcccaacggtaggtgcgttccaccgaggcttcctgatacgagcgcgtgttcatcagcgtcgtcaattcgtcgaacgcgaacatgatgtccgcgccgattttatgctggatgcccatcgagatttccgcggagaaacgatgacggtcgccgttgagcggcgatttgaatgtcaccccatcctcgtcgacgaacgccagtcgttccttgcccgccgcgatcacgtcgtccgatttcatgccggtcacgtccatcgccagcgtcttcttgaatccggctcccagcgacagcacctggaatccgccggaatcggtgaacgtcggcccgtcccagttcatgaatcgcgcgagtccgccggccgcgtcgagcacgtcctggccggggcgctcgaacagatgaaacgcgttggacagcagacattgcgcccccagctcgcgcatggtctccggcaggacggccttcattgccgcctgcgtggcgaccggcacgaaggccggcgtgcggatgtcgccgtgcggcgtgtggatgatgccggtgcggccgtaacggcggccgccacggcctttgccgtcagctgaatcgggcagttgcgtaagggtttcgaaaaagaatgcgctgcggtcgccgggcctgccatcggccgcgccgcgcgggtgctccagaaaactcgtcatacgattactctaggcgatggccgggaaggcgggagatggcgctcggaaagcctgctgcgggctttcccggcggttcgtggcgtatcgttgtctcaagctgtccggctgatgcgtccgcttttcggacgggatatccgcgggtttcagaagaatcgttttgctgctgaccggtcggaaatgtcgtacgaaacaaggccgaaggcctgcttcatgataacggtagataattcattctctccttccaatcaacgttcaggaaacatccagagcaggtatctttactcttacgtagagcttggcggcgcgctggctcacagatacgagccccaacccgcctgctgatacttacgaatattgaaggagacaacatggctgacaacaacaacggatactggcccgccgataacggcggccagcctgagcagccgcagaacgacaacctgcagcaggacgctccgacgacctcggatgcgcaggatcagcaattcgcccaggagccgctgggcgcgcctcaggaagcgcccgcgcagaacgacgacgcgcagcagccgcagcccgaagcgcaggatacccgtccgacccagccgttggcgcctgtcgcgccgacctcagagcaggcccaggcttccgaaccgactcagccgctgccgccgcagccgacgcagccgacgcagccgctgtaccgcccggcaccggaatacggcgcctacggcccgactccgactcagccggagccccagcagccgcagccgacccagcagcagaatcagaacacgggcaacggcggcaacccgttcttcaacggcaacccgttcatgacgcgcccgacggacgacgcctcacagcagaatcgccagaacggcaacacgccctacggtttcccgttcggcccgcaaggcccgaacggcggccaggatcagggcatggctcagccggaagacggcggcaacgcgtctcgcggcggaagctccgcggccagccacatcgtgaccgcagtggtggccgccctggtggccgcggcgctgtgcctcggcgttggatacttcgcgctcacctatggttgggtgagcacgccgacgacgacatcgctgaccaacgtccagtcgaacaagtccggtaccggcagcgccaccgccaagacgggcgaggccgccgactggaagaccgtggcgagcgaggtctccggctccgtcgtgtcgattcaggcggcgctgagcaacggcaccgccaagggatcgggcgcgatcgtgagcgccaagggctacatcgtcaccaacaaccacgtgatctccggcgcccagcagattcaggtgacgctgtccaacgggcagatgtacaccgctcaggtggtcggcaccgacaccaccaccgacctggcggtcatcaagctcgacaacccgccgagcgacctgaaggctgtggaattcgccgactccgacaagctcgccgtcggcgaggacgtcatggccatcggcaacccgctgggctatgacgacaccgccaccaccggcatcgtgtccgcgctgaaccgcccggtcaccgtgaccgatgactccggctccgacatcgtcaccaacgcggtgcagatcgacgcggccatcaaccccggcaactcgggcggcccgacgttcaacgccgccggccaggtgattggcatcaactcgtcgatcgcctccaccgcgacctccagtgattccgccggctccatcggcatcggtttcgcgattccgtcgaacctcgtcaagcgcgtggccaacgagatcatcaaggacggcaaggtcaagcacgtggccctcggcgtgacaatcaccaccggcacggtcgaggcggacggcgtgacccgcgccggcgccaaggtcaccgcgggagcctccggctccgccgtggtgtccggcagccccgccgacaaggccggcctgaaggtgggcgacgtcatcgtggcgtacgacggcaacgcggtgagcagcacgtattcgctgctcggctatgtacgtgcgtcggcgcttaacgacaaggtgacgttgaccatcgtgcgcggtggcaagaccatggacgtcgaggtgacgctcgacaaggaggagtccgcggtgaacggctccggcaactcgaactcgaacaacaaccagaacaaccagaacaaccagaacaaccagaatggcaacggccagaacggtaacggcaatggcaacggcaacaacggcaacggccagaacgggtacggcaacaacgactacggcaacggcgggttctccgatccgttcggcctgtggtaaattccgctcccgaagccgctgacgctgcctgacggctgacattgcccggcagttgacatggctcgatgatggaggggccggtgcgcttgcgccggtccctccacttgtgtctgcggccatgttcccgcgggccgttggcgtgtcctttcgcagttgttgctagagttggtagaagccgcggatggcatgtgccgccgcgcaacataatcgaacgaacaattgaatatcgaataatctttttacgccgtgtatcgcctgccctcgccgttttaggcagtgctgccgatgggttaacaaggcgtgggtcgcatgccgttcgtgattccgcgcttgttgctgggatgacggacggtccgtatacgagcgtaaggagatacgatgcgtaagttcatctatctttgcagtcatctgtgtgttcaagtgccgctgttgccgattgccgtgctcacggtcattccgcttgccgtgtgcccgtcatggcggccgtggggagcggcggatattcctatactgggcaatcccggcgtgggccagtggattgtcatcatcgtggtggcgtacacgatcatcgacaccgtgcgcggcatgatcgacgatttgcggcatggccgggtcggtgtggatctgctggctgtcgtggcgatcgccgccacggtcgccgtgcaggaatactgggcgagctgggccgtggtgctgatgatctcgtccggcgaagccatcgaggaatacgcccaatccaaggccgaaagcagcctgaccgcgctgatgacggccgcgccccagaccgcgcacgtcgtgcgacggcccggcgtggacgtcgctggtgtcaacaccggcgacggcagctccgacgaccggggcgacggcttccgcaaggtcgccgctctgccgtcttccgccgccagcgggtcgtccgacgctgcgacttcccactatgacaccgttgccgtggaatccgtcacccccggcgatgtgctgattgtgctgcccggtgaaaccgtgccggtggatggcgagctgttgtccggatccgccacgctcgacctgagcaacatcaacggtgagccggtgccgcgcggagtgttcgcgggcgcccgcgtcatgtccggcgcggtgaacggctcgaccacgctgaccatgcgtgccaccgaagccgccagcgactcgcaataccagcgcattctcgcgctcgtcgcggccgcgcaggattcccgcccggcggtggtgaagaccgccgatgtgctggcagtgccgttcacggtgctcgcactggcgatcgcggccgtggcatggttggtgtccggtgtgccgacgcgcttcgctcaggtgctggtgctggcgactccttgcccgttgctgatcgccgcccccgtcgcgtatgtggcgggaaccggccgactagccaagtcgggaatcctgatcaagacacaggacgtgctggagaacctcggccgcgtcacgcacgtgttcttcgacaagaccggcacgttgaccgtgaagcagccgcaggtgacccgcgtcgagatgctgcccggcgccggcactcacctcaatgaggaccacgtactgatgatggcgggcgtggtcgagacctattccgtgcacatcctcgccaaaggcatcgcgaaggccggcacggaagctctgtcccggctgcatcggcggttcgaggaggggcagcggctatgcccgcagcccgatgcggactggcctggtcacgggcgcgattatccggtcgtcaagcacattgatgaagacgccgggaaaggcatctccggcgaagtgaatgggcataaggtgcgcgtaggcagactgtctttcgcggcctcaagcgaagatgggttcctgccggttgagcggatcgtcccgggccgggccacgactgatggagaccggcggtccggaaaacaaggtgaggggcggcttgcggacgagatccgtacccgtttcggcatgctcgcgccggatgaaatggcctcgtacgtgtcggtcgacggtcatctcatcgcccggatcgtcctgcgtgacgtgccgcgcgcgaacgccaagtcggcgctcgcgagcctgcgcggtctcggcgtcgccaagctgtccatgctgacgggagacaagcgatcctccgccgccatcatcgccagtgaggtcggcatcgacgacgtgcatgcggaattgttccccgaagataaggtcaccgctgtcacgaccgcgaccgtgacgccatcgcgcggcgtgacgatgatggtcggcgacggcgtgaacgacgcgcccgtgttggccgccgccgatatcggcatggccatgacggacggcacgtcgactgcggcctcggagtccgcgcaggtggtgatcctgaacgacgacatcgccgccgttccacgggccatcgccatcgcccgccgcaccaaacgtgtgatgctgcaagccgtgctggccggtctcgcgctggccctgatcggcatggttgcggcggcgttcaacttgattcccgtcgtggtcggcgcttttctgcaggaagccatcgacgtggtaagcatcctctgggcgctcaccgcgctgcttgaccgtgactgacgggccgtggtcgacgggcgcagctggaccggtcgtgatcgaccggccgcgcccgtcgccggacgatcgggcgagaacgaatgtgacattcgacaacaatgggggcaatgccgggaaatcccgccgttgcccccttccgtgattcggtggcttgcgataacctataacgcgtgactgaatctgagaacaatgaacttcgtatcgccgtgatcggcgccggtcccgccggcgtctactcctccgacatcttcctgcgccagctgaagaagctcggcgaggagctgggtctgggcaccaaggcccgcatcgacctgttcgagaagctgccggtcccgttcggcctggtccgttacggtgtggcccccgaccatccgagcatcaaattcatcgcatccgcgctggagaagacgctcgacaaccccgacatccacctctactgcgacgtggaattcggcaaggacgtgaccctggacgacctgctggcgcgttacgacgccgtgctgttcgccaccggcgccgtcaaggacaaaccgctgaacctgccgggcgccgacctcgacggcgtgtacggcgccgccaagttcgtcgaatggtatgacggataccccacgggtgcgcgcgaatggccactttcggccgagaacgtcgccgtgatcggtggcggcaacgtggcgatggacgtcgcgcgcgagctcatgcgcaacgccgacgacctcaaggccaagaccgacatccccgacaacgtctacgaaggcatccagggcaacaaggccaaggtgctgcatctgttcatccgccgtggcgtcgcccaggccaagttcagcgtgcaggaactgcgtgagatggagaagctgcccggcgtgcagctcatcatcaacgaggacgacttcgagctggatgacgacacgatcgaagaggccggcaaggacaagctgacgcgccagatggtcgaggagctgttcaccatccgcgagatggccgaagacatggaagacgacggcgacgtcgattacgagggcaaccccgcagatcgcaagtattacgtgcacttcaactccgctcccaccgagatcctcggcaaggacggcaaggtcgcgggcatccgcgtggagaagaccgagaccggcgccgacggcaagatgcaccgcaccggcgaattcgaagactacccggtcgaggccgtgtaccacgcaatcggctacaagcccgccgaagcgcccggcatcacctatgacgagaagggcgcccatctggccaacgcgaacggcgatggccgcatcaccaccgaggccgccggcggtgacgtgcgcgaacgcctgtatgccaccgggtgggccaagcgcgggccggtcggcctgatcggctccaccaagtccgacgcgttgatgatcgtcaccaacatgctggaagacctcgccaaggcggccgaaggcggccgtgtggccgtcgaccgcgaccccgagtccatcgaccgcctgctcgccgagcgcggtgtcaagccgattgacttcgccggttggaagaaggtcgacgccttcgaacgctccgagggcgcgaaggaaggccgcgagcacaagaaggtcgtcgagccggatcagatgcgtgagcttgctcacgcctgagcgacctgtagcgcgactcgtatacatcgatcaagccgcctcccgcgtgacattgcgggcggcggcttgtttttgcccgtacttgtatcatcccgtgcctccggaatcatttcattgtgctcaaggcgcatatccagccaactgtcagacagtgaatttagtgtgtgggctatggacggtaaattgcatgtgcgcggccacttcaacggcctgaaaacgacgctgctctttgcgttgatgtgggccatcatcatgttgatctggtgggccaccggcggtgaccgcggcacgctgggcgtatatatcgtcatcggtctggtctccacgttcagcacgtactggttctccgacaaactcgccatcgcctcgatgggcgcccgcgcggtcaccgagcaggaagctcccgcactgtaccgcatcgtgcgcgaactcagcgccaaggccggcaagccgatgcctcgcatctacgtcgccccgaccatgagccccaacgcgttcgcaacgggccgcaacgagcgccacgcagccgtatgctgcacgcaaggcatcctcaacatactcaacgagcgcgagattcgcggcgtcctcggccacgagctcatgcacgtgtacaaccacgacatcctcacctccgccatagcctccgcactggcgaccatcatcacgtatctgggatactcgctcatgtatttcggcggcggtcgcagcaacgaccgtgacaactcctccggcgccttcggtctgatcggcgcgctgttgagcgcgattctcgtgccgatcggcgcctctctgatccagatggccatctcccgcacccgcgaattcgacgccgacgaggacggcagccacctgaccggcgaccccgaagcgctcgcctccgccctgaacaagatctcctacggtgctcaggccaatccgatgccgaaaaccgcgggcacgcagtcggtgtcatccatgatgatcgccaacccgttctccgcgcgcggattctcgaagctgttctccacgcacccacctaccgacgagcgcatcagccggctcatgcagatgtcgcaggagatgcgcaattccggcatcggcggcggcagcccgcattacttgtactagcttcgttgcgcaaggctcgcgggcatcgccgtcatgtgatacactgacgacttgtgcacaaggcactgcggatgtagttcatcggtagaacgaaagcttcccaagctttaaaggcgggttcgactcccgtcatccgctccattcgcttcaacgatgaagctgtgaaacccaatcattccaacgattttcaattttgtaggcacttgctcgatcacacgatttttgccgaattgttgtcaccgtgttgtcacgaggtgtgtaaaagaggattcggagagtggttcagactcaaaattttcccgtgtccaatatctctgctgcagtgatcttgctgctgatagatgttgccacgtaatcaagatcggtgtcgaataggtctgcataagtatcccttcttagcttggcttatgacaggatttttctctgaattcagtgttctttctctgaattcagagaaagaatgtataattcagagaaagattcagagattcagagcaggcggtggcgaatggcgcacgagtatggcaaagaaaccctgtccaaggaattcaaaagcgatcgcgataaaggtctgccggattccgaattagtggaggctgttgtcgccttagccaatacggacggcgggtgcgtgtatctgggtgttgaggacgacggcaccgcgaccggtgtccagcgcaagcatcaagatcctgtcgggctgtcagcgatgattgccaataggactgtgcccccgatatcggttcgcgcgcaattggtgggtgatggcgtcaccgtcatccaagtcgatgtacccaagtcacatagtgtggtgtcaactaagtcagggagaatcctgcggcgcatgatgaaagtggacggtacgcccgaaagcgtacctatgtatccgtatgagatcgctacccggctttcggatctgggtaagctcgactactccgcccaaccggttccggggtccacgcgggaggatttcgatccgttggagcgcgaccgcctgcgcaagatcatctccacctaccgatccagcgaccgtaatcttctagagctttcagacgaggatctggaaaaatcattgcgtcttgtcgtatcggcggatggggatatgacgccgaccttgacgggtttgttgctcatcggcagggagaattcgctgcaacgtcttgtcccgacgaacgaggcggctttccaagttctggtcggcaccgacatcaaggtgaacaatacatatcgtggcccgctgctcaagaccatagagcagatagcggagtcgttcgctccttggaatccaggaacggaactgaccgtgggtttgttttcctcggtggtgcccgaattcgacgagagggcgttcagggaagcgttggtcaatgcgttcggccacagggattattcagttcttggccgtgtgcgtgtgctggtggatgacgcgggactgacgattgccaatcccggaggattcgtggagggcatcaacgttcacaatctgcttaccgcggaaccgcatggacgaaacccatgcctcatggatgcgttgaagcgaactgggctagccgagcgaaccggtcgtggaatcgatcgcattttcgagggggccttgaactatggtcggcccttgcctgactattcgagatccaacgggcggggtgtttcggtgctgctgcctcggagcgcgcccgacgaggcgtttgtggaattattagccgaggaacgcgagcgtagcggcaagtcaatgtcgcttgacggtctgcttattctggataagctcaagcgagagagacgttgtggctttgacgcgttgtcagagtccttagatatgagcgatcaacgtctgcgcactgtattggggcagttgacggagtctgggctcgtcgaaagctccggcactaacgctcgtcgtacatacacattgggggcgaaagtgtatcggcgcagcggtaaaacggtggaatatgtcagacagtcaggcatcgacagggtgcgttaccccgaattgatcatgaagctgatgcgcgagcagaagtcggtaagcaaaaacgacgtgatggagctattgcatctcgacgagaaccaggcatattaccaattgcgaaaactggttggtgagggacgcgccaaaaaggtgggtggtggtcgcaatgtacgatatgaggaaatgcaacgagacgacgatggaatatcgggcgaacagttctgattagggattatcccctgaatgcataaagctgggattcagcacagcaaagaggattttcatcgactcgttcgtcggtatgcaggaatcgccatggaattgttccatggcgattatccgttttctccggacgctcatcgtccagaccagtttcgctgattctgctccacgattgaagtgtgggcgatccttttgccctctactgatgccgttggaagggagccggcatgccgatatattcattccccgaaccacgctatatttggggcgcgggctgttcccaatccattgatatggatatgggagtagcaagcgagcatgtgtggccacacatgctcgctccacaggcgtggagcggcttgccggaagacccgggccccatggccggcaaggcatccggaccgctgacgcggcttatggaatgagccattccagttcccgtggggaggtgtttccttatgggctggcgtgacaatcgcaggcgcagcatatgcaagaagatcatgttcgcaccggaggaatgggagcaggcgaggaggatccacgagcgttgggcaaggaacatcccggtatacaggcggtggggtgacttcgcccgtcagacgctcatgcacggcgcgtcgatgaatgtctcggtgacgctggcgaacgatccggaggcgttcaaggccgagctccaccacatcggcgtgaacgtgaaccagacagcccattgcgctggcccgactggtggatcctgctcaccgccaccacgcacccggtctacctgctggcaatagcgccaaagatcagccggttcatcactggcggccagcgatgaatggcaagagcatggaggcatggcggtatctcggcatggcgcaaatgacgaattcttccataacgttcttcaggtccgggccagttgcttatagagcgtatgagcgtctgggtaaatcctgcagggcactccggcgacgttcgcttgacgctccatgatggggtcgtgcttgccatacagcagcagtttgccgggccttatcgcaaaaagcttctcggcgaagagcagatccagttcggattcggtgttcgcgcatcccaatgtgctggtggcgcatatcactccggaaggaacgcagctcaggcatgtgatggtgctgggggaaccgcatctgagattctgcacgattttgacgccgttcaccgccaatgtcgccagatagagctgattaagcagcatgattgcctgctgccattccaggtccatgtccgaagtgacggtgaggtccgagccaacggcacccatataccgcgagtattccgggatgtcgtcgagggccttctccagtcgcgggtatatccgcatgtcactggtgaacagacaaagcacggtatgggaaggattatggacgaatcgcgccttgcgatcccggtacggcaccatgagctccggccattcgtccagatacatctgcggctgaagcatcgggaaaccttgtggattgaactggatgcctttaccgctgagatagtcggcgtagcggtcgatgagctcttcgaatgatgcgatggatcggttcatgccgcccttcccacgttgggaaacttcatgacaaggacgtgcgcccccgggatttcgcatcgcagcaggcacagcacctggcgcaggcgatgctggtgaaactgctgcaccgcctggccttggaaccggggacggcaatcgtcgatcactgcgatttgacggcagccggccagggacgccctgacccgttcccagtccgcctcatcccgaacggcgaatagcaccgagagccagatgccgcgtcgcttgccattgatgtcgaacagacagtagggcgttcctgcttccggcatcaggggatcatagggaaccgtctgcgcgacggcgtcggcgggcctgccgtcccagaaagtgccgatgagatcataggtggatttcatgcttgtccctttgcctagagatcgaagacaatgccggtgcccagctcgatagccttgttggcgaactcgacgagcttgcggtagatcgtttcaagccgtgggttgatcggctccgtgagccgccattcaagccatccgagcatgagcttgcactgctcggcgttcaagtagtccacgtctccagggtcgatgagcgaattgcacagcctgtctatcgggccgatgaagtccttatcgaggagatcctcgtccccctcggttagttcgaatgattccgtctgccccggcttcgcttgaaaggtttcgggaatatagccgtagtagttgagaccttcaaggctgagaacaaggacaagttccatgatcacatttcccttctcttgagaattttgaagtgggtttctttgttgcttccaggcagaccgttgagcttgacgtttttcttcgttcttttgtcgtatatgcgcagatagcccgccaccatgtccgcgtcgattctccaccgggcgttctcgaacacgtacttgacgccccttctgcgcccctgggcaccgggagtgaaccggctgacaatgtcattgagatcgaccggctgcctcttccaactttcgttccacctcgcctcgcggtctttgcttctgtcgtagcggccctgatccaccatggagccggggacgtcgttgccgatgtagctgcgcgagctgtccgaataccgctgcttgctgtccgacatatgccatatgtcctttcctgcggcgccttgccgcatgccatcttgaagatgcgccagcattgtgagaatgcggcgtgcttcacctgtttgtatgagtgggtgggtccagacggtggcacaatgggatgtgcgagatagtccattgtgggccgtctggaccacggtgcgagaacttgccggttcgcgcaccgtttttttttattgcagaatctgtgccgggtcggcctgcttctcgtccctcctttccaagaggagtccgcgtgcgtagagttcgaggatgctggcgtcgagcgcttcgtcatcatggcgatggcgcagccagttcgcatgctggttcaggatgttagaagcgcattccagcgaggtgccgaatcgctgagagatttcctcgatggtcgtgagaccgagttcttcgatgagtacttggggtgcgatagcgtatttcgcccagaaattcgcttcgatttcggcaagctcgctgtctcggagatggcctcgcatggtgtgtcccatttcatgcaatttggtaaaacgaattcttcctgagttttcttggagattgcaggcaatgtatcggctgtcattgccgtttgcgctaatcgtgaatgatatgccacttgggcagctgcagagcgtcatcaagtcatccaaggagacagatgggttgaatgcaatctgatagggtatcgtttgaattccgtgtgcatccagcaactctgatgggtcgatgggcagcctgatgtagccgagttgctggaatgcgtccaccacgctccatttcaactcctgataaaacgacgggtcgtcaatcctatatcccgtgatgtcctccttgttcccttgcagtcaacagagtcatgatgagctcccgcgtctccgcttcgctgagatcgccgccgtgcctggcgcagtacgccttgatcgtgccgaacggcgtatcggcgtttgattcgggcaggcccagcagaaattccgatgtggtgtgcagagcggtggctatgttcgcgagcgtactcgacgtgggctcccgctctcccgcaaggtatttcgagatattcggctgggttgtcccggctcgcgcggcgagctgggactgattgatgccatgctgccgcataagcttgcgcatcctgtcgccaagtgccgccgtcatatgatgtcctttgtctttaagcctgcgaggctccttttcaattgcttcacggcaatcaatataccacgattattccaaaaggaataatcgtggtgcaacaactaatgtgctgcaagtaggaaaacgcaagataagtcgttcccaaattgttgtcaccatgttgtcatacaaggctgcaatcaggtaaataaagccgctaaatcattggtatttagcggcttttcagcatcggtcaagtagggttcgactcccgtcatccgccccaccactttccgctcccgctggcgggagctggctcgcgtcagcgagactgagggtggttttccacctatcagatagctacacgtgccagctccagcagggggctcagttgcccgcgtcccccgtatctcccgcgtcgccggccatcttaatcagctgctcgatggtgacgaactcgtacccctgcttcttgagatcgtcgatgatgccgggaagcgcctcgacgtcctgcgaacggtcgccgccgccgtcgtgcatcagcacgatcgccccgttatgcgcgcccgtcatcacggcatcatgaatcgccttggctccgggacgcttccaatcgagcgtatcgatatcccacagcacgttcatgtcgatcaggtcggacgtctcctgccactgcttcttgccgaacgccccgtatggcgcccttagcactttcgttacatgcccggacgccttcttcatgttcgaaaacccggcgatgatttcagcgcgcaacgcgtcgcggctgagtgtcggcatgtccggatgcgtgttggaatggctcgccacctgatgtccctcctccagcatgcgtttctcggcgtccgggaacgacaggcactcctcgcccacgtcgaagaacgtggccttgacgcccttctccttgaggatgtccaggatcgggccgctgtatttgctcggcccgtcgtcgaacgtcagcgcgatgaccttcttcccctccgggcgcgggttcaacggcacgacgatcgtgtcctgcggctcgacggtgacgcctttgtccacatgcttgccggaacgtttcccgacccagtattcgtgcacgccgtctttcccggcctgcttgagtatctgtatcgagccgcctgcgatgtcgatgctttcgccgtgcggcacggtctcctttctcacggtatggtcttcggtcacatcctcgcctgacgtcaccatcaccatgccatcctgcgggatcgtcgtgctgtcgattgcatcccggcgcacggcagcgccgttgatgctgacgacgatcggtttgccggcatgcttctcgatcatgtcgccggccacgtcgaccagattgcccggatgcgcgtcgaagtcgccattgtcgcgcagcagtcgtcccaacgtcatgtcgacgctgactttcatggaagtgccgtttaccgtgatcggtatctgccgccaatgccggtcccacatccaccagccaccgacactgccaccggccaacgccaatatcaccagaatggcgacgaatgcaatcagccgatgccgtcccctgccgcgccgaccgttatcggggccggctccgtactcgccatattcgttcccgcgcgtcttccccgcccggctcacactgtccccaaacgacagctcttcaatgtactgcggttcttttgtcacgtctttattttacggaggtgaagatgggggaaaggtgaggaacgggccgtggcgtgcggaggcgatggattccgcccggcggctccggccggagtagcggtggtgccaaatgttgcatggtcgcgggataatgcaggtatgacgattgcaactgccgaacgatacgctgaaatgctggacgccgcgcgccgcggcggatatgcctacccggcgatcaatgtgacgagctcccaaacgctgaacgctgcgctgcagggttttgccgatgccgagtcggatggcatcatccaggtttcagtgggcggcgccgcgtatttttccggtcagggcgtgaacgaccgcgtgaccgggtcgttggcgttcgcggcgttcgcgcatgaggtggcgaagcgctacccgcatatcaccgtcgcgttgcacacagaccattgcgccaagcagtatctggacggttgggtgcgtcccctgctggacatggaggccgatgaggtggcgcacggccgcgagccgatgttccagtcccacatgtgggacggttcgacggttccgctggacgaaaacctcgccatcgccgaacagctgctcgacaagtccgtcgccgcgcgcacgatcctggaaatcgaaatcggcgcggtcggcggcgaagaggacggtcatagcgccgaaatcaacgaaaaactgtattccacgccggccgatggcgtgaaggtcgcccagcgtctcggcctgggagagcgcggccggtacatggccgcgttcacgttcggcaacgttcacggcagctacaagcccggcgtggtcaagttgcgcccggaactgttgggcgacatccagcgcgaggcggctcaggctgtggtggacgggcgtatcgcatccgccgccggggccgtcgattttccgaacggcaagccgttcgctctggtgttccacggcggttcgggctctcgcccggaagagatcgccgaggcggtgcggtacggcgtcgtcaagatgaacatcgatacggacacgcagtacgcgttcacccgtgcgatcgccgatcatgtgttctcgaactacgatgccgtgctcaaggtggacggcgaggtcggcgagaagaagctgtacgatccgcgctcctggggccgcgaggccgagagcgcgatggcggcccgcgtcgtggaggcctgcaagcagctcggttccgccggcaaagccctgaagtgacgtcggtcgccgcggtagatgcaaccgcagctgtcgagttacggtcttccgatatgatggctgaatattgaaaaaatgcgtcggagcgggatttcccacgcaagtgcagggagagactgcaggaacttcaacaaggcaaggacggcaagttgcagccgttcgcgcccatgttgatatgggcgttgaaaaaacgaatgcggcggttaccacacccgccccagcgcttaccttcgcagtagagggcatacggtaggctgttcccggcggaattgtgcggatgcggaggtgcagtatgtccggaatcgtgttgatcggcgctcagtggggcgacgaaggcaaaggcaaggctaccgatctgatcggtaccaaagtggactatgtggcccgtttcaacggcggcaacaatgccggccacagcgtgatggtcggcgaccagatgtatgcgttgcacctgctgccttccggcatcatcagcccgaacgtcacccccgtgatcggcaacggcgtcgtcgtggatccggaagtgctgttcgaggagattgacggtcttgaaagccgcggcgtggactgcgcccgcctgctggtgagtgaggctgcacatgtcatcgcgccttaccatcgcacgctcgacaaggtgaccgagcgtttcctcggcaagcataagatcggcaccaccggccgcggtatcggcccggcctacgccgacaagatcaaccgcgtcggcatccgcgtgcacgacctgttcaacgccgagcacctgcatgacaaggtcgaagccagtctgcaccagaagaaccagattctggtcaagctgtacaaccgtcgcgccatcgacgtggaccagaccactgacgagctgctcaagctcggcgaacgcctcaagccgtacgtcgccaacaccggcctgattctgaacaaggctctcgacgagggcaagaccgtgctgttcgaaggcgcccaggccacgatgcttgacgtggatcacggcacttacccgttcgtcacttcctccaacccaaccgccggcggcgcctgcaccggcaccggcgtcggccccaccaagatcacccgcgtggtcggcgtctccaaggcgtacgtgacccgagtcggcgagggcccgttccccaccgagctgttcgacgaatccggcgaatggcttcgccagcagggccacgagttcggcgtgaccaccggccgcccgcgccgctgcggctggttcgatgcggtcgtgaaccgctacgccagccaggtcaacggtctgaccgacctcgtgctcaccaaactcgacgtgctcaccggtctcaaggagattccgatctgcgtcgcctacgacgtggatggcgagcgttacgacgatatgccgacggatcaggccgccttctctgctgccaagccgatttacgagaccatgcccggctggaccgaggacatttcgcaggtccacgagttcgacgagctgcccgccgcctgccaggcgtacgtcaagcgtcttgaagatctgagtaactgccgcatctccgtgatcggcaccggccctcagcgcgaccacatcatttccgtccactcgcttctcgactagtcgccattcggcgttctcgccgacccacggctgccgggacagagtgaatccgcgtactacaagggtttcagatcatgaatcagcctgtaccgttcgtgccctcctcgcatgacgaatccgatggcggcgacgccgccggcgcgggggacatcgaatccgtctctgccgggtccgatgtcgccgacacttccgcgccggactcgactccaagcgaggctcgcgtcctcgccgcggacgagccggcgccatcgacccaagagatcagcgcctccgaaatcgaatacgcggcgcctcggcccaccggactggcagccgcggtagcaccaccttccattccactggccccggccaagcgcgtgcaggcgaaattcaatcccctcgccgatggcatgctgtatttggtggtgttcgtcggcgggttcttcggcacggcgatacgatacgggctctcgctgctcctgccgaatccggccgcgccaagtggcctccttcattcgttccacaccgccacgttcatagcgaacatgctggcgtgcttcatcttcgccgccctgagcacgtacatgtcgcaggcggcgtggattcgcaagcgcatccgccagctggtcagccgcggtgtcggcatgggcatgtgcggcgggttctccacgttgtcggcgatgatgatcgaggatctgaactcgttgcgcgccgagaacatcgtgggattcgtgacctacacgctgctgagcttcatctgcggtttgatcatcgcgtggcttggcaccatgctgggccttgcgctgagccgaaaacgcgaggcgcacgtggtggctcgcgcggtgcgcgagtcgcaggccgccggcgctccgtccggagcagacttggctgttgaaagtcaggccggttcggaaccggctgcgggccgcgtacaagacatgccagtatccgacgaacagcaccttccgtcgttcgaaccggatccgatcaccgcggaaattccgctcaggcctgatcctgaaaccggggaggtgcgctgacatgtttgccctgatctgtatgtgcggcggcttgggcgccgtgacgcggttcgtcctgaacacctcgattcaacggtggtggaaccgcgcgttcccgctgtccacgttcatcatcaacgtgctcgccacgttcttcgccggcgtggccgccgcggcctacttctaccagacggccgaccattcgtcgtacctgctgttcgtcaccggcttcctcggcggtttctctacgttttccacggctatcaacgagatggtgtcgctcgcccgcagcggcaaatacgccgcggccgccgtgtacttcatgatgaccgtgctggtgccggtggtgtgtgtggcgctgggttgggggctgatcgcgctggtgcggtagctcgtctgcgctggagtggctctcaaaactcgcagatacaaaaacgttgttgttggaaaataggggttctgtttttgtatctgcaagttttgagagcgtcgttctgtatacaattaggcgaacagtcatattgtgacggcaaacgatggagtgggggcatggtcgggatgcgtgatgtggccaaaaaggccggggtgtcgttgagtacggtgtcgctggtggtgaatggtgccgggtgcgtgtccgatgacatgcgcgagcgcgtcgccgaagccatgcgtgcgctcaattatgtgccgaacgagctcgcccgcaacctgtatcatgaccgcaccaacaccgtcggcgtcatcgtgcctaccatccgccatccgttcttcgccacgttggcggccggtctgcagcgagagctgtcggagcgggggctgcgtaccatgctgtgctcgacggccgattcgggtactggcgaggccgagtacgtcgacatgctccgccggcatatgatggatggcatcgtgatggcggcgcacaccgagcacgctccggattactggacttcgatcggtcggcccatcgtggggttcgactgttatctcggcgagggcatcccatcggtcggctccgatcacgagcagggcgggcgactgatcgccgacctgttgattcataatggttcccggcatgtggcgatggtaggcggcccgtgcaggcagttccatgatctggcgcagacgccgactggcgaggcgcggcagacggaatcgcccgggaacaccacgttcccgaccgtgcgctattacctgacgctggagcgtgaactgcagcgtgcaggcattcggtgcgagtacatcgaggccggggaagtggcggattttcagggttgtgcgacggccatgcgcgaactgttcgaccgttttaccgacgtggatgccgtggtcagttccgatatcggtgccgcctgctgcgtgcaggaggtgtttcgccgcggcatgtgtgtgccgcaggacgtgcaggtcgtcgcctatgatggcacgtatctgaccgacatggcagggttgcgtctgaccgccgtatgccaggacttcgatgcgcttgccggcacggccgtcgcccgcatgacggatgacatcgaggggcgcccggtcgattccgccggtgacgtaatccctgtttccctgcgcgaggccgacaccactcggcgctgattgccgcgcctccgccagcgagtccagatgcggtacctacgccaaccgcttcggcgacggcaccatcgcctcgctcaccgatgtgctgcgcacccgcttcgccggggtgtacgacggtgtcctcatcctgccgttcttcacgccgttcgacggcgccgacgccggctttgatccgatcgaccacaccaaggtggaccagcgcctgggctcctgggatgacgtggccgaactcagcaagtcccacgacatcatcgtcgacgcgattgtcaaccacatgagctgggaatccgcgcagttccaggacgtgctgaagaacggcgagaaatccgagtactacccgatgttcctgaccatgagctccgtattcccgaacggcgccaccgaagaagacctcgccggcatctgccgcccgcgcggcgaatctcgcaagtcccgcgctcccaaaagtctcacgcgacgcggccggcatatcggccgtgccgcgtcgtcgtgtaatatgcgaacgttacgatagttgtatacccgtaacgagagcgcacaagagaagagaagtaaaccgatatcatgaccgatgatcagcagcaaccgaacgaattccccgctccgaagccgttgccgggcagcgtgtacattcgccccggcatcgatgatcggcctgattacgacaaggtgctcagccccgaagacaagtccgcggtcgcccgcttggccgtgcatcagccgcggcgcaaggtcgaggcgtccgtgacgcaagccgagacccaggttgcgcagatgacttcggagggatctcccgcggcggccgcggcctccgtcgacacggcggtcccggacatgggctcggcgtacgtggacatgcgcgacccggtggtcagcgccgacggccagcgcccgaaccccggtcaggtgacccgcctgtcgtggggcttcgcggtgggcgcgaccatgtcgatcgtgccatgggccgcattgaacctgctcgcgctgcctgcggtcatagcgaaagtcagctggcagcgggtctccagcgcggttgcctcccgcgcggcgttctccggtggcggccaggaactctccgagagcctggtcagtcgcattggcacggtcggcgacggcggggtggcgtcggcatgggccattgatctggccgtggttgttgtcgtgggcgtcgtcgtgtcgctgattgccgaggccgtcgtctccgcgctgtccgatcgcacgcgcgtggccgctggccggcgcacgccgtggatcatcgcgggaggcgtcgtctccgcggtgatgacgctggcgctgggactgtgctcgaacgtggtgggcatcgcgttgctgtggggtctggtgcaggtcggttatgtgatgctgaccgtgccgatggcggctgcgttcagcgagcgagtgcccgacaagttccgtccgcgcatcgtgcgcgcgcgtggcatcggccagatggtcggccaggcgctgggcgtgtggatcggcgtcgcctgcgtcgtgttcggcgggctgtatacgccgttcgccgcggccgccgcggtgttcctgctggccggcatcgtgccggtgctggtgtggccgaaggaaccgtcgagcgaggagcagccgcatacggcgatgagtgcgcacatgctgatggagcggttccgcgcgccgcggcacgccgtcgaattctggaaggcgttcgcttcgcgctccttggtgtcggctggtgtcggactgacgaccatgttcctgtggttcatcgcatcggcgctgatcttccgggattggttcacgcaaggcaactcctctccgatcgcggtaccggtgtgctcgttgatcgcctcgatggccttggcgacgctcgtcggttccgtgggggccgcgttcatcgccggtccggtgggtgagtacattgaggatccgcggtatctgtcggtcatttcctgcgtgctgtacacggtggcgttggctttgcccatgaccatgccgagcgccgtcagcatggtgctgttcgccctgatcggagggttcgcgttcggcctgatcgatacgttcggccagttgcttgcgatgggcgcgttgccggatgcgcgttcggccggccatgatttggcgttcttcaacctgtcgaattccgtcggtctggcgctcgccgcgataatcggcgcggtcggtgtggctgtcaccggcggtttctcggtgctgttcccggcggccatcgtctgtgtgctcgcgtccgcggtcgtcacgatttcgatgaagcgctagcaatccggccggattggccgctgttgcgcctcgtttgggattgaggcatcatcctatccgcgattagtcccatccgttgctgctgaaatgggactttcgcgggatggggcgtcgatgtgtctgtctgtaatgcaggcggaacgcagacaggttgtgccgacgccgccgatgttgttatgccgcggccgtccacatagtgaacctttgatggctgtcgtggaatcccgcgcctatgttgtcagacagtcgagcgcgaaagagctcgaaagacacgttcgataccgaaaggaggttcgccgcgatgactggatatgctgctgataacgccgctagcgcaaccaccgttaacgttgttctgctgtctgcacgaattattattccgtcttcgctggcggactgattcggcatcactgcttggaaccccgccaacgaaggcagggctcagcgagcaactaatcgtatagccctgcacgagtcgcggggctttttttgatgcgtcccataaggtcaccggatcagcaaagcggcaaacgagagagaacagaataaaaaatcgcgggctcgtccgcgtgcagtaacaggagctaacaatgacagcagtcacactgacagctgacggcaccacttcggtgggtggaaaagcaaaggcgatggtccgtgactcggtcaagaccgtgatcgccgcctcgatggtcggaaccgccatcgaattctacgacttctacgcctacggcaccgccgcagcgaactacttcccgcacatcttcttctccgcgaaggacaaccccaccgtcgcgctgctgatgagcctgctgaccttcgccatcgcgttcatcgctcgtccgctgggatccctgatcttcggccacttcggtgaccgcatgggccgcaagaccacgctggtcgtctcgctgatgactatgggcgtcggcacgttcctcatcggctgcctgccgacctacagtcaggttggtgtcggcgcggtcgcggtactgtgtctgctgcgtttcatccaaggcatcggccttggcggcgaatggtccggtgctgcgctggtcgccaccgagaacgcgcccgaagacaagcgtgcactgtacggctccttcccggagctcggcgccccgatcggcttcttcctgtcgaacggcacctacttcgtgctggagtcgttcaatgacaccgatgcgatgtgtgcctggggttggcgtgtgccgttcctgctgtccgccgtgctggtgatcatcggcctcgtcgtgcgagtccacatggaggagaccccgatcttccgcatggcccaggagcagaagaaagtcgtcaagtccccgctgaccgaggtgttccgcaagtcctggaagcaggtgctgcaggcgacgttcctcgtggccgtgacctacacgctgttctacacgctcgccacctggtcgctcgcatggggcaccaagaccaagcgtgaaggcggcggcggcctcggcttcaccaaccaagagtacctgctcatgctgatgatctccatctgcgtgttcgcgctgttcatcgtgctttcctgcctgtatgccgaccggatcggccgtcgtcgcgtgctgatgttctcgtcctgcgcgctggtcgtgttcgccgtgctgttcccgttcctgctggacagcagtctggtcggtcagaagaacttcgctgccaccatggtgttcctgtgcctcggcttcgccctgatgggcatcgccttcggcccgatcggcgccttcctgcccgagctgttcgacgcgaacgtgcgttactccggctccggcatcggctacaacctcgccgccatcgtcggcgctgctttcgtgccgaccatcgccacgtggctgtcgaagaacttcggcgtgcattcggtgggtctgtatcttgccgtgatggccgtctgctgcctgattgcgttggcgacctgcaaggagaccaaggacgtcgactttacgaagtgacggcgatggtcgggtaccgcccggccgcgtttgaactcccaaaaaacaacaacaatacacaaaaacaatcattcaatatttggacgtgggcaaccacgtcgcctccagtggtactagaaatgagccacaggaggggatgactttggcgcgggacacaatcccgcgtggaagccgtctgcaaccaagagggccgtcgaaagcgagcgcgttcggcggcaagacatccaattaaaggagtgcctattatggcagcaactatctggtatgagaaggacgccgatctgtccgtgttcgatggcaagaaggtcgccatcctcggttatggctcccagggccacgcgcatgcgctgaacctgcgcgactccggcgttgacgtggtcgtcggcctgcgcccgacctccaagtccgtcgagttcgccaaggagcagggccttgaggtcaagccggtcggcgaggccgtcgccgaggccgacgtggtcatgatcctgctgcccgatcagtaccaggccgccgtgtacaagaaggacgtcgagccgaacctgaagccgggcgctgccctggccttcgctcacggcttcaacatccactacggctacatcaagccttccgaggatcacccggtgttcatggtcgctccgaagggcccgggccacatcgtgcgtcgtgagtacgccgccggccgtggcgtcccggtcgtcgtggccgtcgagcaggacccggacggcaagacttggccgctgtgcctggcttacgccaaggctctgggcgccctgcgcgccggcgccatcaagacgaccttcaccgaggagaccgagaccgatctgttcggcgagcaggacgtcctcatgggcggcatcaaccacctgtgcgacctcggcttcgacgtgctgaccgaggccggctaccagccggagattgcctacttcgaggtgttccacgagctgaagatgctggtcgacctggccaacgagggtggtctgaacaaggctcgttggtcctgctccgacaccgcccagtacggcgactacacctccaccgtcatcaccgacgagaccaagaagcgcatgcagtaccagctcaagcgcatccaggacggctctttcgccaaggagttcatggatgaccaggctgccggcgccccgaagttcaaggaactgcaggagaagttctcccacccgcaccttgagaccgtcggcccgaagctgcgcgccatgttctcctggaacaacggcccggccaaggaccaggacgaagccgagtccttcaacggcaagatcgctcgtacccaggttcagtgatcgcctccgctccggctcccgctggcgggagctgccagtcggtcgcagactgactgagagcggtgcataacaaggccgccgttcccgttcattcgggagcggcggccttctgcgttgccggtgatgcggccggtaacgaagccgacattgccgcgtcctgcgccgcgtcacccgctccccacctgaactgttcatactccaatagtgagatggctcacgttgtggacggtgagggggctgtggcggcgttaccggtaggatagtcctcagttctaaggacaaaatccttaacgcttggatcgaccgggcccatgcccgaccccaaacgcgcggaatgcaggctcctgcataatgcgcaaccacaaacgacaccgtgtgccggcaagagtgccggtacgcaagtaaaggagtgccaaacatggctgcacaaatctggtatgacaacgacggtgacctctccgtgctcgaaggcaagaaggtcgcgatcatcggttacggctcgcagggccacgcgcatgcgctgaacctgcgcgattcgggtgttgacgtggtcgtcggcctgcgcccgacctccaagtcggtcgccttcgccaaggagcagggccttgaagtcaagtccgtgccggaagccgccgccgaggccgacgtaatcatgatcctggcccccgaccagtaccagcgcacgatctgggccaacgacatcgagcccaacatcaagccgggcgcggccgtcgccttcgctcacggcttcaacatccactacggctacatcaagccttccgaggatcacccggtgttcatggtcgcgccgaagggcccgggccacatcgtgcgtcgtgagtacgccgccggccgtggcgtcccggtcgtcgtggccgtggagcaggatccacgtggcgacgcttgggacatcaccctggcttacgccaaggctctgggcgctctgcgtgcaggcgccatcaagacgaccttcaccgaggagaccgagaccgatctgttcggcgagcagaatgtgctcatgggtggcgtgaacaagctcgtcgagatgggcttcgaagtcctcaccgacgccggttaccagcctgaaatcgcctacttcgaggtctgccacgagctgaagatgctcgtcgacctcatgaacgaaggcggtctgaacaaggcccgctggtcctgctccgacaccgcccagtacggcgactacaccaacacctgcatcgacgagcacgtgcgtgagcgcatgcagtaccacctcaagcgcatccaggacggctccttcgccaaggagttcatcgacgaccaggacgccggcgctccgaagttcaaggcgctgcaggaggagtactccaacgtgcgcatcgagaccgtcggcccgaagctgcgcgccatgttctcttggaacaaggacgccgtgaaggacgccgacgaggccaactccttcaccggcaagatcgcccgcgcccaggtgcagtgatttctgaagctgtgaggccgtaagaccgtagagctgtaaagccaggccttaccgcatgactcaggtcgttgtcttcgttgttcatcgccgaagacaacgacctttcgtttatctggtcctattaatgtgttcgtaagcaatgtgcttacgaacacattacgagtatcaagggttgctatcacgccaaattgcgtcactgtgtgcgccctcgcacacagtgacgcctgtgtaaaccctttatttttcaacggttctgcagattgcgtcactgagagaggtcgcgcacagtgacgcaatccgcgcacagtgacggtcgataaccatggttgtgtcgcacgattcgcatgtttcgtatgatcacgtgcgagttgcaggatccgacgctggtggcatcagcgccgaggctcgttcgctgtcgtcttccgcgatgcccgactcatacgcggcgccctttgcggcgttctctggcgcggtacctacgttgccgctgacgggccgtctcagcacgatcatctgccagcagtgcccggaatttcgggtgtggtctattccggcaggtggtgtcaagggctttcgccaccctttgcgcgaatcgtcgccgcccctgcgaggtcaatatatcatcggcaaagacgacgatgactgtatatcccatcgcccgcaaagcctgcctcttgcgttcatcccatcggtattgtcgtttgtcgcggcgatgcgcgtctccatcgtattcgatgatgacccgttgtttggggtatgcgatatcgactgtcgcctcgtgagccaactccggaatgagtatcttccagtgtttgaccggctgcggcaatccatgtcgcaacatcacgagagtgcagcggcattccatggtggagtcagtcacggcatcgaggaaaacgagggcatcaatgcatttccttctgcccgggaacgcgtctgctccatcaaggaaccgcgagatattggcgaccgtcatggagcctgatgacgcgcgcagtatggcatccgccagaacgattacctcgatttgcgtgagatacggcgccagcagtgcccatgtcatcagcgggtgcgtgtagacgatggtgatgttgtcgtgagtccatgtgaggtgggcgatgcccgtcaacgatggcgggcatttcaggtaggacgtatctttccgtccggatctcttggttggctccccaacgtacagtacttggaacttcacggcttcaaatcttgaacatagcggtgtctctatgcctgccagacgtaatgcggtcataccggtatagaccggtggcgaggtgttgatggtttttcgtgagtgttccatgcaatgcaggaacgtcgtggattgcagctggcgcagtgagcgcgcaagatagttgttcgcgactgttgcgctggagctgacaggggtgtgctgattcgtattcatggattgaatgtaagcatgataatctgcagtgcgccaccggccgcctcaaatctgtggataagtgtataactcatcggttatccacagtgatgtagcgaatgtggatatgtaactggcggagatgctgcgtgtggtgctgctctgcggatggaggaacgcgtcactgtgtgcggggtgcgtcactctgtgcgccctcgcacacagtgacgcccatgtaaatcccttatttttcaacggttctgcgagttgcgccactgagagagggcgcacacggtgacgcaacccgcacacagtgacggtattgcgggcttccgccgtgcacgggtacgggtatcggatcatgtgactgatccgatacccgtacccaacgcctcagagcgcctgcgggcgcaggacgagatcgaaatcgaactccgcgtcgtcgaggcggtatttctcgtgcagcttgggaccgcagctgttggacccgacgccggactgcatgtaatccacgcacaccaccgtcgaatccgccggcttcagctcgctgttgtgggccttggcggtcagctcctcctgggtgtaaggcagcgcctggaagtcgaaggcgtggtcaccggcacggagcaccagcagctcggcgtcatcgctggcgacgctcgcccaatcgcagtcgtgatggttgccgttctcctgcggcttgatatacggctcgaacagcgattcgggagtgccggagaacacgccatgatagctggaccggcgcttgtcgatgtagctttcgttcgggccgagaccgcaatatgcgatctgccgcatcggcttcggcacgaacaggcgcaggccgaaacgcggcaggaacgggaaatcggtgtcgcgcatcacatgcatgcgcagcgccaccgaaccgtcgggcgcgatggtccagtcggcgtcgatgtcggcgatgcgctgcacaatcggcgccaccagcgccatcgtcgcatggatcgtcacctggccgtcgaccaccaccgagccgtcctcggacgtcgctatggcgctcacgtcgccggcgtcgacgttgccgtcgtcgaggatcgcatcgtctccaaacgaggcgaccggcgcatcctcatcgtccgcacgcagttcaatcgactcgggcttggcgatgacgtcatcctcatcgaccagtacaccgacctcgtacgcgcgcgcctgagcgcggtcatactgggcgcgaatccaatcggccttgatgtactggtcgttgtcggtgggagcgcgccacacgttcagctccatcggcctgttaagcagcgaccggttcgcgaacgacatcgacgagaacaggccggtacggcggtcgagcacataccggaacgtcgagccttccacggtgatcgaggcatcggtctgcatgacggtcagcgggtctgccagcacgtcgtcgtagccggcatccgcggcatcgttcgccccatcgtcggcgccttctacgctatcggtgccgtcatcggcaacgtcgtcgacatcgtcatccgagccgatgccatcggcgatatcggccagcgcggcgacgaccgtctgattgcgcggatccgcggtcggcacggcgacctcgtcgaagccgagctcgaagccgatcggcagtgtctcggtgtccgtcgcctgatagtacttcaccagcatcgtcacgttcccggcctcgggtatggcatcaaggatctcagccggtacgtcgacgaccgcgtcaccatgcggcgcgatcgatggcatcgacggcgtgtaattgccgggatgctcctcccggaacgccgcgcccgccgcagggtcgctctcccacgcagcccatacggtctccacgccatccaccagcagctcgaacgtcatgaacaccgcgtcggcggcatccaggaagtccaggtaattgtgcagcgtcaccgtgcccgcggccgcgtcgaaaccggtcacgcgcaccggccgatacacgttcttgaactccagcagcccggtatgcggcgtgcggtccgggtacaccaagccgtccatgcagaaattgccgaaatgcgggtactcgcccgaatcgccgccgtacgcgtactcgcgctcgccggccgcgttcgtgccacggtcgatcgcatggtcgcaccactcccagatgaagccgccgaccaggccgtcataacgctggatgcgcgtgaaataatcctccagatcgcccgggccgttgcccatcgcatggcagaattcgcacaacacgtacggcttgacgccgttgtcgccgtcatcgccgttgctgccgtcgcgcagcccgtccggcgtgcgcggcccctcctcggagaagtactggtcgatctcctcgacggacgggtacatgcggctgtgtacgtcaagatagctgtaatcgcactcctgtccctcatccacataccgggcgctctcatagtgcgtcaggcggctcgggtcgaaggtctgcgtccacagcagcgccgcctcgaacgtacagccgtacgcacactcgttgcccatcgaccagaagatgatgctcgcatggttcttgtcgcgctccacgctgcgctgcgcgcggtcaacggtcggcgcgatccacgcggggttgtcggcgataggccggttccagcgcttgttgacagccgcgtcgctctcgtccggatgcacgccgcgcatcgcgccgtggctctcgttgtcagcctcggccaccacgtagaagccgagacggtcgtacaggtcgtagaagtgcggcgcgttcgggtaatggctggtgcggatcgcgttgacgttgtgctccttcatcagcgtgaggtcgcgcatgagctgctcctcgctgatgaccgggccggtcaccgggtcgctgtcgtgccggttgacgccgtggagcttgatcggcttgccgttgaccttgaccacattgccatccacgctgacctcgcggatgccgacgagcgcggtgatgacctcattcgcggtggtgtacacgatggtgtacaggtacggcgtctcggcggtccacagatgcgggtcgtcgaccgccagggatgcgtgcgcggtcggggcgaacgcgctgtctccggtgaatccggtgccgttcgcgccgccggcgagcgtgccggtcaccgacgcgatgcgcagtgcggcctgtgcgtccgtggagtcatcgtcgatggcggccacgtcgtcggtcgactcgatgacgccttcttcttcgtcgtccgcggcggtgtcgtcgctgccagtgccggtcgcgtcgtcggcttcgctcgcgtcgggctgtgtccgaaccgtcacgtcgtcctcgtccccggccatcggatcatcgatcggctccgaggccgtctctgccaccagctcgccatcctcatcgaacagctgcaccttgaccggcacatccgcatcgtcgaagaacgcgaaatccacgtcgaccgtcgcgtgatcgaccggcgacgcatcatattcgtcatcgctgatgccggcctcaaccagcgcggaatcgacattgcgccaaatcgacgtatgcacgaacatgtcacgaatcgcatactcgggacggtccagcagatacacgtcacggaagatgccgctcatgcggaacttgtcctgatcctcctgatagctgccgtcgcaccacttcagcaccagcacggccagcgtgttcacgccgtcctccagcacgtcggtcacatcgaactcgctggtcgaatgcgacacctgcgaatacccgacgaactcgccgttcacccacgcatagaacgccgaatccacgccctcgaaattcaggtacgtgcagggtgcgtcaggatcggacgtatgcatgaaatcgcacaggtacacgccgcacgggttgtcctgcggcacgaacggcgggtcgaacgggaacggatagtcgaaattcgtgtactggtggcggtcgaaaccatggttctgccacacgctcggcaccggcgtcgtcgtgaagccgtccgccgccagcgcacccgtggcggcagtgcgcggatcggcgttctccggtgcgtcatccccgccgaaatccacgtcatagaacacggggcggccggcggcgcgcagtcgggagacctcggcgtccaagtcgtagatgctcgcataatacttgaaatcccagtcgccgttcagcagcatgaaacggtcggaattcacgcgattctcgccgaccgtgtccatcggcgtggacgcgggcacgtaatacgcgcggttcggctgcgtgccgacatgtagatggccgagactctcgtagtaccggggaatgaacatgatggagccctccttggttgtgcatgtgccagtgcgatgacactgcacaccattatcagcgtcagcatggtcgagaagtaaggcctttgcctggcttccggcgatattcgcgggtcctgggaaggtggtctcgcgctaaaccaaggaaaatggcggctcacaaggtttgtggggacttcgttgtgacttgtgttcggcgtgtcggattatggtgggctggctctgtgcgctcgtgagccgttccggctctgttcgcgcgtgcggcggccatggctccatccgcgggatgtgcgcgactaagggcggacggtcttgcacgtctgcgtgacctggtatgcggtcagcagaatcgcaagccacaccacaccggcgatgacggcgacgcgatagctggacgagaagcacatgagcaccacgacgaatgccaggaatgcgagcactacatacggcatcacgcgggcgaacggcagcttgaaatggatgcgtcccagagcctcgtctccggtgagcccggccagctcgccgggcccgtctccggccgccacacggcgacggaaatgaatctcggtgaccatgatcatcgaccagttgataacgccagcaatcgtggcgatcgacatcagataattgaacgcgaaatcgggccacaggaacacgaccaccacggccagcgcggtgatggccgcggaagcgagcaccccgacaaccggtacgccgtggaagttgagcttgccgaggatttcgggcgcgttgccctgcctggccagcgagtacaacatgcgggagttggcgtacaggccggagttgtacacgctcatcaccgcggtcagacacacgaagttgaggatgccggcggccgcgtgcacacccaccgagtcgaagatctgcacgaacgggctggtcgtgccgtcgatcgtgttccacggcaccacggccatgatcacgccgagtgcgccgatgtaaaacaccaggatgcgccagatgatgccattcgtcgcgcggggaatggttctgcgtggatcttcggtctcgccggccgtgatgccgatgagctcggtgccgccgaaactgaacatcaccacgaccaacgccatcaacagtccggtccattggccgtcggcactttgctgcagcaggccgtgggggagtacgccgccatcgagcgcgaaccagttcgagaagctcgccttgacgccggaatccgttggcagtccggcaatcagtaccgcgagcccgctgacgatcatcgctatcaccgcgacgatcttgatgatcgcgaaccagaattcgaactcgccgaacttgctcacccccagcaggttcatcgccgcaatcacgacgagaaacaccgcggccgacacccattgcggaatcgcgggaaaccagtagttgacgaacgagccgaccacgctcagctccaccatcgacaccagaatgtaattgaaccagtagttccagccgctcacgaagccggcgcgcttcgaccagtagcgggtcgcgtagtagctgaacgcaccggccctcgggtcttcgaccgacatctcgcccagcgcccgcacgatcatgaagatagccaacccgcccacaagataggcaagcaggattgacgggcctgccaacgcgatcgactcgctggagccatagaagagtccggtgccgatcgcccctcccagcgcgatcagctggacatgccggttcttcaacgatttgcgcaacgccgccggtgccggcgtgttgccggtgccggggcgggaggccgtcgccgtgctgtcgtgcatggtgttcttgctcatcggttcctctccatcgttgccgcacgccggcgactgctcgcggcattggccgtctgcccgtcgttgacccgctcgcgcccgtcttcgacattgccgtcatcgccggtggggccgggccgtgatgccgtgatcgccgcacccgccacaacgcaggccgatatcggcacgaccgccattctatgccatccgctgacgagtcgacgtcaccgtgcgccgttttgtctcccgcatcggctcatcggggtgcgtcatgccgcggtgggcaccacggtcacggtctgagccttcctcatcgtcgcggcgtcgacttttcgtggctatctgcgtttcaagggggtgatttcgtgttcgccgaacatctatctgagtttcagggggttgccaaaacatgatacccggagtattgagcaccaattgccattggaatcatgcggtcttgagggtgtttatactcggctaccaacccctcgaaacgcagatagatgttccggaagagcgccatcaaccccttgagatgcagatagcccaattttgccgcaacatgtctgcgattgagcgcctagcatcacgtttgcataatcgtgatttactaaatcgcgattatgcaaacgatctgtgccggtgcgaagaatatgtcatgccccgtcgattccttgtgaccagcatctccgattcgtctagtgccgctgcggcactctggccgtatgatttcgggtgggtcgaggccggaatcgtctgcctcaccgggcgccgggcatgcccatggtgaagatgatgtgggcgacggtttctggtggggcggcgaggtcggtggcgagccagtactgcagcagtccgatgctgccggatacggcgaaccgcatgcgcatctgcgcttcggccgggtcgctggaggcgggctgcatctgttcggcgacggaacggcggctgtagatcaggccgagcagctgttgctggaaatccaggtcggcggtagggctcatcagcacctgcagatggttgcggttgtcggcgatatagcggcagatgtgctcgatgacgtgctcgacgccggccgcgtcaggctgcatgagcagctggtcgagcgcggtcgtgacccatgccatcgtttcgtcctcgatgtcgtgtagcagctcctcgatgctgtcgtagtgcgcgtagaacgtggagcggttgacgtccgcctgctcgcacagcgccttgatggtgatgctgccgagcggccgttcgcgcatcaggtcgatgagcgcgtcctgcatcgccttccgcgtgtaacgggtgcggcggctttcggtcagttccttggccatggctggtccttgcctcgtatgatctcgcgccggcggattcctgcccgacattcggcaatccgactgttggttgcgaaaccgacatagtgttgttttacttgagtataacatctgttgcgtgtgcggggaggtgcatgatggcgtatatcgagttcgaccgcgtggtcaaggaatacccgtccgggcgcaccacgatccgcgcactggacgaggccagtttcaccgccgaccgaggcgaactgacggtgatcctcgggcagtcgggcgcgggcaagaccacggcgctgaacatccttggcggcatggacaccgccacctccgggcgcgtggtcgtcggcggccgcgacatcaccggactgcgcaaacgcgacctcatagcctaccggcggatggacatcggattcgtcttccagttctacaatctcgtgccgaatctgaccgcattggagaacgtcgaactcgcgtcgcagatctgccccgaccatttcgacccggccgacaccctgcacaaggtcggcctgggcgaccggctgagcaatttcccggcgcaactgtccggcggcgaacagcagcgcgtgtccattgcgcgcgcaatcgccaagaagccgaagctgctgctgtgcgacgagccgaccggcgcgctcgactatgagaccggcaaggaggtcctgcaactgctgcaggacatctgccgtgacgagaacatgacggtgctcatcatcacccacaactccgcgctcgctccgatggcgcacaaggtcgtccgcttccgctccggcaaggtggtgggcgaggatgtgaatcccgcgccgacaccgatcgccgacatcgaatggtaggtgctgtgatgggacggcatgcgcataggaacaaaggtcggaaggcggacggtgattctgccgggtggtcgcccgcgtccgatgtgcccaccgaggtgattcccggaatctacgacttggcggccgacaccgatacgggcggcaggccgtctcgtgggcgctcgctgtcgggggcgttcgtcaaggatacgatgcgctcgtggctgcacgggtggaaacggtttctgtccatcgccgtgatttcgctgcttggagtggcggtgatgaccggcatctacgccggttgtcgtgacacgttccgcgccgcgaaccggttctacgacgcgcaacggttgcacgatatccaggtgctgtcgacctacggcctgaccgatgatgacgttgcggccctgaagcaggtccgcggagtcgatgtcgtgcagccggaacgcagccagagcgtcgaagccgacgtcaagggcaccgacaaaaccgtcaccatcaacgagatcggcgtgaacggcctcgaccagccgtacctacaggacggccgcattccgagcaaggctggcgaggtcgcggtcaccaaaaagttcctcgccgacagtggcatggcagtcggcgactcgctgaccgtcaccccggttgacaccggcactgcgacatcgaccgtttcggatacggactccgccgatagcggcgcgaacggcacggaaccggcggacgagcaagccgatgcatcgcaatcggcgccgagcttcccgaccgaactgaccatcaccggcacggtgatagaccccaaggacctgagcaatccggacggatacagcggcgccaaggcattccgcaactcgctcgcgtccgactacacgttcttcgcgccgagcgacggcgtgacaggagacatctacaccgctatcagcctgaccgtgagcggctcgaccgacgaggacgcgttcggcgacgactatgacacgctggtccgcgatgtcgccgaccgcatcgaagccacggtgcagaccaagcggcagaacgaacgccggcagactctcgtggacgccgcgcagaagaagctcgaccaggcgaagaccgacgcctaccggcagctcgacgacgcgcagatgcagatcaccgagcagacggaggagctgaaaacccggcgcgagcaggcgaaaaccaccaagcagagcctcgaagaccagctcacacagcttgaagaccaatcggagcagctgcaggacggcaaagaccaggtcaacgtgggactgctccaagcccgccaaggccaatcgcagctgcagcagggcatcgccaccgcgcagacgatgaacgacctggccgtgcagggcgcgcgggccgcagagcaggccgcggacgcggcagaccaggcggtcgccggcgcgcaaggtctgcccgagacggtactcgaaccattgcgcaaggcagcgaaagccgcgcacgacctcgccacacaggcacggtccaaagccgatgaatccgcggcacggctcacgcaactgcaatcccagctgagccaggtcaacgccaccatagcccaacttgaagcgcaatcggccaccttgcagcggcaaaccgagcagctgcgcggcggtcgccagcagatccgcgacggactcaagcagatagccgccggcgaagagcagatggacaccggcgaacggcagctcaaggacgcgcaagaccggcttgacgccaagcgcaaggatgccgacagtcagttcgccaagcagcagcaacgcgtcgacgacatcgccgcagcccgctggtacgtgcagacgcgctcgtcaatcggcggcttcagctcgctcaaatccgacatcagctcaatcgaatcaatcggctacgctttcccggtcgtattcctgattgttgcggtgctgatgagcctgaccgcgatgacccgcatggtcgaggaggaacgcggtctgattggcacctacaccgggctcggttacgggaacgcggccatcgcgatgcgatacgtgctgttcgccgcgctcgcctgcctaatcggcggcggactgggactgatggtcggcttcctcggcattccgtcgttcctgctgctggtgatcgagggactgtacacggtgcccggcatacagctcgaatacgattggctgtacgggtcgacaggcatcgcgctgttcgtcgtcggcgtggtcgtcgcaacggtcgtcgcctgcgccggggctctgcggcaaagcccggcgcaactcatgcagccgaaagcgccgaaggccggcgcgcgcatcttgctcgaacgcatccgcccgctgtggcggcggctcagcttcctcaacaaggtcaccgcgcgcaacatattccgcttcaaaagccgcctgttgatgaccgtcggcggggtggcgggctgcacggcgctgattgtgtgcggcttcgccatcaacgacaccgtcgccacgctcggacccaagcagtacgaggacatctaccattacgacctgctcgtcgtcagcggcgacgacagcgtcgatgcgatgcgcgctcggctcgacaaggacgggcgcgtggaacgttcgctcgatctgcggctcgacagcggcgagatggacgcgggcgacgcaggcgagacgattcagctcatgatcgtgccggatgattcagcaggggcgctcggagacatgattacgctgcggtccgcgagcggtgggcatggcaagctgcagcttgggggcgatggcataatcgtcgcgcaatccgcggcgaactcgctcggcgtcaaggccggcgacaccgtcacgctacgcgacggcagtatgcgtcacggcgaagtgaaggtctccgcggtgacgcgaaacctcatcggctcgaacgtgtatgtcagcgaaagtctgtacaagaaaacattcggcgtgtcggcggcggtgacgcacaacgccgtgatcgccacactgaacggaaccgccgaccagaacatcgcgtacgcggatcggctcgcacgcgatccgtcggtcgtgagcgccaccagcaccgacgatctcgagcgcagcttctcgttcgacctgatgagcgccgtcgtggcgctcatcatcgcgctcgcgggcgggctggcgctcgtcgtgctgttcacgctggcgaacacgaacgtgtctgagcgcgtgcgggaaatggccacgctgaaggtactgggcttctacgaccgcgaggtgcaccggtatgtcaacaaggagatgctgatactggccggcatgggcatcgtcgtcggtctgccgctcgggcgcgcggtcggcgggctgcttacggcggcgctcaacatgcccgcgttgtatttcgaggtgagcgtgcactggtatagctatgtgatcgccgccgcggcgacgatggcgttcgcgctgctcgtgcagctgctcaccaatccggtgctcgaccgcatcgatccggtcagctcgctcaagtccgtggagtgagccgcccgccaccgccctacttgtggtatggctcgccggcgttgattttgtaggcgcggtacagctgctccagtaggatcacgcgcatcagctgatgcgggaacgtcatcttcgagaagctgagcctgtagtcggcgcggcgcaggatcgcgtcgtccaggccgattgagccgccgatgatgagctgtatgtggctttcgccgtgcaatccgagctggttgatgtgcgcggcgagcccttcggaggagagcatcgtgccgtcgatcgccagcgcgatcacataggcgtcggggcggatgtgcttggcgatgcgcccgccttccttggcacgaatctgccgttccacgccttcgctggcatgttcgggggtcttctcgtcggcgacctcgatgatgtcgagcttgcagtagcggccgagccgtttgctgtattcggcgatggcgtcgcgcagatactgctctttgaccctgccgacgcaaatgacgctaatacgcattatcctgctttctatctgcccggaggattacggaagatacgccgtcgtactactccgagagtcacggcacgacgataccgcgactctcagagtccctcggtgggggattggctgacgctccgccagtcaatcccccaccgtcggcattggttgatgtgtgcggatacggccgttcaaagccgaaggcgtatttcgtacgtcgagcgctgaggaaaggccgtatacgctccatcaatcaatgacgccgtagaggcggtcgccggcgtcgccaagccccggcacaatgtacgccttttcgttgagtttttcatcgacggcgcagacgacgaccttgaaggcgatggaggggtcgatgtggtcttggacgtattggatgccttcgggggcggcgatgatgttgatggcggtgacgtctttggcgccgcgctcggcgaggtagtgggtggcggtgacgagggtgccgccggtggcgagcatggggtcgatgaggaagcactgacggccggtgaggtcttcggggagacggttggcgtaagtgatctgctgggtggggtgctcttcgtcgcgcttcatgccgaggaagccgacttcggcggtggggatcattttggtcatgccgtcgagcatgccgagtccggcgcgaaggacgggaacgatgatgggggcggggctggcgatgtgcttgccgaccatgggggcgacgggggtttcgatgggcttgtcgacgatgtcgaggttgcgggtcgcctcgtaggcttcgagcatgacgagttcggtgacgagctcgcggaaagtggcggatgaggtgtttttgtcgcgcaggacggtgagcttgtgttccaccagcgggtggtcgagtacgtgaagttccatgagtaccagcgtacccggttatctcacattctggatggacatagcgtgttgcttatgtgacgtagcggtcaagatgtgcagtgaggtcggactgcaggagccgaaggcggtttcgacggcgacgacatcaccaaggccgcgccgaaccagcgcgtccgcaaaggcatggcgttcgtgccgcaggggcagcagtcgttcggcacgatgaccgtcgacgagaacctgcatgtggtcgccgaccggtacgggtccgaggcgaaaacgcggtacgacgaggccgtgacgatgttcccggtgctcaaggaattcgccgtcgaacgggcggatcgctactatgtgctggcctccgggcgcttcatcgccaccggcgaaggcggtcctgcacaggttgaggccaccaaagaggccatgcgcgtataatcgcgctctcaaaactcgcagatacaaggctcttttcgagcgtcaatcgttatacctgcgagttctgagagcgcctattgcagagccttcatcaaagaagccacatgaccctttgcccggacgttgtaacgggcgatttctatcgtgccggctgcgcctgtaacaggcacgctgatgacgaatgtcgagcggatcacgcctatgtgcgtgcgcccgtagagcttcttttcgccgtacgcgccgtaaagccgatgcacggtcaggtctgcgtccgacagcagcgggaacgacaggtggtcccgctcgcggaaacgctgcagcttgtcgattgggtccttggagacgcccagcacagtgaaaccgagtgcggtgagccgggcaatgttgtcgcggaagtcgcatgcctcggtggtgcagcccggcgtcatcgcggccggatagaagtacagcaccacgcgcttgccctgcgccagcagccgcgacagcgtgacggaggtttcaccgccgtccgggttgaccgcaggcagggtgaaatcaggagcgggctggccgggggtgagtcgcgtgggaagggcgggctggctggattgtccgggctgcggtgattggtcgcttgcgtgattttctgtcatgatgcgtgctcctttacctcgatgcccatgtgtgccaccactatcgccgtcgtggtggacagtcgcgcgaccgcgtatagtcgaatcatgcaatggctgcacaggataggcgaggcgattgattcgctggttgcatggtggcggcgctcgctgatcgggcgggtgattgaccggtatgtgtcgcggcgcgggccgctgctggcgaacgggttggcatatgggctactgttcgcgttcttcgccggcgtatggatcgtggtcagcgcgctcggactggtggtgaccgggagcgaggagatgcagaaggcgctgctcgcgatgctgcgcacggtgattccgagcgtttccgattcgctgttttccgcgtcgatgctgagtggaatctcgcatacgctgacatggaccggtctggtgacgctggcggtgttctggtggacggtcaccggttggatgaattccctgcgcaatgcagtgacgaccatgttcgacgattgcacgcaggagctgaacgtggttaaggcgcgattgcgcgatacggtcgctgcgatcatggtggcggtactgttcatattgtcgaccgcggcgggcgtcgtctctggcggcctgatgagactggtgttgcgggcgcttggcatcgccgatgattcgctgccgggcgcgctgttgctggaatcgaccggtttcgctaccggcgtgttgctgaatttcgcgttgttcatgctgctgctgcgcgtggtcgcgcacatacgcgcgggcaaattcacgctggtgggggcggcgcttggggctctggcggtcgcggtgatgcagctgctgggcgctcgtctgttgacgggtgcgtcgcgcaacccgatgctggcgccgttcgcagctatcatcggcgtgctcatctggttcaacttggtggcgcaggtgattatgatctgcgcggcgttcatcgccgagtgccggcggggggggggcggggagagccggagctagctacatccgctgtcagccgacagggtaactggcaccaagcattgccggatacgatatcgtatgagacggctgcgagcttcatcgcaggtcgcaaggtgcatgtctttcatgagatgtgccgtagagcatatgacgagaggagagttcccatggcgattgatgtatatggtgcaacatggtgcggcgactgccaccgtgccaagaacgcgctcgaccggttcggcgccgcttacacgtggcacgacatcgagcaggaggagggcgcggccgaccgtgccgttgagatcagcggccaaaaacacatcccggtcgtgctctatggcgacgggtcgttccaggtcgagccgtccgtcgtggacatccagaacaagctcaacgagcttggcctgctcgggtgagcggtgagtggctgcggcggtggcgaggtgcggtatcggctgtccgccattgaacacgatgcatcaattcgcgccttatggtcggcgcttttgcaaagtgaggacagcatcgttgcttgatttgaccagattctattcgtaggcagaattcgaattttggtagttgaatggttccgggagtgctgggacagtgaatgattcgacgatctcggggatgcggctgtgggaggcccggaagatccatcgtttcagcttggccccggcttgtccggtgggctggtgcgggagcgtcccgaggagttccttgagttgccatgaccggtagggctggcccctgggatccgtgtcctgccgttcggtgagatcctccgggttcttgggcacggcgtatctgacgccgcgcatcgcctcggtcgccgtcttgtcgttgccgcgccgggcctggttccgcacccgtttcctgacctggtcgggcgcgtcgctcatccgggagacgatgtggaacgagtccgggacgcgcccggcgttcggcaggcgctccttcacgctggcgtcgatccacttggcgccgtcgccggtgactgccttgatggaggcgcgctgctcgtcggtcggctgtcggaagaacaggccgggcacctccttgccgtatccgtcgtgcgcccagacgacccgtctgcgcttgtggtcgacgaccacggtgatgtacgtgtgccccccttcctgcagctggtctcgtccacgcctatcgcggtgggaccgtcgaacatgcacggcatcgaggattccaagcgggcggcgaccctgcgcgcgatatggccggccgtcctccacgcgatgcgtgggaatccgcccacggtcttctggctggcgaccgccgccggccacgcgcactccatctcgaaaccactggtgagccggctgtccggctccgccacggcacttgggcggccaccacgccatgctccgcgcacgccacgcgcggcgccaggcccatgagctcgaccccatagcagccgaagtcctggtggcgccatcgccgttcgccgccacccctcccatataacaggcccgtccgctataaaccgcaagatgaggtccacagcggacgggcctgttcgttcatatggtcggcggtcatggacatgccccatgcctactccggcaacgaggccggaaccggcggtaccgccacgacacggcaactcgaccggtatagggacggtccataacaagttcatacggttcatcgcacattgaacatcagttgaacgacgaatgatatttgatgcgcgcaccatgaacagtgcctgaatcagccatcgtctccgaaaagcggcggatagccttgtaaaggccatgatgcgtaggcgcattgcaacggcacattcgcatcgtcgttgaaataggagagtgctagggagagcctggtcatgcatataggaaagatacgcaatatcatcaaaccagcggtggcgtgcatagcgcttgccgtgttcgccgcgccgggtacggtagtctccgccgcggcgcttgaacgtgaaggtgccccattggatgtggtggccgattggaaattccagcaggcgcattccaccggttccatcgacggtggtgacctggtcatcaaggatatgtcgggcaacggcaacgatctgcacatgcagacctacgggaaaaatgattacaagctcagcgactatgtcaactggtcgtcgaattcgatgaacggtgacggtggtggaagcctgaagctcaacggcgacagcgatctggcgcataagaaggatcatcccgagcagcgagatcccaagggcgcggatttcatcaccgcgagcggcgctcccatcaacaaagagcaatttgccaacggatacaccatggagttcgtgtactaccttcccgatgacttcaacgccggtaccgattcgtggatggggcttgcggccaggcaatccacaaacagcaacatggatgaacacgagatggggtcgatgagcctgtcgatctccaattgcaaggaaacccagttcaaggccgccaacaaggacaatgagtcgaccatgaacaccgatgatcccaacaacggcgtcaccagctggggcgtcaccatggatcacggtggcgtttggtatcacatcgccgtcgtatccgatggcacgaacgtggtgacatacaccaacggtgccaaagcattccgcaatatcaacaagaacggcaatggcctgtatgccgatccgaccgatggtcgcttccgcatcggctcgtcgtattacaacgacactttcgacaccagccaatacaacaaggacgactttgacaagttcctgcgtggcaacctgcaggaggtgagattctcccgcggtgcgctggcacagggcaactggatcgtgcccaacccgaccgagtatctcaaggattacggtaccaacgatcgtttcgtgctggacaaccccagcgtacatacgatggctttcttgccggacacgcagaatgccatccgttgggtgcccacggtgatggaccgagccatcgaccagttcgattcggaagattccagtcttaatctgaccaacatcgtgtccctcggtgacgtggtggataactgggacagtgacgcgcaatggcaggcatcgtccaaggcgttcgggcgtatgcagaaagtgggcgtccccttcctggagcagccgggcaatcatgattacaatggaggcaggcatggctacggagtgcccagcttgcgcaaggcggacaattacctgaaacacttcggacccgactccgatttcggcaagtatcagaaagaacacggttttgcatactcgcccgatggcctgtcctcataccatctggtagacaacggctcctacaagtatctggtgatgaacatcgacatgggcgcggtggtcagcaactcgtcctcggcaagcaatgacgatatgcgatggttcgagcaggtgctcaaagaccacccgaacaacccgactgtggtggtgagccacgatatcttcaagtgctccgattcacgtccgaatgaaatctccctcgatgacgattccggatacaacggtgaagccggtgacgatgaaggtgccggctcgaaaatctggaacatcgtgaaacggtacaaccaggtattcatgatgtactccggtcacaatcacggatccggacaaatgaccctgaccaatgacgccggcaatccggtgctggggctgttgtccgactatcagttcgcgtataacggcggcaatgcgttcttccagtacgtcggcatggatgaagcgaacaacaagatcaccatgcgtacgtattcgccatactcggcatcgctgcccgcggccgagcgttcgttcttcgatgtcaactccctgaccggtgtcggcaacacctatgacggatcgttcgatttcgccaaacgattcgccggttacgaacattcctccggttatgacacgcagcagtcggtgatctccttggtgcgcggcatcggtgcgttgaatggtcagacgccggcgagcgaagtacggcaactatatactgctctggccgcattgccggataatgtgaaagcgcaattcggtgatccgtcggatagtggctctctggcaggcagactcgccgccgcatacaatgccgcgttccccaagccggaacagcccgacaccaagcccggtgccggcaatcagactggaagccaaggtgggcatcagggtggacagtccggaagccaacaagggcagaagggcgatggccatggcaaggggcagacgaatgccggcccggaggcaatggcctccactggtgccgatgtggccccgatcgtcgttatcgcgatgatgacgatcttgttggccggcgtgcttgtgctcgtgaagcgtaagcatcacctttcgcactaaccgattaccggtgtgcaacctgtcgacgagcgagcagccaatagctgggcctgatatagaacccgcggtactggttgctcgctcgtcgaatcaaggaaaaccgaagcacgcttcgcgccaatgccgaagacgccgatggcttgccgtgtcgccacctgcgcattggcgtcatgattgtcgtgatcgtggcctacgtgatgttcggcccgtttcgcggcgacatcgttctggtctttggcgcgtcggcgatcttctacgtttccggtacgttcgcgtttccggtacgttcatcatgatgacggtcatcctttccctgaccggtcccatcgagcacggtcaggaagagcggcaagccatcgaggtcggaaccggcggtgtgtcacctgtcggccaggagcctccatcaactagtatcagctagtatccgatatgaagccgtggcctcattgccaatcgccaagggaggaaaccgtgcgcgcgcgacgtgactttgcatggccgaaactgctgaccgcggacggacgcggcatcgccttcggcggcgactacaatcccgaccaatggccggaggacgtctgggacgacgacatccgcctgatgacccaggccggtgtcaacaccgtggcccttgccatcttcagctgggaccgcctccaacccaccgaagaccattgggattttggctggctcgatcgcatcatcgacaagctcggcaaggctggcatcgcggttgatttggcatccgcgacggcgaccgcacccctgtggctctacgaaaaccatcccgaagtccttccgcgagacaagtacggtcatccggtcaacgccggctcccgccagtcctggagcccgaccagcccggtgttcaaggaatacgcgctaaccctatgccgcaaactcgccgaacgctacggcgccaacccatatgtgacggcatggcatatgggaaacgagtatgggtggaacaatcgcgacgactactccgacaatgcgctcgaagccttccgcgcatggtgccgccgcaagtacggcaccatcgacgcacttaaccaggcgtggggcaccacgttctggggacaggagatgaccggtttcggcgaagtgctcatcccgcggttcatgggtgccgattccatggtcaaccccggccagaagcttgattttgaacggttcggcaatgacatgctgctcgacttctacaaagccgaacgtgacgcgatcgccgaaatctgccccgacagacccttcaccacgaacttcatgatctccaccgaccagtgctgtatggactacgccgcgtgggcggaggaagtggacttcgtatcgaacgaccactacttccacgaaggcgaatcccatctcgacgagctggcctgctccgacgcgctcgtggattcgctggcgctcggcaaaccgtggtacgtcatggaacattccacctcagcggtgcagtggaaaccgctgaacacccgcaaatgtaaaggggagacggtgcgcgactccctggcccacgtggccatgggcgcagacgccatcaacttcttccagtggcgcgcatccgcgttcggcgccgaagcgttccattccgctatggtcccgcacgccggcgaggacacgaaactgttccgtcaggtgtgcgaattgggcgcgacgttgcgggcgctcgccgacgccggtgttcaaggcagcggattggcggcatcggacacggcgatcctcttcagcgccgaatcggagtgggccacccgatccgagacattgccgagcatgaaactcagccattggcatgatgtgcgtgactggtaccgtgcgttcctgaacgctggtgcacgcgccgacatcgtgccgctcgcctacgactggagttcctataagaccatcgtgctgccgaccgtactgatactgagcgacgccgatacgcggcggttggccggtttcgtacaggccggaggccgtgtggtggtcgattacgcgaccggtctgctcgacgagcgcttccacacgtggctcggcgggtatcccggtgcgggcgatgggctgttgcgctcgatgctgggcgttcgtggtgaggaattcaacattctcggtgctggggcggaaggcgagccgaacgagattcggctgacgggcaccagggattcatccacgatggacggtgccgtgacccgcctgtggcagaacgacgtgaccgtcgccggaccgcatgtgcaggtgcttgccacatatgccggcgaagaagcggatgagtgggagcttgatggcacggccgcgctcacccgcaacgcatacggcgcgggggaggcgtatttcctcggctgtgatctgggcgtgagcgacctgacgcgattcgtgagcggctggcttgccgtgcagccgcaatcctcccgtcagccgcaggtcaacagtcagtcgcaatccagccgtcagccgcaagtcgtcggcgcgacccctgatgttctgcacaccgtgcgtcaatccgacgacgccatattcgacttctacctgacacgtggcagatcggatgtcgaactgcgtggcatcgccggggagccgatcgtcctgttccgggcggaacggggcagtgacggcggtgcgtatacggtgcatcgcaatggcgttctcgtggtgaaacgcccgaacccgtcgctgtagtcaattgcggcgaaacaagggaatgggggcgcggatggttttgggaaacggtccgcgcccccctacagagattccggtggcgactggctgtttccggctctatttcaacgtttttggactgccgcttaagtgcctggccgcttaagtcgccgctccttcggcgtgccgcgacgggccgaaacggatagttggtgtagcagggcagcctgaggttgtgtcttgctggtttgggaaaatgatggggaaggaatttggccgatactctggtgcagcgaggagtgggccggggagggggtcctccccggtgttgttatgcggcgttggcgaggaagatgtgcttgtggtgatactcgatgaactcatgcgaaggttggctgattgccggcaatgagatctcatgtccatcgaagtcatagagccatctgtcgttgatgtcggagtgccgcaccttgtcatggttgaccatgatgcggtagtcgtcatcgatggagatgaggccttggtcgaaggcccgatcatggaaggcgttgagcaacagcccattcgatgcggcggttttctcgttgggcgtcgatgccttccaaggtttgatgtgactggcgatcagtagtttgggaatctgcatgccggttatgcagcatgtgccgtggtagttctgcaatagtgaattgcggaaataggattggttgacccgttgaagtatggttgccggtcgctcctctccggtgggcgcgtgttcggcgatgaacagggctgttgctgtttcgagcggcgaacaatggatggtacgccagaaagtgtgcccatgtatccgtatgagattgccacccgtctttcggatctgggcagacttgactattccgctcagccggtgatggagtccacccgggatgatctcgatccattggagcgtgaccgcctgcgcaaaatcatcgcttcctatcaatccagtgaccggaatcttttggagctttcggatgcggacttggagaaatcgctgcgccttgttgtgtcggtcaatggtgagctgacgccgactttggcagggttgctgcttatcggcaacgaagaagcgctgcagaggcttgtgccgacgaatgaggcggcttttcaggttcttgtgggtaccgacatcaaggtgaatcagacctaccgtggcccgttgctcaaaaccatagaacagatagccgagtcgttcaagccctggaatccaggcacggagctgaccgtgggtctgttttcttcggtggttcccgaatttgacgaaagggctttccgagaggctttggtcaacgcattcggccacagggactattcgcttcttggtcgtgtgcgggtattggtggatgatgccggcttaaccattgctaatcccggtggattcgtggaaggtatcaacgtccataacttgcttactgcggagccgcgtggccgcaatccatgcctgatggatgcgttgaagagaaccggtctcgccgaacgtacggggcgcggcatcgaccgtatattcgagggtgctttgaactatggccgtcctctgcctgattattcgaggtccaacaggcgtggagtgtcggtgctgttgcctcgtagtgtgcccgacaaggcgtttgtggaactgctggccgaggaacgtgagcgcagcggcaagtccatgtctctcgatggtctgcttattttggacaagctcaagagtgaacgtcgttgtggctttgatgtgttgtcgggctctctggacatgagtgaccagcgtctgcgcaccgtactggggcagctgacggaggcggggcttgttgaaagcgctggcgttggagctcgccgcacgtatatgttgggtgcgaaagtgtatcggcgcagcggtagggcgatggaatacgttcgccaatcagacatcgatagggtgcggtatcccgaactgatcatcgagttaatgcatgaacagaaatcagtgagcaaaaacgatgtgatggaattgctgcatcttgaggagaatcaggcgtactaccaattgcgaaaactagtccttgaaggacgcgctaagaaggtcggcagtggacgcaacgtgcggtatgcggcagtacgttgaatgagatacgcagatcattcttgaacggttttctctgaattccgagatttatctctgaattcagagaaagaatatcggaattcagagaaaactagtgtgcgatgtggctattccgcttcaggaattatgtacgattcgaacgtggcctgtatctgcgatgccgtcagccgctttatcggtatgctccctatgcggggcttgatgtggttcccgtagctgttcccatagcgcgtccttgtgctgtcggcgatgttccagatagttcacgtcatgctcccttgcgtgatgattcacatgattcgcgtcttcatggtagcgtctcccgccggcgcatgagtgactggtcacgctgtcagtggaatctccccgacggatatcccgcctatgcgggatatccacgccggcgtacggagattcgcatgttcgggcgtacgatggacccggtttttgcaggatgcggccaacgccttggatgggcatgggcctgcaaccatcgtgagccgccacgggcgttcggcgatcgccgggcggcggatcgagaaggatcgggcgatcggggccgcccaccatccgaaaccatcgtcggcgtcgcttcagcggggcatgccgacggttcgcgttttccggcaaagggtcggccggcgctttcctcattgaagttcgacgggtcatggtcccgccgtgagggttggaccggtaatcgggtgatgccgaacgtcccgacgggacggcggccgtgtcatcaaagcgaccgcacgaactctccgcccggaagcggacggcgctgattttggatgacccatcggccgtggcattcccgggcccggaacatgccatggggtttgcggaccccgggcgacgccgcatggccttcccgttcccgcgccacgggcggcggcatggttcatggcgccgacggtgggtccgtccgcacgcggagcgcttccatgcctcgctgacggatggtggcgatccccccccccgcggagaggagtattgtttcatttgtagataacattgttacacagtaggagaacattgatatgcaatctgaacgttcgttgattcccacccccatgccggtccggagacacgcacggtccgggaacagggggctggccctcaccgccctgtgtctggcggtgctgctggtcgtgatggacaacaccatcgtcaacgtcgcgattcccacgatgagcgacgcgttgaacgcctcgtccacggacctgcagtgggtggtggacgcctacacgctgtccttcgcggcgctgctcctgcccgccggcaaactcagcgaccgatggggaagaagacggatgctgctcgtcggattggcgggattcgccgtggtctccgcagctacggccttctcctgggccctgtggcagctggtgacgctgcgcgtggtgttgggggtctgcgccgcgctgatctatccggcgacgctgtcgtcaatcatcgtcatcttcgaaggctccaggtaccgtagcctggccgttggcctgtgggcggcgacatcaggggtcggcatcgccctgggcccgatcatcggcggcgtcctgctggagcactatgcgtggaattccattttctgggtgtgctccgtcatcggcgtggtggcgctggcctgcatcgcggtggcggtgcccgaggtacgggcgtaccgttccgagaggttcgatttccccggcaccgtgttatcggtggccggcgtgggcctgctggtgtgggcgatcatcgaacgcccgacttacggctggctctcctggcaggtcataggcggcatctgcgcggccctgatcatacttgcggtgttcgcggcggtcgaggggcatacgcacgccccgctcatcgatgtcggcctgttccgaagggccacgttcacgagcagcacctgcgcgatctgcgtcgcgttcttctgcctgttcggcttcatcttcatcaccacccaatggttccaggcattgcgtggatacaccgcattgcagacggcggtcgcgacgctgcccttcgcggtggtcatggcggcggtcgccccgttcgccacgcaattggcgaaacgtttcggataccggtcggtcgtctcgacgggactgctgttcctgtcggcgagcatgttcgtggtcacgcgtgtcgacgcccattgcagctactggttcgtggtcgtacccaccatggccctgatggcggccggcatcgccctgatccaagggcccgccacggacgccctgatgagcaccgttccggaaagctcgaccggcgccgcatcggctgtcaacgacacgatccgtgagatcggcggcacgctgggcgtcgccgtcatggggtccgcgatctcctccgtctaccccgacgagctctcggactcgttgtccggactgcagatcccgtcttccatcgcgaaagccgcggaggattcggtgatggccgcgaaatcgatccttccgcacctgccggcaggcatccgacagaccgtggagcagtccgtctcgaccagtttcatgagcgccacgcatgcggcatgctggatcgcctgcgccctcgcattggcgtttgcgctgctctgctggatcacacttcccaaacacgattcaggcaatctcccccaatagaaaggaacatccatcatgaaagacgacggacggatcccacggatcaaggacacggatatgacggaccgtctcctgacggccggcgcgatagcggaggacacacgcaaccccatcggtgacatcgcggcatgcttccccggtcacggcagccagagcgtcggcatgttccacggctgcctgtccggcttccccgaagcccggcaggtggattggcaacggtgtgttggacggtttcttaggggacgagtccttgttgtgtgaattcgttggggctccggtatccgagggtggagtggagtctttggttgtcggaccaccacacatagtcgtcggggtcggagcgtagttgttccaggctggtgtagtggttccggtatatgggctccttcttcaggagcctgtcggtggattcgaccacggcgttgccgaacccgccgccccggtccgtgcggaacacctccacctcggtcagggggaagccgagcgtggcgaacgcggccatgaccaggccggcggcgcggcccgtgtcggcgccgtggccggcgatgccgaggcgcgaaggctcacgctggtcttcacccagccccccgcgtcgttcggtttcacggccctccggtttttcggtatctcggtatccaccgattccggtcttccggtatccgccggttccgtccggtcgctgtcgagcagcgcggtcaggtcgcgcgggcggggcgtcaggttcatgttcctcacaggtcctcctcctcgtccttgagctgtcgcatggtctgcttgagttcggcggccaggtcgcggtactcgtgcaggcgggacccgcgggggcgggtggatttcgcgttgaggatgtcctgccgtttcgggatcagcgtctcgaagcacgcgatgcccgcgtcgtcgatccatgccagggcgtcgcgcagggcggtcgtgttggcctcggtgcggcacaggaggatcgcggcggggacgccgcgccggtcgcacaggtccttcaccccggcggcctgatcgaggtcgatgcggctggggctcgacgggatgaccacgaggtcggcgttgttcaccgattcgtccaacgcgcgcccgtacggggcggagtcgatcagcacccagtcgacggggtcgtcgagacggccgttgatcccgtgcaggtgcgcgatgtcggccggcgcggcggacatcacgtcgaacggcagcgggtcgtccagctcggcggccctgtaccaccagtccttcgcgtcgccctgcacgtccgcgtcggcgacgagcgcgcgctgctcgccccgggactggtccacgagggcgcaggccaggaacacggcgctggtggtcttcatgctgccgcccttgcccgtcgccaacgcgatcaccatcggctcgcggttcttcttgtcgttcatcggtttctccttatctcggtatgtcggtatccggtttttcggcatttcggttagttggtttttcggtattgcggtttgtgccgcgtcccacgcggatcgcgacgggaagcggtcagaagaggctgccctggaccaggcccttcggcacgggttcggtcgggaggaacagcggatcgtcgtgcgtgtattcgcggcgcgagcgttggcggcgtttggtccgtcgccagtagtcgcggccatcacggcgcatgcgttcggcccagtccggatgttcggccagccagtcacggacccgactctgtgggatccggtgcaggccgccgtcggcgatgtggaggtcacgggcgatcagtcgggcgagggtccagcggctcgcatagtcgagcccgccgtacacggccttgtccttccagccgttgacgagagcgcggctgatgcagtcgaggcgcatggggcacgcggcacacagcacgcggcccttgccgcgcatccgttcgtcgatcaggtcccggccatcgtcgtcggtcgtcgtgttccacatgcgatccgccatggccgggtcgaccgcggcgattctcgcgcaggccggcatcatgtcccgcccgttcatggccgccgtccttgcgtcgtcggcgtcttgtgggcctggaggcgtcctatggcggtttcgccgggattgcgggcggcccatgcccgggcgtattggatcagcaggccgacggccttgggatggccgaggcgcttgttgcgccagtagacggcgtgcagctgccagatcaggtccgcgtgcccgtcgagctgcgggttggcgaggaggaattcgctgaagcccgcctcggaacagtcgatgcgcgtggtcatgccgtcgcctcccctccggccgtcgcgtcctggccgtccaactcggccagcgtctccacggcccagtcgggcagccatggcgcagcatccggttcctgcgcggccgccggaaccgtctgcgcgtgtgcgtcgccgtctgtgcggccggcggcgaggatcatgtcgtcgttgagttcgtcccagtgtctggcgagggcccggccggtgcggatgcgtttgggccaccaatcgccgttcatggcgaagctgatcgcgtcgaccatcacgagggtgggccattgcgctccctggtcgacgagcctgcggtacaggccgatgatggccctgcggtcggctttggtcggtgagggcgtggccaggccgagcatcgagcgctgctcgccgagcgaggcgaggacccgtccggccgcttcggcgatctcggtgtcgtcctcgtcgagttgttctttttcggcggcggtcgccccgcttgcggggagatgccccgtaggggcagaggggaaggagggtttactaggagggtttacctggagggttttatccttatatatacagctctgcgagatttgcagtgctgggggtgcagctctcgcagtgctggccctgcgggatttgcagtgccggttccggccctttttccagccctgcgagatttgcagtgctgggaatcggcttggttccaacgttttccggcagcacgtcctcggattcgccgttctcgaacacggttccggcctccgggtccacggtcttgcccatggtcgcgggatcccgttccgcggtgtgcgtctccccgatccacttgagggtcgacgggtcggtctccaccgcgaggtcccacacgatctggcagtactggggcaggcggttccgtccgcctttgccgaggcgcgcgtaccgttggtcgccgcggcggatgaatccgcgctcctggagagtcttcaacgcggtgcgcacggtccgttccgagagttcggtgacgttgacgatggtcgcgatctttggataggctgtggtgccgtcgtcgtccgcgcggtccgcgaggtagacgagcacggccttcgccgaggcgttgcccacgtggcatttgaaggcccatgacagtgcgatgttgctcacggtcgcccctcctcacgttgttgggcggcgcgtcgctcgtcggccaatctggcgtgcatctcgtcgccgagacgtgccgtccggcacagggccagcgtcatcagccatgagaacgcgacgaacacgatcaatgcgattgcgagccagttcacgcgagtctcccttccatggacgggtgcgccatcatcgacgccaggcgacgggaatcgacggagcccggaccgttgtggcgggcgaatgccaccacgaccgggaacgtccaaaccgacgcgtgaaaatcccggttacactcgggaaacacagagcaagacatgcggaaggctttagtaaggtcgttcatgtgtgatcactactccaagacaatgcattgggcggccacggaccgggatccggcaagatacgggatccgcggccgctcggaatattggttgcaccgcccgtccccgacgttccagcatcgggaacgggcgttttttcttttagctgcagagaaagagagaaaaacgaatgggatcagaccatcgcaccacctccctcgccgtcgacgggccacgcgccgccgcaacggatggcgaggcaaaggcaatcaagagcctgctcatcagggacatcaaagacttcgatcaaagcgtcccagcagtcgtcagacacgacgatggaacgatcaggcctacgtacataggcgtatggggacaggaccgtctgataggcgcggccctcatccagccagccctttgcgtagccgagacgctcatataccgcaccgggacgagcggggtccatgccgcacagatacgagaggctttcgccgagcatgcagccatcatcgaagggatctcgatcgtcaggaagcatcggcgcgaaggcttcggatcgcagatcaaggcgttctgcgactcctgggcggcagaccacggcgctgaactgatactcagcatccccaccaacgagggcgcgcgcctgctcaacgagaaagccggatacacggtcgtaccgcccgacggatatctcaccatcaaggtatttgacgctcagggacagcctcttcacattccctacgccgaccagcggacccaggacagaggcactagcatgtgggcgtacaagctcgtagggcaacgcacacagcacttcaagattggcgttctcaccgcctcctgaagttccgaagaccataccgtcgatgaatgttcccgacgggtcgcgggagaaaacaagtcttccggcttcgtcgctcatgccaccggcaccggaatccatggccagtacccctacaccgtcaatcgccatcagaccaacacctcctttatcgattcagagaaagagaaaaccaaatgaaatcaacccctcgcaccacctccctcaacgaacctgatattcgtccggcgcgaaaccacgccgaggcagaggaaatcggaagtctcctgctcgaagaaatcgcgcatccaggattcattcctggaccagagttcgtctggcagggtcaaggctttctcaggccgacgctcataggcgcatggtcccagaaccgcttggtaggtggtgcctcgctcagtccatacatggaacacaccaaggcctttttggggattggtcgagcagacgcagcgaaggcggtcgcacggctgatagctgaaactgacggcattgccgtcagacccgaccatcggtgcgaaggcgtcggacgaaagatcaagctgttctgcgactccttcgcggcacagcaccacgctgcgatcatggtctccgtcaccaccaacgaagcagcggcaggcctcaaccacgaagcgggccacatcgtctttgaacggtgcgacggcctcgtcatcaaatacgtagacacggtcggcgagccactcatatggcttcatgacctggatgggacgatccccgaagcggcatggtccgtctccgtactcggcaaaacgtatggaccgaccataatcgtcggtgagcaacgggccatacggcgtggaaacgctgacaaggacatccagtgggttttcgccgttgacgcggcgggccacactgtcgcatgacacttcgttgctcatgacgccctcccctcggtcaacagcaggcccgccaccacacgttcgcgggcggacagctgggcgtagacctcccggtcggcgtgcgtgttggagcgcacggggcggatccgccaatcggcaagcgtccggatctcaccccgctgcagcgcgcgcagcgcgcattccgggcaaaggttcagagtccggggatcgagctggtcgatgtagtcatgccagccgttcctggcgaggaaagcgtcgaagccgtccgatgtctcctcgttccagcgggtcgaccagatcgcggtgtggcatccgtcgcacacctcgacataatcgctccggttatccggccaatcaagctgttcgtaaattccaccagccatcatcgaacctcctgcgcgccattgggaaatgcggtttcatacggaatgagatcttgaacgaaatcagacgacagaccatactgctcgcgaagttcggcacagtctctgcgctgccaatgcgtgtgcgaattgactttctgagtcacgctggctggcgactgatgaagctggacggcaagctgacgatgggtcaaacccacctcagccatccacctcttcatgttcgacatcgttaacctcatttcagctaagttaaaatttctaacctcagtatatgggttggtttttttaacctcaagttagcttaacttacggcgtgtcgaaattaaaaaaaccgcatctcaacaatgcggtttcagcactagcggagaggaaactttcaaatcaaagatggaattgagttaccatgacggcccattcctgcaaaggtcttttcacagaagcaatcagactgggtctttgtccatccagaatatcctcatctatacagaagtttccgaataacgcatcacaatatgcgcaaccatttgacatataacgccccgccctacgcgaagaccgatatttaatttgcctcgcggcgggatgcccagcaatttccaaaagttccctggcatagcacatatctatgctttcccaagactccaccaaggaaataccactttcgcagtcgaggggacaaagattagtaattgccacagaggtccgaccacatctccaacaggatcgatcaatgccatatatccctatatcgacaatctcccccaagcgatgcaacgttttttgggcagcaggaagaaaagcattcggcggcatgagttcatccatgtggatattttttcgccccacaaatgcaaacacgccaaataggttagcaatattaaacattgtttgatataattatcttcatttggaaaggattaacccatggaagtcacagaaacttcagagcaggtgaaaatagaggcgcaacgttttgaagacgtggcacgttacaacattcgccgctatatgcgattgaccggcaagattcagaaagacttggcccacgccttaggagtctcgcggcctaccatcaccttgatgcttaaaggggaaacgaaaattaatttgaggcaagtgttccttattgccaaagctcttggcgtgacagtcgaagatcttatcgatgatacttattattgccaagatgaagagttcatgaaaaagctgaaaccgacgactgatgccgagaagccgggtgctttggtaggtgccggcgcgcctaggtaccttgtcagccccttcaaccccgacgccccttttgaaaacggaatctcaggtgcagccaaaggtgccatggccggcgtgatccgatccggagccaccggtggcccgggatccacacctgagtccgtcgcgtcttcgaagcatgacggcagaacggctctcccccggtctcaagcccatgagacacttggaaccatgactaccatcatcatgcgcacctccgaaggtgacatcaccatcaacctgttcgacgatcagacgcccgtgaccgtgaagaacttcctcggtctggcgaccggcgagaaggaatggacggacccgttcaccggccagccgtcccatgagccgttctacaacggcctgaccttccaccgcatcatcaaggacttcatgatccagggcggctgcccgctgggcaatggcaccggcggccctggctacgacttcgacgacgagatcgtccccgaactcacgttcgaccggccgtatctgctggccatggcgaacgccggcctgcgtcgcggccgcgacggcaaggcgcatggcaccaacggctcccagttcttcatcaccaccgtgccgaccccgtggctcgacggacaccacacgatcttcggcgaggtcgccgacgacgaatccaaggccgtggtcgacaagcttgaggccgtgccgaccgaccgttccgacgcgccgctcgaacctgccggcatcatgtccatcgaagtggtgaagtaagcgcggcggcaattcgaagccgacgctccgatacacatggaagagccctgaaccctcgtcgggttagggctcttcgtatacgtgccgggtctgttaccaccctccggcgctgcgcgccacctcccgccagcgggaggggagggagctataggacgttgaagtgcttgagcgcgttcatgatgccgtcgtggtcgacgtcatcggtgatgtagtcggccgcggccttcgccggttcggtcgcattgcccatcgccacgccgatgccggcgaaggcgagcatgtcggcgtcgttgccgccgtctccgaacgcgatggtctgctcgcgcgtccagccgtaatgccgcatgaaccgcttcattccctcgggtttgccgccgtcggcgggaatcaggtcggtgaagtccggatgccagcgcacgcctctgacattgcgacacatgccggacagcttcgcttcatcttcaaagctgatgtacgggctgatctggaacgtctcatacttcagcgccctctcgtgcggatcgtcgatgttcacggtcggtgcggtcttgccgagttggcgccacgtggcccgcatcgcgtcggtgatctggttgaagtagacgtaatccttttcgcagtagttcgccaccacgtcggggtgctcgtcaagccagcgggtgatggtgacgatgtcctcgggcagcagcgactccttctccaggagcccgtggtcgtcgaagcagtactgcccgttcagcgcgatgatgccgtcgaagtgcaccggcatcatgttgagcacgacggtcatgtgcgacggcgcccgaccggagcagatgaacaccttcaccccgcgatcctgcagctcgtgcagcgcgtcgatggaggactgcgggatcacatgcgtcacgaaactcgtcagcgtgccgtcgatgtcgaagaacgccgccttgatgtcggctcgcacggtggccgtcgcgcctccggcgcccgctgtcatgatgtcgtccgatgccatgtacgcaacctccgcgatacgaaattcggtcatccccagtgtatgaacagcgctggatggcattccgtaacgcgttatcagccccgccccgcgactgccgccgtcgctgccgtatggtgggcgttgtcaaccaatcagagtgggaacgaacatgacagcagcaacatagcaggcgggctctcccgacaatgagccggtgcgcgtcaaccataccgtgcgcaacatcgtcatcgccctcatcgtggtcgccgtgatgagcgccggccgggtcgtggagcgcggagatgtgtgcaacgtgttcgcggcaccccagcaggcggtgaccaagcggttcatcgacacggtatccggttcggccatcggctcgatcacctacgagttctcgggcgacgatgcgctggtgcgcgactttctcgggggagctgtcacgttccagcgatgtcatcgacttcggcacggcggcggacaccataggctacgaggacgccatcgccgcagccgtccgcggcagacaaggaggagacgcgatgagtccctggtcccatgcatacgacatcgccggccaccagaccgactggacggttatcagaaattcgaccagacggtgacctggacggccgtgatcatcatgatcgtgctggtccagatcgtgcagggcatcgcgaacgccatcgccaagcgtatattgaagcgacagaggtaacatggcatgacatctcgcggggaaggaacgtaaatcatggtcgaacatgtcggggtcacggacgagctgatcggcatacggcattatctgcatcagcatcccgaacgcagcttcaaggaggtcgagaccagcgcgtatctggcccgtctgctgcgcgggcatggcatagacgtgctcgacacgacgttggagaccggcgtcgtcgcgctcatcgagggagaggtgccgggaccgcgcatcgcgctgcgcgccgacatcgacggcctgccgatcaccgaggacaccggcctgccgttcagctcgctgaaccccggcgtgatgcacggctgcggccatgacctgcacatgaccgggcttttgggcgcggcgttctggctggccgatcaccgcgaccgcatcgcaggcagcgtgaagatcgtcttccagccggccgaggaggtgggcctgggcgcccgcacggtcgtggaatccggcgcgacggatgacgtgaaggccatcatcggcacgcataacaacccgaactacgcccccggacagatcgccatcggcccgcagccgatgatggccggctgcgtgaagttcaaggtcacgctgcacgcccagggcacccatgccgggtacccgcagaagggcaccggccccatcgaggcgctcgcctcgatgatcctcgccctgcagaccatcgtgagccgcaacatctcgccgttccacgccgtggtgctgtccatcaccgaagtgcatggtgggcacgtgtggaacgtcgtgcccgccgaagcgggattccaaggcaccgtgcgcttcttcgaccaggacgacgaacggctggtccaccggcgtttcgtggcggaggtcgagcacacggccgaagcgtacgggatcgcggccgacgtggactgggactgcatccaggtgccgctggtcggcgacgaggagctgtccgaggcggtcgcggccgacgtgccctcctatggggcgctcaagccgatacatcccagcatggcgggggaggatttcgtggagttctcgggatgcggggcccgcctggtgttcgcgttcatcggctcgaacggggaaccagggtgcgccgactggcacagtccgcacttcgtcggcgtggacggcgcgatcgggcccgccgttgacttctacgtcaacgcctcgctgcgggtgctcgccgagcttcgctgacgggcggtgggacggatcatcccgcgtgacggcatgtgccgcccctgtcgtccgtcatctcggctgggtactatagggcactatgacccatcttcgttttgcccttgcccagatcgacacctgcgtcggcgacctcgacggcaacgccgacaaaatcatgcactacgcgcatctcgccgcgcatgaaggcgcccgcgtcgtcgtcttcccggaaatgacgctgaccggataccccatcgaggatctggcgttgcgccgcacgttccgcaaggcggcgtgggacaaggcgaactggctggcgaccgagctggaggccgacggattgggcgacctgtatgtcgccgtcggcacggtcggcaccgaccacgcgtccgacaaacctcgcaaccgcatggtcgtgctgcacgacggcatggtctgggccggctacgacaagcatttcctgccgaactacggcgtgttcgacgagttccgcatcttcgcggccggcgaccgcaccgtcgtgctcgacatcgacggcgtgcgcatcggcgtggcgatctgcgaggacatctggcaggacggcgggccggtcgcccggctcgccgacgagcatatcgacgtgctgatgacgatgaacggctcgccgtacgaggagggcaagacccatacgcgttacgacctcgcggtcaggcgtgcggccgaggtcggcgccccgatgatctacgtgaaccaggtcggcggtcaggatgacctggtgttcgacggcggcagcttcgttgtcgaccgcgacggcacgctgctggaacgttccccgatgttcatggagcatctgggactcttcgatctcgacacggacgccgagcatcagacgacgggcgacatcgcggaccttcccgacccggacgaggaggtgtacaccgcctgcgtgctgggcctgaaggactacatggcgaagaaccggttctccggcgtgtgcctgggcctgtccggcggcatcgactccgcgctggtggcggcgatggccgccgacgcctgcggcggacacaacgtgcatggcatctcgatgccgagcatgtattcctccatcggttccaaggacgacgccgccgacctggcggccaacatcggcgcacattacgacgtgcagccgatcgagcccatgttcaatgtgtaccagggccagctcaagctcgaaggcgtggccgcggagaacctgcaggcccgcatccgcggcgtcatcgtcatggcgtactccaacagcctcggtctgctcgccgtcgccacgggcaacaagtccgagctggcgtgcggctattcgaccatctacggcgacgccgtcggcggatacgcgccgatcaaggacctgctcaagacccgtgtctgggaactgtcccgctggcgcaaccgggccgctgccgcaggcgtcggcatcggcgggctgcgcatcgtcggcaatgagaacggcgatgccggaacgccgctgcccggcggcgtgatgattccggtcagcagcatcgagaaggcgccgagcgccgagctgcgcccggggcagaaggattccgattcgctgcccgaatatgaactgctcgacaaggtgctcgccgcatacatcgagcatgcgcacggtcgcgccgacctgctggccgacggcttcgacgagaagaccgtcgacacggtgatgcgactggtggaccgcgcggagtggaagcgccgccagtatccgctcgggccgaaggtcaccgcgctcgcgttcggccgcgaccggcgtctgcccgtcaccaacgcgttccgtgagtaggggagcgctcgcccggccgccgcataggcgcggtgccgggcgccgcggcgcgctaccatgggtgcggggaggacgccatgaccgacaagcagtggtatttcaacacgaagaacgagcagcccgagttgggcatgctctcgccgagctcccaccgcatggggccgtacaagacccgcgaggatgcccttgaggcgtggaagatcgtcaaggagcgcaatgcgctgtgggcggaagccaatcgcaagtggcgcaaatggggcgagaacacgccctcgggtggccgcgacgacggcttcgacgactgacgacacggcgtgaatgtgagataagtcacgccatctctcagccagctcacatcgaccggctagtagaatcatttcttgacaacaacgtgaagatgcgttgcacgacacaaggagtgaatatgacagcagttgatgcgaccgctcttactgccgaagagcttcaggccaaggcctgggacggcttcgtcgaaggcgactggcagaaggacatcgacgttcgcgacttcatccagaagaattacaccccgtacaccggtgacgagtccttcctggccgacgcgaccgacaagaccaagcacctgtggaagtacctcgacgacaactacttggcggtcgagcgaaagcagcgcgtctacgatgtcgacacccacatcccggccggcatcgacgccttcccggccggttacatcgagtcccccgaggtcgacaacgtcgttgtcggcctgcagaccgatgtcccctgcaagcgtgcgatgatgccgaacggcggctggcgcatggtcgagcaggccatcaaggaggccggcaaggagccggacccggagatcaagaagatcttcaccaagtaccgcaagacccacaacgacggcgtcttcggcgtctacaccaaggacatcaagatcgcccgccacaacaagatcctcaccggtctgccggacgcctacggccgcggccgcatcatcggcgactaccgccgcgtggccctgtacggcgtcgccgcgctgatcaagttcaagcagcgcgacaaggattccgtgccgtaccgcaacgacttcaccgagccggagatcgagcactggatccgcttccgcgaggagcacgacgagcagatcaaggccctcaagcagctcatcaacctcggcaacgagtacggtctggacctgacccgcccggcgcagaccgcgcaggaggccgtgcagtggacctacatgggctacctcgcctccgtcaagagccaggacggcgccgccatgtccttcggccgcaactctgcgttcttcgactgctacttcgagcgtgacctgcagtccggcaagatcaccgagaccgacgcccaggagatcatcgacaacatcgtcatgaagctgcgcatcgtgcgcttcctgcgcaccaaggactacgacgcgatcttctccggcgacccgtactgggcgacatggtccgacgccggcttcggcgacgacggccgtccgatggtgaccaagacctccttccgcctgctcaacacgctgacgctggagcacctcggacccggccccgagccgaacatcacaatcttctgggacccgaagctgccggaaggctacaagcgcttctgcgccaagatctcgatcgacacctcggccatccagtacgagtccgacaaggagatccgcaaccactggggcgacgacgcggccatcgcctgctgcgtgtccccgatgcgcgtcggcaagcagatgcagttcttcgcggcccgcgtgaactccgccaaggccctgctgtacgcgatcaacggcggccgtgacgagatgactggcatgcaggtcatcgacaagggcatcatcgagcccatcgctcccgaggccgacggcacgctcgactacgagaaggtcaagaacaactacgagaaggccctgaactggctgtctgaagtgtatgtcaaggctctgaacatcatccactacatgcacgataagtacgcctacgagtccatcgagatggcgctgcacgacaaggaggtgtaccgcaccctcggttgcggcatgtccggcctgtccatcgccgccgactccctgtccgccgtcaagtatgccaaggtctacccgatctacaacaaggacgcgaagaaccttgaaggccacgagtacgagtacgtcgagggcgccgatgacgacctgatcgtcggttaccgcaccgaaggcgacttcccgatctacggcaacgacgacgaccgcgccgacgacatcgccaagtgggtcgtctccaccgtcatgggtcaggtcaagcgcctgcctgtgtaccgcggcgccgtcccgacgcagtccatcctgaccatcacctccaacgtggagtacggcaagaacaccggttccttcccgtcccgccacaagaagggcacgccgtacgcgccgggcgccaacccggagaacggcatggactcgcacggcatgctgccgtcgatgttctcggtcggcaagatcgactacaacgacgcgctggacggcatctcgctgaccaacacgatcacccccgacggcctgggccgcgacgaggatgagcgcatcggcaacctggtcggcatcctggacgccggcaacggccacggcctgtaccacgcgaacatcaacgtcctgcgcaaggagcagcttgaggacgccgtcgagcacccggagaagtacccgcacctgaccgtgcgcgtctccggctacgcggtgaacttcgtcaagctcaccaaggagcagcagctcgacgtgatctcccgtaccttccaccagggttcggtcaccgactgacagacggtgacgaccatatgagaagggggcgaggccgaccggcttcgtccccttctcatatggtcgggcaggacggcgcgcttgggaatccgcgtgacgatcctcacacgacatgaagtccatagcgggcggacgccgcgcaaaacgtttgtagtatgaaatacaggaagtactttcaaggaggacgatgatgtctgatatcgcgcaattccgcaccacacggccgcatatgctcaaagcgtcgaaggaatacgcctcgcagaccctgatgggagggctttccggcttcgaatcgcccatcggcctcgataggcgcgaccgcatccacgcgctcaaaagcggcgacatcggcttcgtccactcgtgggacatcaacacgtcggtcgatggcccgggcacgcgcatgaccgtcttcatgtccggatgccccctgcgctgccagtactgccagaaccccgacacgtggaagatgcgcgacgggcagcccgtatacctcgacgccatgatcaagaaggttgaccggtacaaggacctgttcaaggccacgcatggcggcatcacgttctccggcggcgagtcgatgatgcagccggcgttcgtctcgcgcgtgttccacgcggccaaggagatgggcgtgcacacctgcctcgacacgtccggcttcctcaacaccaactacaccgacgagatgatcgacgacatcgacctgtgcctgctcgacgtcaagtcgggcgacgaggagacctaccacaaggtcaccggggggctgctgcagcccaccatcgacttcggacggcggctggcgaaggccggcaagaagatctgggtgcggttcgtgctcgtgccggggctgaccgactcggaggagaacatcgagaacgtggccaggatctgcgagagcttcgacggggccgtcgaacacatcgacgtgctgggattccaccagctcgggcgcccgaagtggcatgagctgcgcatcccgtaccctcttgagcatcagaagggcccgtccgccgcgttgaagaagcgtgtgacggagcaattccagtcgcacggattcgtcgtgtactgatagggaatcgttctctgcggtgtcggactcgaaaacctacacaatcttgcgtgtggaaataccgtaaaatcttcgacgacaccgtagcctgtatatatggctgaaatcttcgcgtttccgaggggctccgcaacgatgcggcacccggacgccgacatgcctgaacgcccggtcggcgtgccggacgcggtctggtcggcggtggaatcggtgcgttccatgccacgggtgacgggcatgcgctaccgtgagcttcccgtgccctcgacgctggccgactacggcatcggcgtggaaatggaatgcgtcgcggatgacgactcccgttcgttcggcgacgcccacatggcctcgggctggatcatgctgctgtacgtcgagcgtgaacgcgaggactggcactcccactggcgttgcgtcgcctacgcgcagctgccgttgccgtccgacgagaacgatggcctcgccccgagcatgtactgggacgggatgcgctcgttcgtggatgacgcctccttaggtgacgtgtcgggtacggtcaccgtcacgcagaacacgtcgttcggactcgctcaggaaggaaccgccggctgcgagatgcgtgtctcatggacaccccttgctagcatggatggcggtttggacgcgggcggccaggtgcagtgctgggcgcgattcgtgcagtccgccagcgaatgcgaggaggagccgtcagttgaccgatgagccgaggctgcagacgcagccgcgaggtggtgttccggatgtgaccgacacacttgaaggatttcgggaggtatgcgaccgtctggccggggcggccgggccgttggccgccgacgcggaacgcgcctccggattccggtacggccatgaggactggctggtgcagttcaagcgcgaaggcgccggcatagtgctgctcgaccccgtcgccctgacccgcgccggtgccgactggggcatgttcaacgacgcggtcggcgatgccgtgtggatattacacgactcgttgcaggacctgcccggattcgccgacatcggcctgacgccgcaggccctgttcgacaccgagatcgccgcgaggatgctggggctgcaccggttcggtctcgccgcggtcaccgagcattatctgggcgtcacgctcgccaaggagcattccgccgctgactggtcatatcggccgctgccgagggactggcgcaattacgccgcattggacgtcgaactgctgattgagctgcgccggaagatgcagcgcgagctgaaggtgcagggcaaggacggatgggccgacgaggagttccggtatgcgctgcagaccggcatgggacccagacgggagcatccggtgccctggctgcgcatatcgcacatcaacaccgtcagccaggaccatcagggcctcgccgtggccaaggcgctgtgggagaagcgagacgagctcgcccgcgcctatgacatcgcgcccggactgctgctctccgacgattcgatagtcgaggccgcgtcgcgaaagccccgcaacgcccgcgaattcaggatgatcaggtcgctcaacgagcgcgtgcgcatgcgcaccggcggcgagcaggacaagatgttcgaacggtacgcgccgattcagcgcaaggtcaagccctcggtatggcgagagacgattcggcgcgcgctggagctgccgccgtcgcaatggccggtgatgccggcgcccgtggccgacgaggagcatgcgaacgcacctcgctcgatgaagctctgggccaccaggcaccctcagcgtatgcggctgctgcaagacgtgcgcaaagtcgtctcccagatcgccgacgacacccgcacccccgccgaaatcatcgtcaagccgcagatcctgcgcaacctgtgctggaccgacgaaccgcgcaagcgcgatgtcgcggaattcctcaaatcgcagggcgcccgtgactggcaggtgaatctcatcgcagcgtccgtaagtcgcgttatcatgtagaggttgcctaccggcagatgaagtagaataaacgactttcaggagcgcaagcgtgaaaatcagcgttaggaatctcgaacccaccaaggtcaagctcaccatcaccgtcgacccggaggagttcaacccgtatctggatgccgcccgcaaggagatcgccaagcaggtgaacatccccggcttccgcaagggccacgtccccggcaagatcatcgaccagcgcatcggcttcgcagccgtcgctggcgaggccgtcaacaacggcgtgccggagttctattccaaggcgcttgaggagaagaagatccatccgatgtcccagccggagatcgacgtgcaggaagtgcccgaatccgccaaggacgagaccaagctgaagttcaccgcgaccgtcgagcgtcgtcccgacatcgagctgccggaacttgacggcctggagatcgacgtgcccaaggcccaggtcaccgatgaggacgtgaacaaccgcctcgaatccctgcgccagcgcttcggcaccctggtcggcgtcgaccgtccggctgccaagggcgacttcgcgaacatcgacctcgacgcccagatcgacggcgagtccgtcgactcccaggaaggcgtgagctacgagctcggctccggcaccatgctggacggtctggacgaggccctcgaaggcctgtccgccggcgaggagacctccttcaacagcaagctgcagggcggcgagcacgaaggcgaagaggcgctcgtcaaggtcaaggtcaactccgtgaagaccgaggagttgccggagctcgacgacgacttcgcccaggacgcctctgagttcgataccctggatgagctcaaggccgacgtgcgcaaggccgccgagcgcgacgccgaaggccgtcaggccaccgaggcccgcgacgccttcatcgccaagcttgaggaaggcgccgagatcccggtgccgaagggcgtcaaggccgacatgcttgagcagcagctcaagaacgtgaccgccgatccgtccaaggccaccgacgagcagaaggccgacgccgagaagcaggtcgtcaaggagctcaccgaccagatggtgctcgacgccctggccgagaagctggacgtcaaggtctcccaggccgatgtcaccaacttcctcgcctccatcgcccagcagtacggcatggacccgtccgcgttcatccaggccatcgtcaagaacggccagctcggctccgccgtgcaggaagtcggccgctccaagggcctgctcgccggcatgcgcgccgtcaccttcaagtccgaaggcgagaccctcgacctgagctccttcctcggcgaggccgctgaggacgaagagtccgagagtgtcgaagccgcttccgccgcggccgccgtcgccgacgagctcgccaagaaggacgacgagaacaccgccgacgccgagtgagcgtaaatcgcgcggcatcgctgctatcgcggcgtgcccgtgatgcagaatgactgatttgacccggaaccgcaaaggttccgggtcaaatcgtatatacggtgggatatgcgcggtgaggagcgggtgtaggatgccgcgggtaggctgacatgggcgggtctgccgttcccggacgttccactcgccatcgaagaggtgcatcatggagaagaccgattggaagcgcatcggctggctgaccgcggccacgctggtgctcggcgcgatcatcggcgcatgcgccggcctgctgacgctgctgctgtacggcgtcgaatacatgatgctcggattcatcgaaagcgagttcattcccggcgcgttcaccgtgccggcggtccgccgcatcgcctccgtcacgttgggactgggcgtcgccggcgtcatatggtacctgctgcgcacgaagaccgagaaggtgccgtccgtcaagaaggcggtgaacgggggccgcatgccgttctggcagaccatcgtgcatgtggtgctgcagatattcatcgtcggctccggcgcctccatcgggcgcgaggtcgcgccgcgcgagctgggcgccatgctggcgcagcggttctgcgacatcttccatatcggtgacggcgaaggcgacgcgcatggcgtgctcgatcgccgcatggtcgtcgccgtcgccgccggtgccggtctgggaggcgtgtacaacgcgccgctggccggcatgttcttcgcggtggagatactgctcgtcgacgtgacgttggagaaggtcgcattcggattggggatgtctgcgactgcggcgttcgtcgcgaccgccatcaaaggcgagcacatgttctacgacatcggcgcgatgcagatgaacagcacgccgagcctgatgctgttcgcgctgctgtgcggaacggcgtgcggcgtcgtcggcgcactgttccgcaagggctcgcggtgggccgaatcgcacaagcccaccagacggtcgctgatgtggcagatgccgatcgccggattggtgaccggtctggtctctatcgtcgtgccgcaggtcatgggcaacgggcgtgccgcggcgcagctcggcttcagcacattcatccccgaaacggccgccacctccggtgcggcacaatcggccgcgtccgcagcggcctcgccatggacgttcctcgccggctcggacggcgctccgggctcggtcgtcaacgccgggactccgcttgaactgaaccggctatggatgttgctgggcgtgctggcgctcaccttcgtggccaaggcgttcgtcactctgatgaccatccgctccggcgcatcgggcggcgtgcttcagcccggcatcgccttgggatccacgctgggtacgatgctcggactgctctggctgttcgtcttccccgtagattcggtcaccgcgtgcgccctgatcggggccgccgcgctgctctccgcatcccagcaggctccgctcatggccatgtgcctggtcatggaactcaccgaggctccgatcgagttcttcgtgccggtcggcctggccgtggcggcatccgccttcgtatcgtccaggctgctgcacaggttgggttgattgctgctctcattagaaaatgtcctgaaatagcaaacatggttcgatatttcaggacattgactacagattagccatgaggacttatccatacattgttgaagagcatcgtgctctcatctcatgatgtggtctcttggcaggcatgttgcaatgatgaattgagtgttgggcgttgattcatcaccgtggtaattctcatttgatcagaaaaagtggccatcttcggttctctgggggtatgcgaagatgacttcgctcctactgtcgatagtgattgaatcgatatcgtgttgggtgaaagatacggtagtgcgcaaaacctcgggcactgccgacatggaaggacggcaaattgattttcaatagagcaagtattccgccccccccgctatgcgggtagccgaaaagggcggtgcagggcgctgccgtcggttcggacaggtagagtgaattgctgtaacgtattgtgagacacaacatactgtgagtcaaggagataaggtggcagatttgctgacatcatccccggtgatggcggacggcgacatgccgtcgatgccggatccgattttcaatcgtctgttgaaggaccgcatcatctggatgggtgaagaggtcaaggatgacatggccaaccgcatttgcgcacagatgctcatgctggccgcggaggacccgaagaaggacatctggctgtatatcaactcgcccggtggctcgattaccgcaggcatggccatctacgacaccatgcagctcatccagcccgacgtggcgaccgtcggcctgggcatgtgcgcgtcgatgggccagttcctgctgagctccggcaccaagggcaagcggttcctgacctcgcatgcccgcgtgctgatgcaccagccgtccggcggcattggcggcaccaccaccgacgtgcgcatcaacgccgagctcatcatggatatgaagaagaccatgagcgagctgaccgccgaacagaccggccacacggtggaggagatctaccgcgacaacgagtacgaccactggttcaccgccaccgaggcgctggagtacgggttcgtggacaagatcatcaccacgcacgattcgatgacgaagggagaatgatcgaaatggcatccgaagaagctcagttcgcagcccgcgccgaccgtctcgccggcccgcgcggcgtcgtcgggttcatgcccgcagcagcccgcgagagcgcgctgcgcggcggcgcggccgtctcgccgcagaaccgttacgtgcttccgcagttctccgagaagacgccgtacggcatgaagacgcaggacccgtacaccaagctgttcgaggaccgcatcatcttcatgggcgtgcaggtcgacgacacgtccgccgacgacatcatggcccagttgcttgtgctcgaatcgcaggatccgagccgtgacgtgatgatgtacatcaactcgcctggcggctcgatgacggccatgaccgccatctacgacacgatgcagtacatcaagcccgacgtgcagaccgtctgcctcggtcaggctgcctccgccgcggcgatcctgctggccgccggcgccaagggcaagcgcctgatgctgccgaacgcacgcgtgctcatccaccagccggccatcgaccagggcttcggcaaggccacggagatcgagatccaggccaaggagatgctgcgcatgcgcgaatggctggagaacacgctcgccaagcacaccggacaggatgtcgagaagatccgcaaggacatcgaggtcgatacgttcctgaccgcccaggaagccaaggattacggcatcgtggacgaagtgctcgaacaccgttcgtgaggttcatgaatcttcacaagtggatacccccgtcgccgtcaggccgggggtatcctcgtaacagtgcgcataacgggacgcatagtcgaaggagagctgcatggggcgcgtggtgagttacaacgaggacgtgcctcggtgcacgttctgcggcaagaccgagcatcaggtacgcaagctggtcgcaggcccaagcgcggccatctgcgacgaatgcatcgagctgtgcgtcgacatcgtctcggaggaacgccagcacagcgccgatgtcaacgccctgacactgcccaagcccgccgagatcagcgcctatctcgaccggtacgtcatcgggcagagcgcggcgaaacgcacgctgtcggtcgccgtctacaaccattacaagcgcgtcaacatggaactgcgcgaatcggccgggcagttcgacggcaagaagcaggcgctcgggcgtcgccgccgcacggatccgctcgccgacgtcgaggtcgccaaatccaatatactgctgctcggccctaccggcgtcggcaagacgtatctcgcgcagtccctcgccaaggttatgaacgtgccgttcgtcatcaccgacgccacgacgctcaccgaggccgggtatgtgggagatgacgtggagaccgtgctgcagcggctcatctcggccgccgacggggacgtcgagagggctcagcacggcatcatctacatcgacgagatcgacaagatcgccagaaaatccggcgagaacacgtctatcacccgtgacgtctccggcgagggcgtgcagcaggcgctgctgaagatactcgaaggcacgatcgcctcggtgccggtcgagggcacacgcaagcaccgcgaccaggacacggtgaccatcgacacgcgcggcatcctgttcatctgcggcggtgcgttcgtggggctgagcgatatcgtcgccggtaggctcggacgccacgagagcggcttcggggcctcctggcatgaccatgaggtcaagcccgaggaactgctcgaacaggtcagcgccgacgacctcgccgaattcggtctgctgcccgagttcatcgggcgtctgcccgtggtcagcgtgctcgacgagctgaccgaggccgatctggcgcgcatcctcaccgagcccaagaacgccctggtcaagcagtatcgcaagatgttcgccgtcgacggggtggatctggccttcacggagcaggcggtgaacgccatcgcgtcgaccgccataacgcgcgggacgggtgcgcgagggctgcggtcgatcatcgagaagacccttgaggagacgatgttcgagcttccaggcatggatgacgtgcagcaggtgatcgtcgacgcggcctcggtcaggggtgagggtctgcccaaactggtccgtggggaacggcgcctcgtggcatgacggggacgcgcgaggcacattcgcgacacgcgcgcgacacgccaagttgctaaagtcattacattgatgtaatttatttgagttgccgcaaacaagacaacatgcgccagtagcccagcggattagagcagctgactacggatcagcaggtcgcaggttcgaatcctgtctggcgcacgagccgtgaagtaattcacggttgtgcataattcaatatgcgcggtatgcgccggtagcccagcggattagagcagctgactacggatcagcaggtcgcaggttcgaatcctgttcggcgcacaaaaagcccttgaaagcgaatgcttccgagggcttttccaatggatgggcgcacagcagacaggcgcaacgaggagcatccgcccacgaccgtgttccggcgccatcgaatacatacgaggagcagacgtgtacgatttccagtccgtggtcgaacggcgcggcaccacatccatcaaatggcacatgatcgaggatgacatgggtgtgggaagtgaggacgtgatcgccatgtccgttgccgacatggaattcaagccggctccggaaatcgtagaagcgctggtcgaagccgcccaacatgacatcttcggatacgattacgcgaccgacgggtatttccgcgcgctgacggcatggatgagtcgtcggcacaactgggacatcgacccggcctgggtgagcctgtcggacggggtcatgcccgcggtcaacaccgcactgcgtgcggtcacccatcccggcgacaaggtgatcctgcaaggacccgtctactatcctttcaccgccgccgcggagcacaacggcctgaccatactcgacaaccgcctcgtcctgggtgacgacggacgttacgtcatggatttcgacgatctggaggccaaggcgtccgatccgcggtgcacggcgctgatgctgtgcaacccgcacaacccggtcggccgcgtgtggagcgccgacgagctgcgtcgtctgggcgacatctgcatcgcccacggcgtgaccattctggccgatgagatccatgcggacttcgcctaccccggacacgacgtgacgatgttcggcacgctgggggagcgctacgccggccactgctatgagttcaccgccccgaccaagaccttcaacatcgccggcctgctgtgctccaacgtcatcaccgtcaaccccgaactcaagcgggcgttcgacgtggcggcggagaacatcgccggcctgaccgtcagccatttcggactcgtcgcgtgccaagcggcatatgagcgggccgaaccgtggctggatgcgctcatgggcgtgctcgccgacaacctttcgctgctgcgcgagttcgcggaacgcacgcctggacttcggctcatcgagccggaaggcacgtatctggcatggctggactgccgcggtcttggcttcggttcggcggacgagctgcgcgatttcatgcgcgaccgcgctcgagtgtatttcgacgagggcgtgctgttcggcgagaacggagccggattcgagcgcgtcaacctcgcctgcccgaaggcgctgcttaagcaggtgctggacaacatcgccgtggccctgtcgcagcgcgcctgatttcggcaaccgggattgcctctcggcccgctggcggggcgagccgtgaggcaaacagcgggggtgcccgacattatcgcccccgctggcggagggctggcatgcgcggcatgactgggggtggttctcagctcaatggaacagcccgcactcagtccctacccatccgtccggctgattcgctctcatcccgtgtgccacaccaggcgaaaaacaccccaaaatcgcatggtgtggcacagcagagagccacaccatgcgatgtgagccttcacatcacgtggtgtggcaaagcacgggtcgcggaaaccgccattttccaatggccggtgaatgggcccggaatcgcccttggccacaccagccccaaaaccgtcaaaaatcgcatggtgtggtacaggcgatagccggatgacgatcggcggggaatcatccccacgcctttcccgcgaaagtcccatccggcgacgaatagatgggactttcgccggatatggattgtccgtcgccttcctcccccactcctcgcctacaagcagctctgctgtttcttcacggctcgcctttggcccctgtgattgtggtctcgcttcgctaggctcagcccggggcgtagagtgggatgggggtctgtaaaatgaggagtcggtctgatggcaccgaatcctgacatgtcaggcatacgtccgcgtcaggctgttcacctggtatggaattgagggttcatgaatatcacgggtagggtttgggtcaggatccggcgaatcgccgcgtccgatcgtatttccggcctgattatgctcgcgttcgcgtttgctggtctggtcctggctaatctgccatggacgtcgcacatgttcgaggcggtggcggagacgcagctgggcattcccggcaccaacatcatcctgccgatcgggcattgggcgcaggatggcctgctgacgatattcttcctcacggtcggattggatctcaaacaggagctgaccaccggttcgctcgccgatccgaaagccgccgccgtgcccatgctgtgcgccgtgggcggtatgctgatgccgccggtgctgttcatcacggtcatctccctgttctcccggttcgcgccgcctgcgccgggaatcgtcaccatcccgaccggcgcggatgtcccgttcgccgaagcggcgcaggggtgggcgattcccacagcgacggacatcgccttctcgctggcggtgcttgcgttgttcgccaaggcgctgcccggttcgatccgagcgttcctgatgacgctcgccacggtcgatgacttgctggcgatcatcctgattgcggtgttcttctcgtcgctcaacgcatggtactggttcatcggcatcgccatatgcgcggccatctgggcgttcctggtgagattgcgccgcgtcccatggctgctggtcgccgtgataggcgtactggcatgggtgatgatgttcgaggccggcgtgcaccccacgctggcgggcgtgctggtcggcctgctgacgccgtcgcgtgaaatgcacggtgagaagtcgccgcgcgcgcaacgctatgcgagcaagctgcagccgttctcttcgctgctcgcactgccgatattcgcgctgttcgccaccggcgtgcacttcgccgagctgtccccggcgctgatgctgtcgcccgtggtcatcggcatcatcgtggcgctggtgatcggcaagccgctcggcatcatgatcacggcatggctgtccacgcacgtggctgggctgacgatggcgaagggactgcgcgtgcgcgacatgttccccgcagcctgcgcgtgcggcatcggcttcacggtatcgttcctgatcgcctctctggcctacacgaacacggagctgtctgcggaaggacggttcggcgtgctgatggcatccctgatcgcggcgctcatcagcggcatcctcctgagccgtcagtccaagcggttcgagaaggaggagctggagtcggcgtcgtaacggagcttctgctggtatgttggagacatccaagacaaggagtgcgtgatcatgtcgaaaacggatgcgtcgaagaaaagcggcaagaaaaagaagctgcgtaaactggccgcgcagaagctcgcccacgcggcggcgaacaacgcgctgaacgacatcatcgccgcggcaggtgccgaacgagggaaatcatcggccaccgggcggcagacgggtgacgcggcggtgcgcgccgccgtctccggcgttcagcaggatgcatcgccgttgggcgacacctatcaccggggcccggtgattctgcgcggcccgatgattccgaacgacaacactacggccaacctgctcaaacccaatcaggagaccgattggctccacatggatccgtggcgtgtgctgcgcatccaatccgagttcgtcgacgggttcggggcgctcgccgagctcgggccggcggtcagcgtgttcggctccgcccgcacgccgcgcaccgacccggactataaggcggcgcggcgcatggggcgtggaatcgcaaagcatggcgtggccgtcatcaccgggggaggtccgggcatcatggaggccgcgaaccgtggtgcggcgcttgccggcggcaaatcggtcggactgggcatcgaactgccgcacgagcaggggctcaaccaatgggtgaacctgggcatgagcttccgctatttcttcgtgcgcaagaccatgttcgtcaaatactcgtccggcgtgatcgtatgccccggaggattcggcacattcgatgagatgttcgagctgctgaccctggtgcagacgcacaaggtcatgtcgatgccgatcgtcctgtacggcaccgaatactggcgtggcctgttcgaatggctgacgtcgaccgtgcaggatcacggcatgatctcgccgctcgacccgagtctggtactgatcacggacgaccccgacgaggccgtggaagtggcggtcagccggatcgcctcctagcgcttgacggcgatgagcagtccggtgccggtcggagtcagagaggattcgaaacggtcgtcgtcctgaaccatgtccagcaattgccgcatggccaccgccttgtcgctgcggtcggcgggattgggtacaccgccgttcgcctcgtcgccctcgaacgcgagcatgtcggtgaacacgatgacgccgtgctcccggagcagccgcggcgcctgggcaaacgtgtccaaatagttcgccgcatcgccggagacgacgatcaggtcgtaatccgtgccgttgagacgcggcagaaacacgttcaccggcgcgttcaccgcgcgcagcgtcgtttgtgtcgtgtcggacagggcgaagaacatcttgcggatgagcgcgattccctgcgtcgaggaatccaccgccgtcaactggccggtaccgtgcagcgcatcgacaagctggacgatctccacgagtgagccggagccgatggtgatcaccgaggtgctgcgcatcatgcatgccagcgtatgcagcagctgcgcctgagctgcggaaccctgcgcaagaccgcactgggcggcctgttcgcgcgcgtccagcagcgcttgcgtctgccgggaataggcgtgatcctcgacgtactcccatgccctggcgagattcgcatatgaggtcttatccataaacaatcccctgaaccgttgtcgaatggtgtctgtttcggtctgtcagcgctctcggacgcgggcgacgatctgccacatctcctcgccgacgtcgatgccgcggggacagtggcgcgagcaggcgcgcacggattggcaagcggccacgccgtcggcggtgtcgatggcgtccagtcgctcgtcggttgcggtgtccctcgaatcgttcacgaagcgggaggccgagatcagggccgccggccccatgaaggcgtcgccgccggcgtagaccgggcaggctccctcgcacacgccacaggcgatgcagttgctgagcagctcgtatttcgccagctgctctggccgctgaaggtattcgaacacgtccaccttgccttcgctggtggtcgcgagcacgccatcggcctgcagatacggcttgagcttcctgatctggtcgagcatcgggtcgatgtccgcgatcagatcgcgctgaacggggaatcccggcagcggtgccagttcgatgatgccgagttcgtgggattgcgcgcctgcgttgtcttcgcaagagtttccttcgggagcggtcgtgtccgcgctccgcttatcacccgcgtcgccggtgcggcggaatccctcgccatcggcgaggggaatcggcgtcgccggtttcgcccagtcgccgacggtcgcggtgcacaggagcgtcggcgtgccgttgatcgccaccgcgtcggaaccgcacatgccatgcccgcacgaataacggaacgccagggtcggatccacggtgcgcttgatcttcagcagacagtccagcaccgtatcctcccggcgaaccggcagagtgtactcctgaacccactgcttgccgcggggacgccgacgcgccgaagcggaggcgccgccgaatggcgagcttttcttggcgaaggggctgccggagcgggccgggcgatcacgctcgggacgcggcgtgaacctgttcacccgcaaggtcaccgtggccagcgcgtcacttgagccgctcatatatatgcctcctgaagtcaaagaatcgtcaaccagtttgccataaggcatggccttggcgggcgcgcccatgcctcggctccgcgcacggaatcgtcgtcgtgccggcgatgtggataagtggatattcatccacattccatccacaacacgccgaagggcaagccttcgaccacattggccgaaaaccatgtggtcgaaggcggttttatggtgcactgatggtcatggacacctgtttgacaagccgagcggaacacgcaggcgctacgaccgatcatgatcctcccgtggcggggctgagcgatatgctgtgccggctgtgcgacggctcgctcaaatccaagcagctgggggtgctgggggagcaatatgcggcggattggctggaacggcacggatacacgattctggggcgcaactggcattcgcggtacggggagctcgacatcgtcatgatgacgcccgaccgcgtcatcgcgttcgtcgaggtcaagaccaggcggaccgaccatttcggcatgccgcaggaggccgtcaccctgcacaagcagacgaatctcagacgcgccggcgtgcagtggctgctcgagccggaccaccgcatcaggcatacgggggtgcggttcgacgtgctcaccatcgtcgcgcgtgcgggcatggtgtcggtgcaccacataccgggggcgttctgatggctatcggcggttccctttcggtcggcctgattggtctcaaggccttcatcatccagattcaggcgttcatctcgcccggtctgccgtatttcagcgtcatcggcctgccggacgcctcgctcagcgaatcgcgggaacgggtcaaatccgcctgtcaggcgagcgggttcaaatggccggacacccgcgtcaccgtcaacatgtctcccgcgtcgatgcccaagcggggcgcctcgcacgacctcgccatcgcggccggcgtgctgagcgcggcgggggcgattccgcacgacagcctggaggagacgatcgttctgggggaggtgaacctcgacggcaccgtgctgccgatccatggtctgctgccgatcatgctgcatgccaaggagcgggggatacggcgactgatcgtgccttacggcaacgaggacgagtcccgcctggtgccgcagatggacgtgacctgcgtccgtcatgtgggcgagctcatcgagctggcgggaggccgagcgtcgtatacgcttggcgtcgaccgtgcgacggtctcgtgcacggtcgaggacacgccggccttcagcggattgggtgacatgagcgaggtggtcggccaggatcatgtcaagtgggcattgcaggtggcggcggccgggaaacatcatctgctgatgaccggcccgccgggctcgggcaagacgatgttggcctccaggatgccgagcatcatgtgcccgcttacgccggaggaacagctcgaagtggcgtcgatacgctccctgtgcggcacgctgcagcattatggcatctccgatatgccgcccttcgaggcgcctcaccatacggcgtcgaccgcgtcgctggtgggtggcggatcagggcttgcgatgccgggggcgattacgcgcgcccaccgcgggatcctgttcatggacgaggcccctgaattctccgcgaggacgctgcagacgctgcgcgagccgatggaatccgggtacgtggccctgtctcgcacgaaggggacgacctactatccggcgatgttccagatggtcatggcagccaacccgtgcccgtgcggttacgcctacggcaacggggagcgctgcgtgtgcaaggagaaggaccgtatccggtatttcgccagactatccggtccgattctcgaccggatcgacattcaggtggaggtgccgccggtcccgtgcatagcctcggcgccgacccgcgattcgattggcagccacgtcatgcagcagcaggtgatcgcggcgcgggcggcggccggcgaacggtattccaaatacgggtggggctgcaacgccgaagtgccggggtcgtggatgcgcgccaacacgtcggtgaaggcgctggaactcgccaacagggcgctggcgtcgcatcggctgagcctgcgtggagtggatcgggccatgcgactggcatggacgctggccgatctggcgggcaaaacgtcgccggggccggacgagatgtcgcaaggcatcatgttgagagcgaggatgtcatgactgtatgcgagtcggatagcggcctttgctgggaccttgacgaggagacgctcgctcgggccatcctgacattctgcctcaataccgcagacgcgctgatgaccgcgctcctcaagggcacggccgatgcgtgggaagcgctcaccctcatccgggacagcgacccggaactgcgcacgtcggccggcgcggggaaggtcatcgagcaggcgttctgcatcggcatgacccgatgggggagcaagcccacgccgcaggcggtgcgttcgtttcgctccgcgttggcgacatggcagcagcgattgcgaactctccccacgtgggacagggattatctctgcggctggttcaccatggaggggaggcaatggatcatcgcgccgcatgacgtatggtggcccacccgtctcaacgacctggcgttgctgggtcgttgcgcgcccccgctgtgcctgtggggcagtggcgatcgcgcggcattgaccagttgcccgcagcccgtcggcatcgttggctcgcgcggcgtcaacgagtatgggcgccgactgacgacggacatagccgtgcatgccgcgcaagccgggcatctggtggtttcagggggagccatgggggcggacgccgccgcccataggggagcattggacgcgatgcgggcgtacggcatcggacgggccgggcgcacggtggccgtgttcgccggaggcctcaaccatgccggtccgcagtgcaacagcgagttgttcgacgggattgcggaaaacgggggagcactggtcagcgaactgtgcccgggaaccattccggaggcgaggcggttcctgtcgcgcaaccgcatcatagccgcgctttcgtcaacgctggtggtcactcaggcgagactgcgttcaggggcgctgaacaccgtgaactggggaagcgaactgcagcgggacatccatgcggtgcccggcaacattgacatgccgggcaacggcggctgcaaccggctcattcaggagcaacgggccaccatcgtgtgctccgtcgccgacatggatgacgtctggcatgccccgcatccgccggagtcgtttcacgacgtggccactcaacggaaagacggctcggactgcgatgtcgggacgcctcgtgatgccggcatattgcgcgacagcagcccatcgggcggcaacaggtcatcggcgatgaccgagagccagcgggcgatcatcgatgccatccgatggtgccgtcgccggcggatagccccgaccgcgcaatccgtcgccgaacagctgcgcacccggtcaggtgaaaaaggccttgagacgggcgcgacggaagggaagccaacggaagggaagtcaacggaaggaaagggagcggatgcggtgccggaacgcggcatgcatgagttggtcgcccatgtgctctcgcaattggggacgatggagctcatcggactgataaccgtcgagaacggtcgcatctccatcgttccggaaaccggagggagacggagatcatgatgatgatactcactcgtggcggatggtacaggcgaaagcatggtgccttggcgtgcgttacgcctgccattggcatcgtgccaggtcgacacgccatccaccgtcaccggcattgtcgtgacccgcccgcggcgggatgaacggcacaccctcctcttcgagcatcgcgcgctgccgctccgggccgccgaacgcgaagccgggcgccagcgaaccgtcacggaacacgacgcgatggcagggaatcacgccgggttcgggattggcgtgcagcgcgaagccgacgaacctcgcattgcgtgggcggccggccagcgtcgcgacctggccgtaggtcgcgaccgctccgcgcgggatccgccggacgatgtcatacaccgcactgttgaacgatgtcgcactgttggacgacgctgtgctgccggatgacgctgtgccgttggatgttgccgcattgccgggcgtcgccgtgttgccgggcgttgtcgtgctgtcggatatttcttccatgaacggtattatccgccgtgcccccgtcacgtgcgcggcgaacgtcagcccttgtgcgacaatcttggatatgagtccgaaacatgtggaagaaatgtatgacgcggtgatcgtcggcgccggggcggccggcctgtcggcggcgctggggctgatgcactcccctgacatcgaacagttgaaggagtccggcatcgagccgaaggtcctggtgatatccaaactgcagccgttgcgctcgcacaccggttcagcggagggcggcatcgcggcgagtctgggcaatgtggaacaggacgattggcattggcattactacgacaccgtcaagggcggcgactggctggttgatcaggatgcggccaagctgctcgccgagtacgccccgcagaccgtgatcaacctggagcgtatgggcgtggcgttctcccgcaccgatgacggccacatcgcgcagcgacggttcggtggccacaccgcggatttcggcaagatgcccgtgcgcagggcggcatatgcggcggaccgcatcggccatcagatcctgcactcgctgtggcagcagtgcgtcgcggccggcatcgaattcgccgaggaatggtacgtgaccgatgtggtgcttgacaagtcggggagcgccgttgcgggcgtggtcgcctatgacacgcacgccggcgtcacccacgcaattcatgcgcacaacgtgatgttcgccaccggcggtgcaggacgactgttccacaccacgtcgaattcatgggatctgaccggcgacggcatggccttggcgttgtccgccggactccagctggaagacatcgaattcgtccaattccatccgacgggtctcgcgcacacgggcatactcctgtcggaggccgcccgtgcggagggcggcgtgctgcgcaacgccgacggtgaggcgttcatggaacgttatgcgccggagcatcgcgacctcgccgcgcgtgacgtggtgagccgttcgatcatggccgagatcgacggcggacgcggcgtcgcggacccgaaagacccggacggtccgaaggactgcgtgtggctcgatatgaccggcatcgatccggatcatatgaatgcggtgctgccgcaggtggtggagaccatcaaggcgtacgcgaacctcgatccggccaaggacatggtgccggtcaaaccgaccgcgcattacacgatgggtggcatcccgatcaccacggatggagaggtgtatcgctgggcggagtcagggagccaggacggcgacgccgattccggtacccgcacggtcgtggagggcttgttcgccgcgggcgaatgctcgtgcgtgtcggtgcatggggcgaaccgtctgggcggcaactcgctgctcgacgcatgcctgttcggcacgcgcgcaggtgagtcgctggcggcccgcatcgcacagtcgccggtcgacgacccgatgcgcggcgccgatgcggatgacggtcccgccgaggcggcagccgcgctggtggacgacgtcgcccgttcgcgcaagcaggatgtcgccacgatgcttgcgggcagaccggacgtggacgatgacgcggcagacgatacgtctgacggtatgccgcagacagcggagctcggcggctcagatgcttccgcgcagcccggttccgaggaggataacccgtatcggctcgccgccgatctgggaacgctgatggaacatgcgctggcggtgcgttgcgacgcccgttccatcagcgaggccctgaacctgctcgatactgtgatccgtccccgcgccaaccgtctcacggcgcattcggagacacccgcgttcaatcaggagataaccgcgatctgggaggtacggcacctgacactgctcgccgaagccatgctgcgcgcatccgaggcgcgccacgaatcgcgcggttccctgcaaaggctcgattatccgacgcgtgacgacgaacgtttcctcgcgcattcgatgatcgggatggccgatgccgccgatgccgaggcttcatcggcacctcacgcctccatcctgtggcagtccgtgcacatcaatgacttcccgcccaagacgcgcgaatactgagagctgcgatacgggagtggcctgacgccttcccctcaggccggattccttggtcccgagtcagagtggttctgatacaaaactgcgccgaaggcccagccagggcttcggcgcagttccgttttgccggctttgcggcacggtctcacttcaccagcgaagtgagctcaccgagatcgagctcgaaactgaccccgcgctcctcgaaatgcggctgattgcgggtgctttccattgcatgacgtacgaattcgcccgcgatccgagccgattcggccaggccgcggccggccatcaccgcaccgcacagtgcggacgcgaaagcgtcacccgtaccgtggatcatgtacggcagcttgtcgtgcacaagctcgaccttctcggcagcgcccttttcggcgctcgccacgtagttgatgatcttgccgtcaccgtggtcgatgcccttgagcaccacgttcttggcaccgagtcccagcagcgcgtccagcagttcggtcacggcggcgtcatcgagatcctgcccggggtagtcgcgcttggtcaggatgctcgcttcggtcaggttcggcatcagcacgtccgcgccgtccgccagagcccccatcgcctcgcacagttccggcgtgtacgtcgggtacatctgcccggcgtcgcccataaccgggtcgaccagccgcagcgcggacggatattcgcggtacaggcgctggatgatggacacctggtcgggggagccgaggaagccgctgtacacgccgtccagttcgacgttctccttgcgccaggcatccagatatccggagagaatgtccgtcgtgtcatggaacgtgaacacggcgtacttggtgtgtgcggagaacagggccgtcggcaccgggcacacgtcgcagccggccgccgacaggatcgggatcgccgcggtcagcgagcacttgccatacccgcacatgtcgtgcacggcggccacgcgcggaatgtaatgtgggtcgcggtcatacagcgtcacatcatcggtcattcggaaacaccccttactggtaggcaatgacgatacacaacagagactagcatcgtcgggcgcacaccgcgtaacgcggtcccgcccagcgcgccaccggtggcgggcggccgggaagtgccacctgcatcgtatcgacggcatgggagcggaagccggaacgtgacgcctcgcgctagagttgtctgatacacgtgacgacgggacgaagcccgatgcggcggttccgtccgcatgatcgcaaggaggatgccatgacgcccatggatgttctgattgtcgtggaacgcttcttcctgtattggctggcgtactcgttcgcgggatgggtgtgggagaccggcctgagcgtcgtgctgcgcaagcggttcgaggatcggggcatgctcaacgggccgatatgcccgatctacgggttcggcggtctgctggtcgtcgtgctgctgcatgacgtgaacaatccgctgtcgctgttcctgtccagcggcgtgctcgcatgcacgctggaatatgcgtcgagctgggcgatcgagaaactgtaccacatgcgtttctgggattattccggcaagccgttcaacatcaacgggcgcgtgtatctcaacgggtttctggcgttcggcgcgggggcgacgtgcatcaaactggtggtccagccgtggatgtccgacatcgtccggtcctggccgatatggctgcttcacgccgtcgcgggactgtcgttcgtcgtggtggtaatcgatgcggccatcacccaggccggtctgcgcagtctcgattcgcgtctggcgaaggtcagcgagggcatcaaggcgctcaaatcgcagcagatcagacagatcgacacacgcatcagcgaggccgacgagcagtggcgcgaaacgtccgccaaactgcgcgggcaggcggagcaggcgtatgaccggttcgcggccggagcccagcagggcattcgtgcggcatccagaccggttgcggatgccggcgagctggtccgtcgctcgctcaaccgccagcagcgccgtctgatccgcacgttcccgaagatggtatccctgcgcgacctgaccatcaccgacatgatccgtgacctgtggaaccggctctgacggcagcggcgtgtcgcatcgtggatagtcggttttagggctcctgttacgacctgcgacaccaatgatgccaacggcttttaaagggttataggcaaccgcgataacgccggacttgcgatgccgcatccatgtgccctatggtctaaaccaacacctcgccagacgctggaaaccgccgacgggtggcgacaagaaagacacggaaaccacagcatcccgacatgggaaaaggagcgaccaccatgaccgaagccaacaagaagtaccgttttgaaaccctgcagctgcacgtcggccaggagcaggccgacccggccaccgactcccgcgcagtgccgatttacgcgaccaccagctacgtcttccacaacttcgaccacgccgaggcccgcttcggactcgccgacccgggtaacatctacggccgtctgactaactccacccagggcgtgttcgaggaccgcatcgccgcccttgaaggcggcaccgccggcatcgcggtcgcctcgggcgccgcggccgtcgagtacgccgtgcgcaacatcacccagtccggtgaccacatcgtctcctccaagaacatctacggcggcaccttcaacctgctcaagcacacgctgccgcgcgacggcatcaccaccactttcgtcgatccggaggttccgcagaactttgaggacgccatccaggagaacaccaagctcgtctacttcgagaccttcggcaatccgaacgccgacctgcccgacttcgaggccatctccgcaatcgcccacaagcatcatctgccggtgatcgtcgacaacaccttcgccaccccgtacctgttccgcccgctggagcacggcgccgacgtcgtggtcgagtccgcgaccaagttcatcggcggccacggcaccacgctgggtggtgtcgtcgtggaaggcggcaacttcaactgggctgaggtgccgggcaagttcccgaccctgaccgagccggatccctcctaccacggtctgaacttctacgaggcccttggtggagccgccttcgtgacccgtatccgcgccatcctgctgcgcgacaccggtgccaccctgtccccgttcgccgcgttcctgctgctgcagggcaccgagaccctgtcgctgcgcgtcgagcgccacgtgcagaacgcgctgaaggttgtcgagtacctgcagaccgtgcctgaggtcgagtccgtctcgcacccgtccatcgaggggcgccgcgaccacgagctgtacaagaagtacttcccgaacggtgccggctccatcttcaccttcgacatcaagggcggcaaggacgcggcgcgtgtcttcatcgacaacctgcacctgttctctctgctggcgaacgtggccgacgtgaagtcgctggtcatccacccggcctccaccacgcactcccaggagacgctggaggagctggaggatcagggcatccaccagggcaccatccgcctgtccatcggcaccgagaacatcgaggacatcctcgacgacctcaagggcggcttcgaggcgctgcgcgcctccggactggccaagtgatggtcttggctagatagccgcaaggattttccgcgtcgccggtcggggaaccgtgacgcggaacgagaaggggaacccgtacaaacccgcgctgacgtcatgcagcgcgggtttgttacatatagcccttgctggctgggctgtagtgaagcgggtgggatgtcgccgcacaaccaccctccggcgcttcgcgccacctcccgccagcgggagggcgtatggtccgatcctgctgttcagctccgttccgaccacattttggctttttgtcttgaacagtgatgcaagcagggggtttcgtgccacgaaacggtaaaaatcgctgttttaggcatttcgtggcattccctgtgccacgaaatcgtttttaaccggttacatgccgtttcggggcgtgagggcaaatctaagaatcattggaaaatggacgtttcgccattctcgttctcaacactgttctcgctcatcgtacaattcttcttgccaggcatcccctatcatccccgccccgtcatcgccacgggcccgtgtgctcccggccgagagaggccgccgagcgcagtgaaaccgcgcacaatgttcgagcgcgtaatactcaaggatgatgggcacgatggcgattcaccccgccgcacgatgccggtccgagcccgccatccgtatggtgaaagtaacgttcagggaaaatccctgtattgatatggaagaggacgttatggaacagcagatcatgcagccgcagaccaatgccggtgcggcgcaggaacagcggcaccccatcgccatcgaggcgatcgacctggtcaaggactacgggcatggcgaaaacgcggtgcatgcgctgcgcggcgtcaatgtgcggttcgagcaagggaggttcaccgcgatcatgggcccgtccggctccggcaagtccacgctcatgcacacgctcgccggactcgactcggccacgagcggtcatatcgtgttcgacggcgccgacatcaccaccatgaacgacaatcagctgaccatgctgcgccgccacaagatcggcttcatcttccagagcttcaacctgctgccgatgttcaccgccgagcagaacatcctcatgccgttgactctggcgggtcagaagcccgaccgtcagtggttcgacatgctgacgacgacgctgggactcaaggaacgtctcacgcaccggccgaatgaactgtctggcggccagcagcagcgcgtcgccatcgcgcgtgcgctcatcaccaaaccgtcgctggtgttcgccgacgagcccaccggcaacctcgattccgtctccagcgccgaagtgctgagcttcctgaagcgatccgtcaaggaacttgggcagaccgtcatcatggtcacccatgacgccgtcgccgcatcctatgccgatcgtgcgatcgtgttcgccgacggccagatcgtcgccgacgagcagcgcccgaccgccgagagcatgaaccaactgttgatgaacgagcgcgagtgggccacccaactggtcggcgggccgtccgcgggcaccaccgttccaagaccgccggtggcggccctcaaggggcacaccgaaaaggcgtctttcgttccgggtgctccaagcgttccgggcgctccgcagcacgccgccgtcgcccagcaccgccgctgacccgcccacagcattaaggacttctcatgttctccatcaccatcaaactcatgaaaaaaagcgcgaggatgctcatccccgcaggcatagccatccttatcggcacggcgttcatcgccgccacgttcctgttctccaactccatggacgactcgctgcgcaggcagcgtaccgcccagctcggcgaagcgaactacatcgccacgatgaaaacaaacagcaacggcgcggtctccgagaacggctcggccgacagaaccaccgtcgccgatttcaacctcgaccggatacgcgccacgaaaggcgtgaagggcgcccgcgtcgacacgtccgtcagcgtttcgatctccgcagcgggcaagcgctcgaacggatacgccgtcggcacgtcaaccgaccgcaagctgctgccggtccgcatcgtctccggcgaccagccggtcgacaacaacgaggtggcgttgccaaaatccgtcgccaaacaacttggagtgggtgtcggcgacaaggtggacgtcgctccgatatccaacggcagcgctctgagcggcaccgcggtgcgtgacgtgcgcgtcgttggcctgaccagcgacccgtttggtgtgtactcgttttacggtggcgcttcggtgctgtcagagaacgtcgtcgccgcggtatacggcgtggatgatttcgaccatatgcaggcgtacatgctcctgcttgacatcgacgaagccgacgccgctgccgcgcagcggaccgtcgacgaggtctccgggctcctgccgaaatcttatggcgtggaatcgcgccgatcggtcgaggcggaggccgtcagggacctcagctcgaacaacaccagtttccccaccatattcctgctgagcttcggtgtgctcgcactgttcgttgccgccctggtcatcgccaacacgttccaggtgctggtggcgcaacgcaggcgcacgctggcgttgctgcgcacaatcggcgcgaagaagggccagctgtacacatccgtactgatggaggccggattgcttggcctgattgcgtcggtgctgggcgtcggcttcggcgtcggtctgatcgcgctggtcacgaacacgggcgtaatggaaatgatggggatgcaggccaggctgattctctcgtggcaagcgttcgtggttccgatcgcattcggcctgatcatgactgtactcgcctcactcggctccgcacggtccgccaccagcgtgacgccgcttgaggccctgcgcccgatcgagctgaccgatacatcacgcgccggaaaggtccgcgccacgattggcgttctgacgatcatcgccggattggcactggctggcgtcgccgtatggcagctgtccggcatgctgaacggtctggacaccatggccagcgacaattacagcagtgtgctgctgatgtccatcggcggggccgcgctggtgttcctcgggctcgtactcaccgccacgttctggctgccggtgctgatgcgcggcgtcggcgcgctcgtctcgatgtgcggtccgagcgccaaagttgcccacgccaacatccagaagaacccgcgtcgcgtcgccgccaccggcaccgcgctgctgatcggcgtgaccctggtcgccaccatcgccaccggtgcagccagcgccaagcagaccatgggggaggcgctcgcgtcccggtacagtgtcgacatgatcgccaccggcgacggcctgaagaccagcgcagtcaaggaagcggcccaggtcaagggcgtcgcggccaccatgtacgcgcccacggcgacggtgaccgcggaaggcgtgaacgggggaacgatgtccctgctgctcgtcggcgtcaagaacacctccgaactcgccggcgtcatgcacgccgacctgagcggcgtcaccgtcggcgacgacaccgtgctgctgccgaaataccgtgccacctcaggcaaggagatcacattcggctccgatgcgaagctgcggttcactgccgcggagtcgaatggcattgcggcaagcaccgagcaagacgggtccgccagcgcaagctcgacgaacggaggtgtttcctcatcaatgcgtctcaagccggtgcaatccgattaccgccgcgtctcgtccaactatgatgccgtcgccttcatcaacaccagccatttcaacaacggcgacatcaccgcgaccggccacatgctgctcatgcgtgtggatacccagtcggccggcgtctccctgagtgacgtgttcaacaagattcaggacgtattttcgtatgactccaccgtgtccatcaccggtcccgtggcgcaacgcgcacaatgggagaccatcatcaactcgatgctgatgcttctggtcgcgctgatcgccgtcgcggtgctcatcgcgctgatcggcgtggcgaacacgctgagtctgtcggtgattgaacgcacccgcgaatccgcgacattgcgggccatcggcatgacccgcgggcagctgcggcgctcgctggccgtcgaggcgctgctgctgtcgctcgtcgcaggtgtggtcggcgtggtgctcggcacgctgttcggatggctggggtcgtacatggtgttcagcctgtacggcaagacggtgttccccttcgaatggggcatgaacggcatcgtgcttgtggtggccgccatcgcagccctgctcgccagcgtgttcccggcccgtcgcgcagtcaagacgccgcctgtcgaggctctggctgaagcctgagcctcttaggcggccttcgcggcaagccgctcacttcacctacagacagtccaccggactgtctgtttgacggttcagcctgtcgaggctctggctgaagcctgagcctcttaggcggccttcgcggcaagccgctcacttcacctacagacagtccactggactgtctgtttgacggttcagcctgtcgaggctctggctgaagcctagttcgtagagccggtgggtggtcaacacagccgccagtgcaatgaggtcccttctttcactcaaaagaagggacctcatcgcctatatggcgttataccgcacgacccgtgacacgcggctcccgacgcgcgatgttacaacctgaacacgcaaaaaacggtacgttgcaaaatgaactgttcattaatcgaaggtgattttcattatctttcagcggtcggaacctgacagttggtctacaacagaatcggttccatatcaaccaacacacaatggaagctgaaagaatgcacaagacaatgcgtaagtccgcggtcctcaagggcgccgtggcaggcatcgcatccatcgcgatgctgatgtccgtgagcgtcaccgcgaacgccgcggacactccctcgtacggcagcgcggtcaagccgaacatcacctcgctgctcggcgagtattacaactggtggaccccgaagaaggtcgtgaacaacacgccgcagggcgatgccttccgcggcaaggtcaccgatgccggcaagagcgtgctcggacagaacgacaagaccgtcgtggccatcaacaacaaggccgccgccgacaccaccaaggtcgacggcacctacacgcaggccgagcgcgccgctctcgacgcgagcgacggcgacgcactgcgcatctacaaggacgcgttcgggccgatcatcggccagtacgtggccgagggcgtcgcgcagggcgagctgcccaagacctccgacctggtgttcagcaaaagcagcaaggactcgttcgcgggcttcgtcggcaccggcagcgccaagaaggacttcaactacccgcgtccgtacttcaacaaggagaacgaaggcgtcgaccgcacgatcggcggtgacaccgacctcaacggtctgagcccgacgctcgacatcaagcgcatcccgatgatcaatatcgacggccaggaatacggcgaggattacaccgactatcaggagccgtcgcagtccttcccgtccggccacaccaccaagacctacaaccgcggtctgggattggccacgctgctgcccgagctcggaccggaactcgtggcccgcgccgccgaaggcggcaacaaccgcgtcgtgctcggcgtgcactacccgatggacgtgatcggcggacgcatctccgccagcgcatccgtcaccgctctgtggtctgatgccacgttccgccagaacgtgctgctgccggcccatgacgaacttgagaactacatcgccgcacgctgcaaggccgacggcaacggcgacaccgtcgccgcgtgtgtgagcaagaccggcgccaacgacaagaacggatacaagaacaccttcaccgacgcggtgtccaccgaaccggtgaccgaccgcgcgtccgccatcgacgcctacaccgcacgcatgacctacggattctcgcagacctcggccgccggtcaggcgcccgtcgtgccgcaaggcgcggagaacctgctgctcaccgcattccccgacctgaccgacgcccagcgtcgtcaggtgctcgaagcctccgaaattgactccggctacccgctggacgccagctccaacggattcgagcgcatcaacctcgccaaggctttcagcgccaaggtgacgctgagcgaagacggcagcaccatcaccgccatctccttcggcgccaaggcgccgaccgtggtgaagaccgcatcctccaaggacacgatcaccggactgctgaccgacttcaacaagtactacgtcgcaggcaagggcgtgaccgatgagggcaagtcggtgctcgcgcacgacgaccagctcaccgaagacatcaacaacaaggcgtacggcaccgacggcaacaccgcgcaggaccagcgcgccctgtccgacgcccagatgaactccaccaacacgctgtacgacgcgctcggtccggtgctcggcaagtactacaaggacgccgccgacgctggtaagttgccgaagaccgcccagttcctgtccgacatgaacaagtccgcttccaccggcgtcgccaaggccacataccagcacccgcgcccctacgtggaccgcgtgaacttcaacggcacgacgctgaacatgaacggtctgaagcagacgctgaacatcaagaaggtccccggttacgagaacttcgactggggagacggcgaagcgcccgacaacgagtatgacggactgtacaactccggctcgttcccgtccggccacaccaccttcgcgttcacgcagggcgccggcctggcgtacctgctgcccgagctcggcccggagatcatgacccgcgtgtccgaggccggcaacaaccgcatcgtgctcggcgtgcactacccgctcgacatcatgggcggccacatcgccggccagtacggcgtcgccaccgcggtgagcggcgagaagaccgcacaggaaggcgcggccgcccgcgccgagctcgtcgattacctgaccgcgcagtgcaaggccgacaaccacggcgatacgctcgacgcctgcatcacgaacaccggcgcgaacgccgccaacggctaccgcaacgatttcaccgacgaggtttcgaccaagccggttaccgaccgcgcctccgcactggccgcgtacaaggcccgcatgacctatggcttccaggccacgggcacgaccggacaggcgccggtggtgcctgactcggccgtccgcatgctcgacaacgtcgccgcgttcaagtcgctggattccgcgcagaagaaggccgtgctcgccgcgaccgaaggtgactccggctatccgctggacgcctcgtcgcagggctgggcgcgagtcaacctcgccgcggcctacagcgccaaggtcacgctgagcgccgacggcaagaacgtcgtcaaggtcgagcccggccaggcgcaggcctcggtcgtgcgcgagacgagtggcagcaacggcgacaacggcggcaacggtaacggcggtagcaatgccggcaacaccggtgtcaacaatgccgctggccgcaacccctccggcacgcagccgctgtcgaagaccggcgcggacgtgtccggcatcgcctcggcgttcatcctgatcgccgccgccggcgtcacgatcatgatgatccgccgcaagcacgcgatctgacaactagcgtccccgctggcggactgagcatcgcgccccgccagcggggacgtttttatattcgccttataccagaccgttgtcgtaggcgaagacgacggcctggacgcggtcgcgcgcattgattttggcaaggatatgcgccacgtgcgttttcgcggttggcaggctgatgaacagcttgtcggcgatttcctgattcgacaatccatgggcgatctccaccagcacctcacgctcccgctcggtcagcaggttcagttccgggtcagtgtatgccaccggccgggcgccgggcatcgtggacgaaccgtccgcatagccgtcagtcgccgtcaacccatgcttggtgtacccgtcctccatcatcttttcgatgagtcgcttcgtcgccgaaggcgcgataatcgcgttgccctgatataccgtgcgaatagaactcagcagcgtctccggctcggtgtccttgagcaggaatccggatgcgccggcgttgatagccgccatcacgtactcgtccaagtcgaacgtcgtcaggatgatcacgcgggtcttgcgcggcgcgtctccggcggccgcttccagcgcgctgatgcggctggtcgcttccagtccgtccatgccgggcatgcgcacgtccatcagcaccacatcggggtgcagcgattcggccaacgacaccgcctgggcgccatcgcccgcctgcccgaccacctgtatgtccggctgggatccgatcaccattgcgaatcccgctcgcaccagttcctgatcgtcggcgatgaccacccgaattctttgcaactcactcatgccttccactgtatccaacatcggcgaacaagtcccgcatcacgccccctgatttaaccctgaattcatgtcggatgatccccggcgggccgtggagcgccgtctcattacgacgcgatgccgtgcagctgactatcgtgcagctgcttgtcgagcgatgccgcgggcctgagctgcatgccgggctgctcttgccggtgagcctcatcgctgaacccggtctcgcgcagcacgcccagcagcttgcgcatgtgtgccagcgccgcacggccctgtgatccgatggccgcgaacgcctcggagatggccccggacgacggctgttcgccgtgacgctcgcaatcgtcaagcatgcgcaggccggcgaccgcctggtcgatcacgctggtcagcgtcatcgtcacctcggactggatgctctcgctgatgcggtcacgttccatgttcgccgccaggatgcgctgcttggcctgctccgcgcgcaacgcttcctcgcgggcttgcagcaccagcgcgttcgatccgctggatcgggcccatcgtgccatggccgtcgcgcttatgcacaacgccagcgatatcaccatgaacatgattgccgatgcgaacgcggcgggtgtcgtcgcgagggaatatgccgggcgggaatgagtcagcatgctgaagatgcttcgatacccggtttgagcggcgaagatcttgcagccgaacagcacggaatccgatattgcggcgatccccgtccatcgccatgccttgtcacggccgtacaacaccgcggaatacagggccacaagggaagcgaggatatcggccaggctgaccggctcgaagaacagcagctgaagcgcagcgaggatggccaccgccagcgcgctggattccgggaacctgcggcggaagatcaacggaatcaggatgatgatcgtcaatgcgcggtcgaaacggttgtcgagctgcagtccctcggcgtatatgacggatggattgatggaaagtagcatccaggccaccagtatggtgagcagcaggtcggtcagcagataatgccgctcggtccactgcgacatgcgctcgatccagttgagccgctgctccccggtagcggatgcctgctggatcggcttcgaacgcagggcggacagaatcgtgcgcaggcgtatggtgatgggcgccggcggtgcttgtgtcgggaccgatgacatctgcgacaccggacggggcatctttgcgccggccggttgcgtgacaccggccggttggacgacaccgacttgactggcgacggcggattgcggggcgttcgcgacattactgacgaccccggcattcccggtatccgtcgccattgaaaccgttccggtcgtcggggccgccatcggcatgattgccgcgcccgaagacaccgcagcggaagacgccgcgttcgagctttcggacgccggcgcagcatcctcggactgcgttgagacagtgctgtacggcacgaagccggacaccacgaagccgccgccaagctgcgggccactggtcacgctgccgccgatcgcgcctcgcccgccgcgttcgcaccgcatgggagcaatccgccacggtggatcgcatcatcgctgcgcaggcgccggcgagaccggtcataaccgtcctgccatccctgtcttatcgcgtcagacagtgacgctaatctgtgtaccagtctcgtaagaaaaggacggacccatgactcagccttatgacgaacgcgcggaacgcaagcgttacattcgccgccgccagcagatcgtattctcctgtgtcggcgcggtgcttgccgtcgccctggtcgtgtcggcgctgttctatttccatgtcgggggtctgggcataacggccacgtccgcagtcaagccgaattacggcgtgcgcgtgccctgctcgaccaaggacgccaacggcaagaaccagacatattccaactatgcgaacgtcaaggtgcgcgtgctgaacggcaccaaattcgtcggcttcgcgaaggccgtcagcaccgcgctgtcgaaccgccagttcaaggtcaccggctgggacaattacaagggcaagaaggtcgagcgcaccacaatctatttcggcaagaacgccatcaacgaggcgtacacgctgaacacgaacttcacggacgcggtgatggtgatggatgaccgcgacgacaagctgattgacgtggtgctcggcgcctcgttcaacgatctggccaacaaggacagcctgccgagcggcgacaccgccatcgaaaacttcgagggatgcgtgcccgtccagtcaatgggcaccttgcccaaggccctcgatcatgaaaaggtggaatgacggccagcatcgtcatgacggcctgaaacccccgatattcggcggctgcctgccttacgcggacagccgccgaaccgtttcttgggcgcgtttacagcgacgcgtgccaccgcttgagctcggccaccgcggtgtcatggtcgaccggaccgttatcgagccggtattccagcatatgcttgtatgcgcggccgacctccgggccgggagcgatgccgaggatggtcatgatctcattgccgtcgatatccggccggatggcgtcgaagtcctccttctccttgagatcgcgcacgcgctgctccatctcgtccatggcggacgagaacaccatcgccttacgacggttctgagtggtcgcgtcggcgcgggtcagccggttcagccgctcatacagcggaccggcgtccttgacgtagcgtcgcacggcggaatcggtccatggttcttcgacatacccgtggaaccgcagatgcaggttcactaactcgctgacatcctcgacgagatgatggtcgaaccgcagcgccttgagccgtttgcgcgtcattttcgcgccgaccgcatcgtgatgatggaagctgaccttgccgccgggctcgaaccggcgtgttttcggcttgccgatgtcatgggtcagcgcggccaggcgaagcgtcaggtcgggagcgggcacggggccttccggcccggtctccagcgctatggcgcgatcgagcacaatcatcgtgtgctcgaacacgtccttgtggcggtggtgctcatcgatttccagctgcagggcgggaatctccgggaatacgatatcggcgagacctgattcgaccagcgcttcgacacccgccctcggacgatcggacagcaacagcttcgtgagctcgtcacgcacccgttcagcggatacgatgtcgatgcgatcggtcatgtcgctgatggcggcagccgtgtcgggggcgatgctgaacccgagctgtgcgacgaaacgcacggcacgcatcatgcgcagcgggtcgtcgtcgaaggactgatatggatccaccggcgtgcgcaatacgcctttagccaaatcgctggcgccgccgaacgggtccacaaactccagctgcggcacgcgcagcgccatggcgttcacggtgaaatcacggcgggacagatcgccttcgagcgaatcgccgtagctgacttcgggcttgcgggattcgggatcgtacgtgtcggaccggtacgtagtgatctccaccttgacttcggtgccgtcctcgcgccggcgcatcgcacccaaagtgccgaatttgcggcccatatcccagaaaccgtcacgtccccaatgacgcaggatcggctcgaactcgtcgggatgggccgacgtgcagaaatcgaggtcgtgggaacgccggtgcagcaacaggtcacgcacggggccgcccaccaacgccagctcgtacccgcgagccgcgaacaggtgtccaagttcaatggcttccggccaaacttcgaaattcacacgaggcctttccataaagtattaccgcttttatgcgtattcaagcataccgttaccccacctgcacacggtattgagtaaggtggaagtcatgattacgcccgcagacctcgcgcgcatgcttgcgcatgctgcgggcgaccatacccaaaatccgctcgaacccgatacgttgctctatacgtccgaggctccgcgcacgccgaaaaccgttgtcaggccaccggaaccacgcttccccacgcctgcgatgatgccgcagcgacgggcgggcgacgggccgaccacattcgcgtcgctggacgctcaggagctcccggtggtgcgcgaatactcggccggcggcctggtgttcgacgagcgcggccgtgtggccatcatcgcgcgacactcccgcaacggccatctcgaatggtgccttcccaagggccatatcgaaaagggcgagacgccgcagcagaccgccgtgcgcgaggtgcacgaggagaccggcattctgggtgaggtggtcgagtccattgccaccatcgactattggttcaccggtaccagccagcgcgtgcataagctcgtgcatcatttcgcgctgcgccagatcggcggcgacctgacggtggagggcgatccggatcatgaagccgaagacgccatctgggtggatttcgatgatttggatgacgttctcagctatcctaatgaacgcaagatcgcttggctctacgcaaggaaaatgaagcagggatgatcgcgaacagccccgagcacggtcaggccgtgccatcgttatctcaccgaacgacacgcctatggcgcttctttaccatcatgttgctgacatgcgcgatgctgttcgcaggccgcatggtaccggccggcccggcacatatggcgatggcggatgacgagacggacacggccacgcagacgaccgccttgtcgatcaccgaatcgacgcccgtggtcaccgacacatccggctaccacatcaccatcagcatctccaatcccacgtatgccgcgacgtcaccgggtctggtgaccgtggcctacaacccgtcatatacgttcgtatcgcgcactgacatccagcattgggcgaccggggacgtatcgattccggtgcgcaccgttctcggcacggccacggtgccgtccatcgcggcgaacaagaaggtttccgtgaagatcgacgcggcggccgacagcgatgcgttgaaggcgttgcagatgtgggggccgaaaccgctgctggtcacctatcaggcgacccaggcgaccgactctcaatccacaggctcctctgacgggtcatccgggtcggaccgtaccgtcgatccgaacaccaagccgattcgcctgcacagcttcctgaccagatcatcccagggattgcgcaacgcacagaccccgccgatggccatcaccatggtcatgccgttgatgaacaacggccagcaggccgacaagaacgccatcgaccagctggtggtgcatgacaacggcgatgaatccgacacaaaatctacacaatcaggtggcggcgtcacggatgacagcacagacgacggctccggcaacaataccgacgacaccgaaaacaccgcggcgacgcaatcatcagtgctcaccccgcacgacaatgatgcactcgccgccaaactctccctcatcggcaagcacagcgatctgcagaccatagccgatccgacggcattggcttccgacaccgggcaacgcatcgatgccgtcatgcagccggccggattcgacatcaccgcctatgccgcgatcaacaacgtccggtcgtacgaacaggccggcgtcggcaccggcgcatggaacgcacgatccgcactggccgcggcaccggcatcatccaattccctgcccatcgcctggcaaggcaagggcgattggacccggcaggcgctctccacggccaggaagcagggataccagtacgtcatcgccggtcacgacttcgactccagcaccacggccaccgtgcacacaggcacatacacaatccccacctcggccggcgacatcacggtgctgagcgagcagaaggaactcggcgacctcgtcaaaggcaagcccaccagcagtgatgcggacggcgagaccagtaacgcgggacgcatcgcgcggttcgtcgcgcagagcgccttctatcagatggagcagccgtatgcggcgatgaaccgcaacctgctggtctgcttcggcactaatatgtcggcggcgttcatcgacacgctgatgaccgcggtcgaacagtcctcatggctgcagctcaccgacctgaacgatctcattgacgcagacgcctatcggaccggcgacaaggcgctgcaaatcgtcccccaagacagtcatttaagcgagcggaacacccgatcggtcacgtccgcgctggaatcgctggccgaaagccgcaacgacatcaaccgcttcgccacgtcggtcctcaccgaccataaggcatccgcgtcctggatccgcaagatcaaggccgcacagagcacgctggcactgcatgcgctctcgtccgcgccgcgcgacatcgacagtctggtcgacggtgccaaacggctcggcggaggcatgttcggcggcgtatccatcacgccgaccgactccatcaccgtcgtcagcgaaacggccaaaatgcccgtcaccgtcaggaacaaccatccgtatccggtacgggtgaaggtctcatccctcaccgactccatggaaatcgtcacatcgcggttcactgaggtcaccataccggcgaacagcgaggcgcaggtcacgttcgccatccgcgtcgccacttccggccacgccacagcccacatcacattgctggaccgcaacggcgacacgttcggttccgcacagaacaccgacatcaccagcgtgctgcgcatcagcgacatgaccggattcatcatcatcggcttctcgctgctgctcggcctggtcggcctctggcgccaattccatcgaaagaaggaccccgacgaatgagcaccacggtaggacgcaattcgctgatcatggcgtgcggcacggccgcgtcacgtgtgaccggccagatccgcaccatcttcctcgtcggcgcgctcggtaccaccggtatcgcagccaacgcgtatcaggccggcgcgcagataccgcaggtgatcttcaacctgctgtccaccggcgtgttcaacgcggtgctcgtgccgcagatcgtgcgcacgctcaagcagaaggacgcggatgagcgactcagcaagctcatcaccttgtccatcgcgctgctgctggccatcacactgctgatggcgtccggcacgccgctgctgacgatgctgtatctcgactccagctggacgcccgcgcaaagggcgctggcgaacgccttcacgctgtggtgtatgccccagatcctgttttacggcctgtataccgtattggggcagatcctcgccgcaaaggggcgtttcgcgacgtatgcgtggagctccgtaggcgccaacgtcatcagctgcatcggtttcggcgcgttcatcatgctgttcggcaacgcgggacggcagccgatgtcgttctggacatccggcaagatagccctgaccgcgggcgcctggacggccggcgtggcgttccaggccctggtgctgttcattcctttgctgcgttgcggcatccactaccggcctcgctggggactgcatgggctggggttgcgttccatgggccaggtggcggtgtggagcatcgccatggtgctgctcaaccagctgatgggcatcgtcaattcgcgtgtcaataccggcgccccgaccgccggcggcgatttgtacggcatcgcgggcaacgcgagctatcagtacgcgtacacgatatacgttcttccctattcgatcatcgccgtgtccatcacgaccgcggtgttcccgcgcatgtcccgcgcgatcagcgagcatcgtatcggggatgcccgcgccgacctcagctcatccttgcgatccaccggtcttgcgatgttcttcttcaccgcggtcatgattgccatgccggtgccgctggtgaaggcgctgattccgtccacgaatgtgcatggggcgattctgatatccgggcctctgatcggtctgctggtgggattggtgcccaccagtgcgttcctgctggtgcagcgcgccttctacgcgtatgaggacggccgcagcccgttcctgttcgcggcggccgacaacgccgtgcagttgctgcttctgctgacctcgctgcgtttcgcaccgccgaaatattggacgctcatggtggctctgtcgctgagcctgtcatatatcatcacgttcccatgggtgttctggctgttgcgcagacgattcggtgggcggatcgacggcaagcgcatcatcatcatgcatgtcaaggccctgattgccggtgcggcggcatgcgcgtgcggactattcctcaacccgctggtcacgcgtttggtcggcgcgaaggtttccagcgtcaacggacatatgagctggtggcaatccatcgtcatatgcgcgattctgacgattgtggtgacggccgtgtatgccgggctgctatggctgatgcgcgtggaggagttctccagcctgatcgtcaccatgaaggcacggctgttgcgtaggacttccactgcgacatcggtatcgacaccggctgagtcggagaccgaggaagctcaggcacaaaacgcggaggtcgaagagggcaccacggcaattgcggagaatgataatcattacgataattattcgctgggtgacgatggaacctcggagaatgacggttccgcggaacgggccgctgaaactgtgaccgatctcgaacggccggttcagaaccagccggttcaggaccaacccagggggattccgtccgacaaccttccgcccagcttcgcgccgacggtcaaccgtaagggccaacgcccgtccatcaagtccgtcgtactgccgaacgtcgcggcaaacgcagccggtgcagcggcaggtatcgcggccggcaacaacgcccagccgcgaattcccaccatactgccaacgccgcatcattccactcgtcaagccgtgtccgtcgcggctgcacagccgaccatccccacggctagaatgtcagcatcaccactatctcagcgcatgacagcagagcacggagaaacaactactatgaagcctcaattgggagataccgtcatcggtcgctacactctcgtttcttcgctgcgcgaaagtgacggattgagcgcatggatagccaatgaccgcatgctggcgcagtcctgccagctgttcatcatcaccgacacatccgttctgccgcagatcaacgaggcggcttccacgctcgcgctggccaacagccggtactgcacgccggtgctgcagctgcagcacgtcggcgatgccgcggtggtgatcaccgagccggactccggtctggcgctggcggaatacatgcagcgttcgtcttcctcgttcctcagctacgacgcgattcgatcgatcgtgggacaatgcacccaggcggttcaggagctgttggacacggggctgacccataccgcgctgagcaccgataccattcgcgtgagcgtcaatggcgtgcagttcgccgacactcccgtcgccgccgcattggccgatatctgcagcggcatcgacggcgatgtgatgtcgtatgagcagatggcgacgcgacagctggccgcactgctgtacgcgctgctgaccaagacgccttcaggcgcgaacacgacgttcgacctgaatatgctgcccgccgacgttcccacggaattccgcgtgatctgcaagcgtggactggccctgcacaccgaagatggggaaatcatcgtgccgatggcaacgctggccgagctgagcgcgctgctgggcgcgtgggagccattcggcaacctgtcggatcgtgacatcatattgccgtcggtcagtggcagcgcctcgatcagcatggtggcgttgcgtgacacgagtgatgacaagatcgtggaactgccggatgggctggttacctcgacgaagctgccggaattgtcgatttccgaagcgggactggcagccggcgccgaggccaggttcgtcaacgagcagcgtctcgcacagcaggcgttcctggctcagctgcccggagatccaccctcggccgatcagccggtcatccccgaagcggaattgttcgaaccggataccgccgagccgtcgaagaccctggcctccctgcaatcgaaggtcggtcagcttatgggctccttgcgcaaggacggggagccggagtcgccggtgacgacatccactgcggaagagaccgcgattgagcagccgatgccggtgtatgcaccgctaccggcatcgttcccgcccgccgccaagccgcataggtccgctactggcgcgacgaaggcacaggcacagtccggcaacggcgtgaacgtaccggcaaacgctgctggtgcgtctggtgttgcgggcggtaccggcaaaccccggacgaccggtgcaaccggcgagatacagagcatcgtggccaatatgccgaatgttccgctgccggaagagaacgacaatgagcgcacccgcgccggcagcatcccgccgctgccgcagtccggtgaggcgcaggtgtctgaaggcgagcaaaccgtggctggaagccatcccacgacccgtgcggctcagcccattgccacgaacgccatgccgcagccgcgcgcgcatatgtcggaatcattggccgctcttgccgccagatccgccaaggccgcggcgtcgggcgacgccgtaatgcccccgtcattcgcagtgtcggcatcggcgcccggagccaatggagcagccatccccggatcatcgaagtcgcgtacgcggatgacggcaccaatcagccgcgatgccctgcggaacatgtctggcggccgtcctgcggcggctccgggtgcgaatgtgccgagtgtgcagacaccggcgcagcgtgcccaatccgacgcctttgatcccacggtcaccgttccgctgctaggcactgatggtacttcggtagatcagctgccgcctatggcccagatcatgccgccgagcttcgcgccccagcaggtgcacgatgtcaacgcagcgaatgtcggacgcaatatcgaggaggacctgcctgaccagccactctgggggcagctcaagatcaaggtcatcgccatcgtcgtcgcgttggttctgctggtggtgggattggtcgccgcatggttcatcctgaacggagacaaccacggtggcggatccgacaatcaggattggccgaacaagaccgacatcgataacgtcccgttcggcaactcgaccacacagaactccacgtcaaagaactctgcggcacaatccgacatcgtgtacatccgcgttctgtaggcgacgcagaagttctcataggcgccccttctactcacgggcaggaggggtgtttcatcgtacgcggtgactcacgctgtggacttatgctgtgggcccgtatcgtgctcgtattagctcctccggtttccataaacacggcatgcctgtttcggcaatctgaaagcgaccaatcggcattcgaggcgaatccatgtcgttgttcacccaccgctggacgaggtcaggtcaactcgctatcgtaaggggcatgactgaactttcaaccatcatcatcggttccggccctgccggatatacggccgcaatctacctcgcacgcgccgggtatcgcccgaccattcttgcgggtgagctcacgccgggcggtcagctggtcaacaccaccaccgtggagaattaccccggtttccctgacggcattctcggaccggaactgatggatcgtatgcgcgatcaggcggagtctttcggcgcatccatcgaatatctcgatgtgacgagcgtcgatttcagctcctcccccaagaccgtcacgtgcagcgatggaagccaatatcacgccgatgccgtcatcatcaccaccggttcacagtaccgcaagctcggcattcccggcgaggccgagtattccggtcacggcgtatcgtattgcgccacctgcgatggtttcttcttcaaggacaagcccatcgtcgtggtgggcggaggagacagcgcgctcgaagaggcactgttcctgactcgtttcggctcttcggtgaccgtgttgcaccgccgcgaccagttccgcgcctccaagatcatggtcgagcgcgtgctgaacaatcccaagatcaccgtgaaaatgaatacggtggcgacagccattcgcgggcagaaaaacgccgccggcgtgcagacaggtgctgatgcggtaaccgctgcagcacccgcagcgcagaacaccggaaatcttctctcgttgaagacgactccgatgctgaatgtctccggatcggcattgaatgctccctcttcgaccggcatttccctgtcggcaaaggctgaaaccgcagatgattccgccggctttgtggacattcgcgacaccgtgacaggcgagacgggcacgttgcccgccgagggcatcttcgtggcgatcggccatgaaccggccacgcgttttgcgaagggttccgtggatatggatgacgacgggtacattctggtctccggtgccggaacgcatacttccgtgcctggagtgttcgccgccggtgactgcgttgaccgggtgtaccgtcaggccatcagtgccgcaggcatgggatgccgcgccgcgctggacgcacaatcctacctggcctcactgcactgatccaacagcacagctcgacctgtcagcgaaatcaaacctcatcacagacgatgatattgcttcaccggcgggttgagctacacaaatattgcttgcattgtcagtaatcacaaacgaaacgacagactgaccgaaatagcgctgcggacgcttaccagcgccggagaatcgcatcagaacgacaatccgctcaaatctagcgcattgtactggaccgatttcaactcatattgctcaacagagttttcggtaatgaattttcaggtgcatgcaataggacagttatacgtgcggttcattgcattagtcctctgactgcaaatgccacgacagttgctttatacgcgttctgccggagaggcaatgaatacctctcggcagaccagatcatacagctcatgaacggcatgaccgttgtttcccgttgtgtgatgatggcggctcacaccgttgtgtggctcgcaacctcacacccattttgccgccgcgccctcgactgccgtgggaatcagcatgctgaggatgcgttccatatcctcaggggaggaaaacacgatttcgattcgaccgtgcttttgcgtacccttgatggacactttggtgtcaaaatgattttcaaggttgttgacaatcggagaaccggcccaaggattgttcttcgtcggccttaccttcttgggcacgttgctttctgcgttcttcagcgccacgatttcctcggtgctgcgaaccgaaagcccctcccctatgattcgagtggccagcttgtcgatttcactttcgtcattcaaaccaagaagagctcgcgcatgccctgcggacagtacgcctgcggcaactttcttctgcacggacgcaggaagatgcagcagccgcaatgtgttcgcgatttgcggtcgagatttcgagatcgacttggatagttcagcctgagtcaggccaaagtcatcaatcatctgctgatatgccgccgcctcttccagaggattcagtgcgacgcgatgaaggttctccagcagtgcatcacgcagcatctcgtcatctgatgtggttttgacaatcgccggaatcgtcttcagttgtgcaagttgtgatgcacgccagcgacgctcgcccataatgagctcgtatttctgcgatgtttcacgtgaaacatcactcttgctggactccccagcctgacgcttgcgaaccacgatcggctgcaatacgccgacttccttgatggacgcggccaactcattcagctcttcctcatcaaagacgctgcgcggctgctgcgcattcggaacgatggagctgacaggaatatccagcagatagccaccctcgacaggcttcaattttggagtttccttattatccttttccttgccggatgcctttgtgctctcggaacgctgagccggctgcgttttcttggaatcgctcgtcccctgtgctgttgctccgaaaaacatgtcactggggtgtgccatatcactgataccgggcatggcaacacgcttgccgctcttgggcttctccaccgttgtggacttgtgtacggcaggaatggaatccttcatggccggaatggtcttacgcttgatttcgccaagacgaaccggagcggtagactcactgtgttgttcagtaccgctcttatgggattcgaccttctctggcgcagccgcagctttctcttgaggggctttcttgttggctgtcgtctcctcggattcgagatcaacacccaattgctgctgttccgcatgagctgttctcgactcaccgggaagtgcggggaacagcgcacccaatcctttacccaaacgtgattttgaggtcatgggttactctcccctcttcgcgtcaattgcagccagcaccgaaggcgatcgacgggcgatttccaaggccgcttcgccataggcactcgctcccattccacgcgggtcatagctaatgactgtctttccgaaacttggagcctcagatatttttaccgtacggggaatcgtcgtatccagaacgatactcggatagtgactcttcacctctgagaacacttccctgctgagcaatgttcgtttatcaaacatagtgaccagcatagtcgacacagtcaaattagggttatagtgctcctgcaccaatcctatggtattgataagttgaccaagcccctccaaggcatagtattcagcttggatcggaatcaacatctcagacaccgcgcacatggagttgatgaccaacaggccaagactcggcgggcaatcgaccagaacatagtcataatgattgttcggatcctgcaggaatgattcgacggcttccttcagcagattgttgcgattcggcagatccgccacttccagttccgcacccgaaagttcaatggaagcgggaaccacatcgagccctgggatatcaggacaggttttcagtacctctccgattgtcattcgtccttcaagaacgtcatataccgaaggatcgctggtgccgtgaggaacaccgcatgccgtagaggcgttcccctggggatccatatcgatgaccagcacgtgagctccatgagaggcgagagctgcggcaatattcaccgttgttgttgtcttgccgacgccgcctttctggttggcgacggccaggcatcgggttctcgatggcagggggaacaatgcggcattcaggcgttcatagcgtgacgcctcatctgcaatctcggcacccaaagaggaaccatcattcccgaaaatccttctgaccgtttcagaagcagattccatggcaggaatcgcagaggattcctgtgaatcattggatgtcatagtccctcctaaaaaacgaacaacatctaatttttcctagtcgtatggacatctcaagttgtgcacagcaatgtggataactgtggataagtatagtgcattagtgtgtgaacacttcgatcaacactagataaaccgtttatttccgccattttcttaatgtggattacatgtcgcaaataatgtggataactttgtgcactgtttgaagttgtggataactccattcttgcgaaaccatcgctttcgtgtttgacattcattgtttcacgtgaaacaatcttcggacagtcagcgatgtcgatgagatataacagtattatttatgcgttcaaaggcaatggatatcgtccgtctcgccccgcaatccaacctccgacagcggaagcagaattacgattcccgtcagcgggagcatgggattatcgtgtgactctcacccatgggagccacacgataattagcgcttgtctacgagaacgacgtgcgtggattcgagaccgggagctactggagcttcaacgacacgagcacgcactcccctggcatgggaaatttgatgcttcgccttttcaatctcagcctgcgccgaacggcctttcaatgcgaccagtcgaccttgagggcgaagcagaggcaacgtccaaccggcaagcttggtcattggcgccactgctcgacaggtcactacagagaatggtttcaattcaccttcgtggtgcttgatacgatcgatgacttcgtcggaacgtgcgcgaataatcgtaacattctgcaggtccatgtcatccacgcactcttgcaaccattcgacacgacgttccatgggctcaatgagtgtaaactcacaatccggcatgcatgctgccgcaacgattccagggaaaccgccgccactgccgacatcggcaatggtctttgccttgcttcgatcggtgacttcccgaatgaacgggacgcatgcggcggagttgaggatatgacgttcccagatgatggatatgtcgcgtgggcctatcaatccacgcagctcaccctcgcgggatagtttcacgtgaaacacttcgagtttgtcgtatgcttcgcccaatgcctcacgaactattgcggaatcatccagctcatcaccagatgtttcacgtgaaacaatatcgctcactcttcgctaccttcatcgacgtcggattcatcggcgctgctcttcatgtagatggtgacatagcgacgcggctcttcaccgtgagaacgagacttcagcccctcctcgcgaaccacatcatgaatgaccttgcgctcgaacgaattcatcggtttcaaatcaacgggctcaccggtgtcatgcacttcatcaatggcatcaagcgcaatgtcacgaagacgctgacgcttgcgcttcaggaacccgtcaacatcaacaatcagatgcgagcgttcgccggtcttctgctgaacagcaagccgggtaagctgctgcaaagcatcgaccacttcaccattgcaaccaatgagatgcttgatatccgtatcgtcatcagcgacgatctgcaccatcggacgaccgttgcgaacacccatctcgatatcgccttcgtaatcggcgatgtccaataagccttccaagtagtcggcggcgatgtcagcttcttcattgagctgatcgatcgtcgtggtctcctcctgcgccatatcaccactcctttaagcgagtattacttccatagtgtaaaaaaaggaaacctcacggtcaaatgaggtttccaatcgtgtcacttcttcttgcgattcttccgctggggctgcttgcgctggtatccccgctccagacgagcagcggcttcctgacgtgccttctccagttcctcttcctcaatcgaaagctgtccggccttggcgcgacgagcattctcctgacgatgatctcgaatctccttttcctcagctgcacgggaacccggggtcgggaacttgtacacctggaacaaggaacgggcaaggttgcatgcgttgttggtcagccagtacaccagcacggcgaacgggaacatgatgccggagaagatgtacatgatcgggaagccccaggtcatggcctgctgcatcttgtacgtggatccctgcatcgaagccttggggaggttcttgcgcatgttgttgaactgcatgtaccacatgcatgcgcacatcaacaggatgaagaagccgatgacgacctttccggaattgttggccgtaccgaaggtatcggtgacgctgacaccgaagacgcgggtttgcgcgaactgctcggcggtcgcctgatcgaatgcgccaagcgctcccctcttgccggtcgcgatatacggaatggcggaaagcatgtagaacatgcacatgaacacaggaccctgaatgacggcggtccaacacgaccccatggggttggcgtcattgtcctggtagagcttcatcatctcacggctcatggcctctttgctggcctgatcctttttacccttgtacttgttctgaatatgctgcatcttgggctgcaaggcctgcatcttgcgcatcgacttcatctgcttgagataaatcggcaaaatacaggcgtgcaccacgagcacaaggaacacgatcgccagcacccaagaaatgccgatcggtgccatgcccagcagggtgaggaacttatggaacaggaccatgacctgagtcatgagccactcaagtggggtcagcagcttatacagccagccccaaatgcctctgtcaagaagaaattctccggaagtgttcatcaggccatctccttaatcatcggccattggtgtgagtcgaggcctctcatatgccttcgaccagcgaaatctgtagcacagtgaaaaatgttgcggaacatcatcgatgccgccacgactccaagggttgcagcgaagaaaacgccaaataaacagcacgattcctcttaccgcgccgaagcgccgaaccgcagtgatcgcgtaatgtgagcaactcggatagtacttgcagcatggcggcgttttcgccgaaatggccctctggtaccacttgatcatgccgataagcgccgatccgatggctgacatcagtgactcaccctgcgttcatgcgtagtcgtgactttggcgaagcaacgggaaaactgtcggtcaaggtcagcgaaatcgacacgcgatgcgctgggtttggctctcacgacgatatcgcactgcatcggaagcatatcttcatatcgtcttgcgagcacacgaaatcgacgcttcacacgattacgcgttacagcgttaccaacagccttgctgacggcaagtcccatacgtctcatgatatccgcagatgcctgaacatcacgggtatcgtcatgcaccacaaagtgcacgacgatatccgaatccgtcaccttgaagcgacgcttcagcactgcgatgaagtcacgatggcttttcagccgcttcactcgccttcgtcacctaccgcaatcaggcggacagagacttacgtcccttgttacggcggcggttgatcatcgcgcggccggaacgggtgcgcatgcgcacgcggaaaccatgcttcatcgagcgacggcggttgttgggctggaatgtcctcttcatagttatgctcccggtttttgccatgctgatgcacggctctcatgagtcaagctctataacggtactctgagccatgcccaaaaatcaaaatgaaaacaatttcttcacgatttatcagtgtgtcgtgccccttgcagagcagcggaaaacattggaaacacgccaaaacatgtagaaaagttatccacaaattacatgaatgttattcacaattgaggcgacacaacacgctaagctgtggataacttggctaaagtggagtacatatatcctgttgttgttgtacttattatagctaccgtagcgcatccgctgcggtgcgcaccggcacacatacctgaaggaggtcacaatgtcggatgaccttctcggtccagccgggcaagccacgcggatatggtcggacacgctgcgtctgctcaagcagaatcccacgctgtcgccgcgcgacaagagctggcttgaaggagtcgtaccggaagcggtatatggcacgaccatcgtattgtgcgtaagcaacatggccacgcagcaagcgttgcagaatgaactcaatgcgccgctgctcaacgctttgaaaatcatatccggaaacgacatgttcccggcgttcaaaatcgtggctcctcaggtgtcccaaccggaaccgcagccgccggaataccggcatcccgatactgcggcgaaaccgagcgaaccattccctgcgaatccgtcgccgaccgtcgccgatctggctcaggaatcctacatgcccaacagcatgcagtcaatctcctccatcgattcgatttccgcggaaatgacggaggcgaatcagcaaccaggcgccacggctcctcgaatacccggcgagccgagttttccggtacggcagcagaaggtgatgcgcgatccggaaacccatctgaacaaaaactcgacgttcgacacgttcgttcccggtgattccaaccgtttcgcacgcactgtcgcgcttgcggtcgccgagggaaccgggcaggaattcaacccgttgtgtatctacggcggatcgggactgggcaagacccacctgctcaacgccatcggcaactatgcattggtcaaggatcccacgctcaaggtccgatacgtcaacagcgaggaattcaccaacgaattcatcgaggcactgcagaccccggcccagagccagaaccgtatcgccgaattcaaccgccgataccgcgaggtcgacgtgttgctcatcgacgacatccagttcctcggcggcaaggaagcgaccctcgaacagttcttccacacgttcaacgcgctgcatcaggccaacaagcgtatcgtcatcgcgtccgatgtcgcgcccaagaacctcaagggcttcgaggcacgactcatctcgcgtttcgactccggactcaccgtcgatgtcaagccgcctgatcttgagacccgcatcgctattttgcgcatgatggcttcgatgaacggcacttcgacaccgaatgacgtgctgaatctgatcgcggagcgcttcaccgagaacatccgcgagctggaaggcgccctgattcgcgtgagcgcggtggcatcgttgagcagtcagccggtgacccgtgcgcttgccgagcagacgctgcaggacttcttcaccaccgacgtggaaatcaagccgaccgacatcatcgggcagacggcgaagtacttccatctgacattcgacgacatcgtcgggcgcgcgcgaacgaaaaacatcgcgctggcccgtcaggtcgccatgtatcttgcccgtgagatgaccagcatgagcctggtcgatatcggcgaagtgttcggcggccgcgatcacaccacggtcatgcacgcgtatacccgcgtcagcgatgatatgcaggaaaagcctgaaatttacaactacgtgaccgagctgaccgcgcgcctcaagcagcgcggcaatgagtgacgacagtcgttttctctcggctgtgcaatggtcccgtctggcacgatcgcgctgagacaccaaaaaacgccttttttcgtcgctgtgcgtgattctgctggatgaaggcctgattcgtcaccgtcgacaggacctatcagactcaaataatatagacatacatatttaatctgtacaataaaacaggcgcaacacgccgaacgatctgctgattgaaggaaaagttatccacatgcttattcacaaatgtgggtagagcctgcggataacttgtggactactgcacattttttgtggatgaacagtggattaatccacaggaaatgtggacaatcaaaatagttcgccgaaaatgtggataactcggtacttatgcacattttgtccggaaagttatccacataatctgtgggttactcagcccatataaacacaaggattcgcgcagttatccacactatccacagggcttattactacgactatcttatttctctttcgataaccgtcgtgatgataactcacttcgcgcatgagaaaaacaatccgaacatgacccgctagaatgttgccaagcacatcgtgaaatgagggaacccatgaaagtagaaatcgattccgcggctctcgccgacgccgtagcttggacgacccgcgtcatcgacgcccgaccggcgagccccatccttgcaggtatccagctcgaagccatcgacggcacccttcaactgtccgcgttcaattacgagatttccgcacgtcaccacatcgaagccggtatcgacgaacccggaaccgcactggtactcggcaaactcctcgccgacatcaccaagtcactgcctgccgaaaagacttacctgtcgaccgacggctccaccatgaccatcaactcgggcaagtccacgttcaccatgcagctcatgcccgatgccgaatacccggatctgccggtcgtaccggcaaagctcggccaggtcgacgcacccacgttcatccaggccgtaactcaggccagtgtcgcggtctcccgcgaggagaaccgcccggtgctgaccggcgtgcgcatgcagttcgacggcgacaaagtcaccatgacctcgacagaccgtttccgcctgtcccgcgccacgttcacctggacgccgcagaacatcgacacctctacgaccacactggtgcgcggatccctgctgcgcgacgtcgcccgcgcgcttgacgatcaccagaacgtcgtcatcgatttcgacgccgacaaccccacgctgctcggtttcgagaacgccggacgcgtctcgacatctcagctgatcgacggcgaattccctgcggtcgaccgcctgttcgccgacgaatacccgattcaggccgtcatcgacaagcagctgctgatcgccgccatcaagcgcgtcgcgctggtcgccgaacgcaacgccccgatccgcatggtgttctccggccaggaagtcaccctgtccgccggcgccgtggacgaagcccaggcgcaggaaatgctggacatcgacatggacggcgaggacatcaccgtcgcgttcaacccgtcctacctgatcgaaggcctgagcgccatcactgagccgttcgtgcgcatgaagatgaccacggccgtcaagcccgtcgaattcaacggccagcaggaggcggacagcgacgaatcgatggattaccgctatctgctcgtcccgatgcgtttcaacagctgagcccgacggctgaacactggaatccgaatcgaatcgccggcaccgccgaaacacacggtgccggcgatgacatgacaggagcccatcttgtacatttcgcgtcttgcgcttgaccattaccggtcatggaaccattgcgtgctcgacctcacgccgggcatcaacatcctgcagggggcgaacgggcttgggaaaaccaacatcgtcgaagcgatagaagtgctgtccacgggcctgagccatcgcacatccagctcggttccactggtgcagcgcggcgaacatgcagcgacgatccgggccaatatcgaatccgtgacggatccggagcccgctgatgagggcgtcaataccagcgctgatgccgtggatatctcggacatgaaaccggtccggcagacacagaccaccacccttgaggccacgattgcggcacgcggcgccaaccgcgcccgcatcaacggcgggcagtcgcggtatctgcgggagattctcggcacgctgccgaccgtgagcttcaccccggaggatcagcagcttgtggcgggcgaccccgccgtgcgccgctcgttcatcaaccaggtcgcctcgctgctgattcccggatatgcgaaccggttgcaatcattcacgcacgtcgccaagcaacgggcggcactgctcaaacagctcggtcaatggcagcgtgcaggatccccgattgacgccgcgctcagcgggctggagatctggaccggacagttcatcgaggcgggagtcgcgctcagccgcgacaggcagcgcatcatcgcggaactgaacaagtcgttcggcccgctgtatgccagattggccggtgtggcgggcgacttgccgtccaatgcggaaattcaggatgccgcgcaggatggtggtgagcaggcagcggtcgaatacgtgccgtcattcgacgagatccttggaacacaggcgcccgaaccgttgataagccagcatttccagcgcatctatcccggcgaggtgtctcgcggcgtcaatctgatcggcccgcaacgagatgacctgttggtgacgctcaatggcatgccggccagggaattcgcctccaacggcgagatgtggacgttggccctggcattgaagatggcacaataccgggccctctgcgagtatttcgacaccaggccggtggtgattctcgacgatgtgttcgctcagctcgacgaatcgcgccgcaccgagatcctgcgttttgccgcggctcaggatcaggtactgatcaccgcggccgcggaaagcgatattccgatactgccggcgaatgagtcgacagaatccggcgagataccggtgaaccgcatcgcagtggccgatctcaaacggcgcgacgaagcggatgccgagagggccggcgaacaatgaccgaaccccgcaagccgaatacgccgggcgggccgggggcaccgagcaggcccgacaagccgggcagcgcggtcaagccgggcaatgtacacgattcgcacgagccgatttgcgcgaccctgcatctcgaccagcgcaaactgcccgccacggtgttcgagcacatcgccaagatggcgggaggaaggcgtcagcggatgattgacgccgaggccgcatgggagaacttcggcaagccgggccgcgacccgagcaccttgggcagcgtaacggcgctgattgcgaataacggtcattggataccgtatctgaaaatcgcgcagctgcgcaatcactgggatcaggtggtcggaccggtcatcgcccagcattcgcaggtcatcgggctgcgcgacggagtcatgaccatccgtgccgattccgcggcttgggccacccagctcacctacctgattccgcagctggaacgtaccatcaaggagcgcctgcaggggttggacgtccacaagatccaggtaacaggcccccgtgccgcgacatttcgcggctcaaggatgaagaggcgctaaattcgctcagagagccaaagtccccgtagacgggtaggattggcggataataggttcagcgcttagaaaccccgttattcgcgttttagagcgtatcgcccgcagaacaacctttcatgacgaaagaatatgcaggaaggaaaccgttagtggcagttcttgaatcggattccgaacatgaatcccgtgacgagtccggcatgcctgagcaggctccgggcagcggtctgacggcgagcagcgccgagcagcatgaccgcgaggtcgatgaagccatcgcccaggacgagctcgatgacgcccagcttgacgacaccttatcgcccgaccattatgacgccagcgacctgaaggtgctggaaggccttgaggcggtgcgcatccgcccgggcatgtacatcggctccaccggcccgcgcggtctgcaccacctggtctacgagatcgtcgacaactccgtcgacgaggcactggccggctacgccacgcatatcgaagtgacgatcctgccggacaacggcatccgcgtcgttgacgacggtcgaggcatcccggtcgacgaagttcccggcgaaggcgtctccggcgtcgagaccgtgatgaccaagctgcacgccggcggtaaattcggcggcggcggatacgcggtgtccggcggccttcacggtgtcggcatctccgtggtcaatgcgctgtcgacgcgagtcgatatcgaagtgcggcgccagggattccactggacccagacatacgtcaatcagcatccgacggcccgcctcgccaagggcgccccgatggccgaggatgagtcgaccggcacttccgtgacgttctggcccgatgcggcgatcttcgaaagcacggtatacgacttcgagacgctgcgctcccgcttccagcagatggcgttcctgaacaagggactgaagatttcactcaccgacctgcgcgagccggatctggccggcgacgaagtggccggcgatgacgattccaccgagccgaagcaccagagcgtgacttaccagtacatgaacggcatcaaggattatgtctcgtacctggtcaagtcccgcaaggccactcccgtcgaggaggatgtcatcgatttcgaggccgaagacctcaagatcggcatctcggccgaggtcgcgatgcagtggaccaccgcgtattccgaggctgtgcacacgttcgcgaacacgatctccaccacagagggcggcacgcacgaagaaggcttccgtgcagcgctgacctcgctggtgaaccggtatgcgcgagacaagaacatcctcaaggagaaggatgacaacctctccggcgacgatgtgcgcgaaggcctgaccgccgtcgtgtccgtcaagctgaccactcctcagttcgaagggcagacgaagaccaagctcggcaactccgaggcgaagaccttcgtgcagcgcgtgatgaccgacaagctcggcgactggttcgacgcgcaccccgcagaggccaagaacatcatccagaaggccatcgaagcctcccgcgcccgcatcgcggcgaagaaagcccgcgagaacacccggcgcaagtcgattttcgagtcggccggcatgcccgacaagctcaaggactgccagtccagcaaccccgaagagtgcgagctgttcatcgtcgagggtgattcggcaggcggctccgccattcaagggcgaaacccggaaacgcaggctatcctgccgcttcgaggcaagattctcaacaccgaacgcgcctccatcgaccgcatgatgaagtccgacaccatcgagtcgctgatcaccgcggtcggtggcggctatggcgaggaattcgacgtgagcaaggtgcgctaccacaaggtcatcatcatggccgatgcagatgtggacggtgcccatatcgccacgctgaacctgacgctgttcttccgttacatgcgaccgatgatcaccgcaggatacgtgtatgtggccatgcctccgctgtaccgtctcaagtggacgcgcggcgatcatgattacgtgtacaccgaccgcgaacgcgacgagaaactcgcccaaggcaaggccgcaggccggcagctgcccaagggcgaaggcatccagcgctacaagggtctgggcgagatgacctaccaggagctgtgggagaccaccatggatcctgagcaccgcatcctgaagcagattcacatcgaggatgccgcggcagcggacgagaccttctcgatgctgatgggcgacgacgtggaaccgcgccgtcttttcatccaacgcaatgccaaggatgtgcgtttcatcgacgcttaaggttctaatccaagccccgccggcggggggggggctgtcagcgcagctgactgggggtggtcccgatccacccgatgacagcgacagaaacgacgtccaacatacggtcgaacagaatttaaccaaaggacaaccaagtggcagacgaaaacagcaacggcaccgacctgccggagcagaacgacgagcgtgccgaacactcgatggagcccatcagccctcaggccaacgaacagttggtcctcgacgacaatcgcgtggcccacaccgacatccagaaggagatgcgtcagtcgtacctcgactatgccatctccgtcatcgtcgaacgagcccttccggatgtgcgcgacggcatgaagccggtgcaccgccgcatcgtgtacgcgatgtatgacggcggctaccgtcctgatcgcggctattccaagtgcgcccgacccgtcgccgacgtgatgggcaactaccacccacacggcgacgctgcgatctacgattcgctggtgcgcatggcccagccgtggtcgatgcgatacacgctggtcgacgggcagggcaacttcggctcggccggtgacgacccgcccgcagccatgcgttacaccgagtgccgcatgatgccgcttgcgatggaaatggtgcgagacatcgacaaggacaccgtcgacttcgtgcccaactacgatggccgtacgcaggaacccaccgtgttgcccgcgcgcttcccgaacctgctggccaacggctcgtccggtatcgccgtcggcatggcgaccaacattccgccgcacaacatgcgcgagctggcggaaggcgtgcattggacgctcgatcatcccgaagcgagccgtgaagagctgctgaacgcactcatcggcatcatcaagggaccggacttcccgaccggtgccacgatcctcggccacaagggcatcgagcaggcgtaccgcaccggccgcggcctgattacgatgcgcgcggtggtcaacaccgaggagatcaagggccgtatgtgcctggtggtcaccgagctgccgtatcaggtgaatcccgaccgtctggccgcttccatccgagaaggcgtgcgcgacggcaagatccagggcatcgccgacatgcgcgacgagacgtcgggccgtaccggccagcgactcgtgctcgtgctcaagcgcgacgccgtgccgaaggtcgtgctcaacaacctgtacaagcactcccagctgcagcaaacgttcggtgcgaacatgctcgcgctggtcgacggcgtgccgcgcacgctgagcctcgacgccttcatccgccattgggtgaaccaccagctcgaagtcatcgaacgccgtacccgttacctcaagcgcgaggccgaggaacgcgaccacatcctgcagggcctgctcaaggccatggacgccatcgacgaggtcatccgcctcatccgctccagccagggccgcgaggacgcccggccgaagctgatggagttccttgacatcgatcaggtgcaggccgacgccatcctttccatgcagctggttcgactggccaacatggaacgccagaagatcatcgacgagcatgaggaactcatgcgcaagattgccgactacaacgacatcctcgccaagccggaacgccagcgtacgatcgtcggcgacgagctcgacgagatcgtcgcgaaatacggtgacgaacgtcgcacgaagatcctcccctactcgggcgagatgaacgtcgaagacctgatcgccgaggagaacgtggtggtcaccgtcacgcactccggcttcatcaagcgcaccaaggccaacgaataccgtgcacagcatcgcggcggcaagggcatcaagggcgccaagctgcgtgaggatgacgtggtggatcacttcttcctcacgtccacgcataactggctgctgttcttcaccaataagggccgcgtctaccgcatcaaggcgtacgagctgcccgaaggctcgcgcgattccaagggccagcacgtggcgaacctgctgcagttcggtcccgacgagacgattcagaccgtgctgtcgattccgaactacgaggtcgccaagtatctggtgcttgccacccgcaccggcaaggtcaagaagaccgcgctggccgagtacgattcgccgcgtcagggcggactcatcgcggttcgtctcgcggccgacgaggagaccggcgagcccacggacgagctgatcggcgccgcgctgtgcaacgccgcagacgacatcatcctcgtctccaagcagggcatgagtctcaagttcgcggcggacaacgaccagctgcgtccgatgggacgccagaccgccggcgtgcagggcatgaagttccgcggggatgacgaactgctcgccatggacgtggttccggaggactccaagcaggacctgctcgtggtcaccaatgagggcttcgccaagcgcaccgcgatcagcgaataccgactgcaggggcgtaacggcttcggcgtcaaggcggtacagctcgccgaaggtcgcggatcgctggtcggtgccctgatcgtaagcgaagacgatcaggtcatggcgatcatgaagtccggcaaagtgatccgttccaacgtcaccgaggtcaagcgcaccggccgcaccacgcagggcgtgacgctcgctaagcccgacaagggcgacgagattatctccatcgcccgcaacgaggaaaccggcgaagacgaagtcgagacgacggatgatacggctgcggccgcatccgcgaccacgtctcccgatacggccgaaaacactccggataccgcggatagcgtcgcatccggcagtgattcgggcgcggcatctgacgagaatgtgaacaacactgatgacgaggcataatcgtctcagaaaactggtagcctcggctaagagtcatcggggaacgacaaggagcaacgatgagtgacaacctcgaacccggacggaccgacatgttcgtgcccggtccgcatgacaatgcagaaccgcacgaaggtgtccgcgaaagcgcccctcgggtcgcgcgctctatttccaaccagccgcagtcggagagcgagccgcgcgccaacaaaacgcgtgcgtccctgcgttcaccgcgccgttcgacgccgcgcgcccgccgcatgaacctgtcgctgacccatgtgaacgcatggtccgtggcgaaggtgacgttcatgctgtcaatcgccggcgcgatcatcgaagtgcttgccgccgccctggtctggctgctgcttgacgcggtcggcgtgttcgaccagctgaacaatatcgtctcgtccaccggtctggccgccgacagcctgaacctgtccagcgtgttcagcctgtccacggtactgtcggtggtcaccattctggcgatcgtcggcgtcgtgctggtgacgctccttgccaccatcatcgcgctgctgtacaacgtgatcagcgcgcttgtcggcggcgtacatatcactctgggcgacgactgatccaatcgaatccctgatacatcccgttacgaaccccgcggaggcaacgcccgcggggtttgtatatctcatcatcgccggcgcaggaaaagactacaccgccgcttcgtggaagccgtccgctcaggccttcaggaggccaaggttcgtggcgttgccgctgattggcgacagcgccacatgaccgcgttgccggcgcgggttgtcagcacatgacgacgaataatgggagttcccgatgatcgggagcccccattatgttgttgataggaaaatcacgctctcaaaactcgcagatacagaccatttctgttgaattcggccctgtatctgcgagttttgagagcgtgagctcgcgataatcaggccgtgaacctcaccgaagcccatgtgaccggtggcaacgaaacagtcatccgaccctcatcaagcgcggcggatagcggctgcaaggtgacgccgtccggctcgtcggccgtattggtgcggtagatatcgtcgctgtgcagcatctgcgagctggtgacggacggccactcccccagcctaggcaacgatgtcaggccgattgtcacatcatgggcgttgtgctcgtcacggttgacgagcagaatcatgccttcgcgagtcttttaatcccaagtggccaccgcgaccgtgaagagccgtaaggccggcagcggcaccggttccgcatgggcacagtacacggacgagctcgccaccgcatcgaccaccgccgatatgaaggctggtgagccgcagtacgtgaccaccacgttcaccgtgcccgccgacgccgcgcctgaaggcgctctgtggctgagcttctccgacatgggtctcgccgatgacgccaacggctacatcgacgatgtggtgctcgtccgctccgactccaagccgacgctgaagaccaccgcgttcacgccgaccgtcgccgagggtgaaaccgcctccgcatacgtggagctcgacggtcagcccgccgccaaggaggtctccgccaacaagaacgcaaccgtcgacgaagtggccaccgcactgaaaacctcaccgccgcacagaacgccctggccgagaagccgaagccggcgaccgtcgaatcgatcaaggtggccgcgaagcccgccaagaccgagtacacggtcggcgacacgttctccgccgatggtctgaaggtcgtcaaggtcatgtccgacaagaccgaaccgggcaagaagcctggcgcgcagaagcctgccggtcagcagaacgtctgtccaagaccggtgcctcggtggctggcgtggccggtttgcgtgcctaagtgcgcgccgaaacgacgatcgtgcgcacttaagaacgcaaacagagccatttgcgttcttatgttcgcgcacttgtcgtttcgacgcgcacataggaacgcaaaccggccgtacctgctgctgttgcgttgctgtgccgtcacgccgttgtgccgtcacgatgtcgctgccgtccggggaacgtcgaaagacgcgaaacggtcctgcgcaaatcatgtcacagacccgtttctcaatgccggaccacgccggttaaatccgtgatccgcgaaaacccgcgaaaatcagcggtgggtggtgccctcgtaggtgtcgctccacgtcagcgacgccacgccatcggcgatagaaatcggcatctgtacgatcggcgagttgccgaggtcatgctcctgccagcggtcgccgatgaacaggaagtgctcgctgttgtacgggtcgtcgtccagcggcaccacgatatcgacctgcgaatcgtaggtcttcgcaccttccggcgcgaacagcttccactcgctccacgggccgtgcaggtcggtggcggtggagtacttgttgtcgttggtgtcccagctggtcagttgcgagccgaaccagtagtacaggccgtccttcttgatgatggtcggcgattccaggccgtatgggtagtcggtggcacgctcgcaggcgacgtcctcgacgatggtgaggtagtcgtcggcgagacggtaaatgtgcgtgccatggtcgcggtcctcgctcatgatgtagccgctgccgtcctcgtcctggaagacgccgatgtcacggctcaggtagccgcgccacgtgatggtggtctggaatgcgaacggaccggtcggggcgtcggccacggcgacgccgatgtgcgcgtatccgtagtcgggcgtttcggcatgaatatacatgacatatttgccggtggcggggcaatgcagcaccttcggccgctcgccgatacggtcggcggcgagggcggagccgtcttcttgcacatcaagtacgatgccgtggctgcgccatgcgatgaaatcggtggttgtataacagcacacgccctggaacaaattgccgtttaccttgttctcgccatatgcataccaggtgtcgccgaatttctgcagaccgatgccgtgcagctgggcaacgtcgcccgaggtgtcgtgaggcagaaaagctccgaatctatcagccatgatttcccctttcgtgatgatctgctgttgattatctgtcgtgtccgcaactgcttgtgaccggttacagactgaaccattgtatcgtgaaaactatgccgacatacggaagaatcggagtgcgcccggcggtggcgctccggcaacggccgcgtggggtcgtgcgttgcaatatgaggctctcaaaattcgcagatacaagggactatttgttattttcgccctgtatctgcgagttttgagagcgtggttcttccgggatcacgccgattggcgctccacgatggtcgtcggcagcagctgcacgtaatgcggctccacgatgtcgccttgcagcatggacagcaacagccgcgacatcgtctcgccgtgcagctgcgaatcctgccgcacggtggtcagcttcgggttcgccagcagggcgattggcgaatcgtcgaatcccgtgaccgcgatgtcgtccggcacccgatacccgaaccggttcaactggttgatgacgcccagcgcgatgctgtcgttggcgcacacgaatccgtccagctcgtcaagcatgggttggaactcgaccacggccatttcgccgctggtgccctcccagtcgtccgcgtagtagacgtggcgctcgttgaaccggtcacccatcgccgccttgaagccgtcgaagcggttgttcgacgatggtgagtatccggggccgcacacgtacaccagcttggtcctcccctggtcgagcaggtagcgcgtgatgtcgcgctgcccctcggtgttggtgaagtccacggccgggaacggcaggttctcgcgttctctgacttccgagaggaccaccggccgcttgaccgatgcgaacgtgttggcgagcatgccgtcctcgctcagtgagaacagcaggtacccgtccgaaaagtcgctttgcaccagctgcgcgatgcggcgcgtggagtcctcgctgttggcgatcagcgtgaccatctggtagcccgcgtcgccgaggacctggttggcgccggccatcgcccttgacatactggcctgcgcgatggtctcgttcgattcgacctggatgatcagcgcgacggtgagtgtgcggcgttgcgcgagtgagcgtgcggcgttgttcggcgtgtactgtgatttggtgatggctgctgcgatgcgttcggctgcgtcctgcgagacgtgggtgttgccgttcagataccgggagaccgttccgtacgatactcccgcgagacgggcgacgtcgcggatggtcggctttttctgtgcatcgtccatggaatccatggcatcggtgtttgcttcgtgttgctggatattcgccggttgcttatcgctgttctggtctaccggtgtttcgttggaacgtgcagacgacttcgtccgagtgcggttcgccagacgccgggtcggtttgccgctcgttgatgctaccttgttcggcgcgtgaatagttgttgacatcattgttcctttacgcgtgcggccgtcgtcggacgaccgcgtacaggttcgagtatacgcagatgatgtaaacggtcacaaggggtgtctgtcgttgtgccggccgtggcatgcggagcctttcctcagtcgcggtccgccgcccgaccgccgtgtggctcgccatccgtggctcgcctgtgtcgacgcattccgacatggctgcgcaatctgttgtatttcgcgttcgcgttcagataatgcggggcatagtcgtcctgtcggttcccgcgacgcgagtacattgaaatcatgaccgatccgctgcatatccaactcaccgcgcgccccaccgtggacgactggcagcccgactgcgtaatggacggctaccagcaggcgacgatccatctcggccatgatgacgaaggcgatatcgtcgccacattcgtgcgccgggacccctcgaagctgcccatgagagcgcgatggaggcgtcagcggttcgcgctgcgcgggcaccggctcgcggtgatgtacgtgcacgggtggaacgactatttctaccgccgtcacgaatccgagttctgggaatcgcttggcattcccttctacgccgtcgacctgcgcaagttcgggcggtcgttgcgggatggacagacccctggatatatcgaggatctgcacgattatgcggcggaattcaacgccctacgcgacctggtcgtcgccgagcagggcgagcaggtgcgcatcctgctggtcgcccattcgcagggcgggctgagctcggtgttgtggctgaattcgcagcggccgcatcacgtcgaggcggtcgcgctggactcgccttggctggaattgcaaggcaaccgcatgttccgcatactgtcgacgcccgtggttcaggcgttccagctgggcggcggcaaaacggtgatgccgatgcgcgatccggggttctacggccgctgcatcgattgcgagaccggcggcgactgggattatctgcgccatccgctggtggacccgcagcgtttctttccccgcgccgggtggatgcgggcgatctacaatgcgcaggccgaggtgtcgcgccggctcgacatccgcattcccgtgctggtgtgcacgtccgaccggaccatgctgcagcccacatgggatgaggcgatgcgcgaggcggattccgtgctggacatcacggcgattcgccaggcggcgctcaacctcggcgatgtggtgacgctggcgacgattcgcggcggcctgcatgatctgagcctgtcgcggccggccgcgcggcgtaggtatttcaggatcgtggccgactgggcctctctgatggcgtggcggagggtgattccgcctgcgcatctgcgcaccgcgttggacgcagtcgcggcggccggcagccatgtcggtggcgtgaatcccgatgtcggccccgacgcaaaatcctgaggtcccgcaacggctcgcggccggcgtccagctgcgagcctgcgcaggtcacgccgactgccgcaccaccagctcggtcggcaacatcaccgtacgcggcgagtcgatgccgtgaatctttttgatgacgatgtcggccatcaccttgccgcgcatctccatgtgctgatcgacagtggtgatctgcgggttcgactccctcagcatccgcgcgccgtggctggcggtaaaagccatctttgccattggatttccttatggcggtttgggttagatgacgggcaaccccttgctacaatgagagggcttataaatccgtttgttttaagcaaaaccccgagcttacttccaccgtaatcgccacgctcggcggcttcgccccaacggtcaaactcggcatcactaatcacagcacatctcctactttcatttcacaacgtcgataatatcggctgaacattgatacttcgtggactagccacgccataaagacgcgcctagccggtaagcctgttgatccagcgaagccgttcgctgcggccggcaaggtcacggtgacggtggcgctcaagggcacggacttcgcgaagtccttcgagatgactgtcaggtccgccgacaagacagctctgaacgaggtgatcgcggaggccggctcggacgagttcgaggccgccttcgacgctgcgaagaaggtcgccgccgacgaggacgcgactcccgcccaggtggctgacgcgcttgccgcgccgcagaagccggcggtcaagccgagcccgaacggcaaggtggatgccaccgagccgagcggcctgagcaagacgggtgcctcgacgatggcgttcgccgtggccgcggtcctgctgctggccgccggtgccggcgtggtgctgctgcgccgccgcgccgagtaaggggcgagccgccatcccaagattctggcatgtcgggatggccgccgctgagaaatcggtggcggccatcattccccgacggcatgtcgtgacgactgattgcatgggggggcgcttgatgcggacgggatgttcccgagagccgccttcccggccgcatttttcgttgttgcgggaatcgcgctctcaaaactcgcagatacgggccgtttttgttggatttagccttgtatctgcgagttttgagagcgcggggttggtggcagcccgtgcctcatcccgtaaaggtcccgtttctggcctgcgggatgtgactttctccggatgcgggggcaatcgacatgatggcgacccggtgatcgcgcgccgcccccgttggcggggagctgtcgcgaagcgactggggtggccaaacctgctgcaggacacgaaaggcccgacgaaaccaatgcgaatactggtttcgtcgggccttcgcgttatccgcgaatgcgcgccaaacgttacgcgcctacgcgatcacaggatgccctgcgcgaccatggcgttggcgaccttgacgaagccggcggcgttggcgccgagcatcaggtcaccctcgtggccgtactccttggcggcggccagggagtcggcgacgatggtctccatgatgttcttgagcttggcgtcgacctcttcgaaggaccacgacagacggtagctgttctggctcatctccaggccggaaacggcgacgccaccggcgttcgccgccttggctgggccgtacagcagaccgttcttctggtagacctcgatggcctccggggtggacggcatgttcgcgccttcgacgacgaccttgcagccgttcttcaccagagcttcggcggactcgccgttgacttcgttctgggtggcgcacggcaacgcgatgtcacacggcacggtccacacgccggagcaaccctcgtggtactcggcggacggcacgcgctcggcgtactccttgatgcggccgcgctcgacttccttgatctgtttgaccacggccacgtcgatgccgttcggatcgtagacatagccgttggagtcggagacggtgacgaccttggcgcccagctcctcggccttctgcacggcgtagatcgccacgttgccggagccggagaccacgacggtcttgccctcgaaggagtcgttcttcagcacgcgcagggcttcctgggtgtagtagcacacgccgtagccggtggcctcggtgcgggcgagcgagccgccgaactccagacccttgccggtcaggacgccggagtactcgtcgcggatgcgcttgtactggccgaacaggtagccgatctcgcggccacccacgttgatgtcgccggcgggaacgtcggtgaactggccgatgtggcggcacagctcggtcatgaacgcctggcagaaacgcatcacttcagcgtcggaacggcccttcgggttgaagtcggagccgcccttgccgccgcccatgggcagcgtggtcagagagttcttgaggatctgctcgaagccgaggaacttgatgacgccctcgttgacggtcgggtggaagcgcaggccgcccttgtatggtccgatggcggagttgaactgcacgcggtaaccacggttcacctgcaccttgccctcatcatcggtccaggccacgcgaaacttcaccacgcgctccggctcgacgatgcgctccagcacgcctgccttctcgtactccgggtgcttctcgaccaccggctggatggtctcgaacacctcgcgtacagcctgaaggaactccggctggtcgccgtcgcgctgttcgacctgagcgtagacgcgcttcacatactcgtcagtgagcataattctccccttaatggttgggttatcaataagacggttttattgtaggtgcggtgtcaaggggcgacaagaaattgctcaggatgtggcgcggatgtgtgcgtcagctgagctgcagcgtttcggcgacttcgtcgacgatgcggtgcatggcctggcgcgcgttgtccggactgctctgccagatcgcttgggcgacggcgtcgtgtgcgtcgagggcttccggcttgggcttttgcgggtacatgtgcagttcgacgcgtccggagagcacggtggcgatgatggtggatagggaagcgaacatttcgttgccgctgttgcgcaagatcagcgagtggaattcgatgtcgagcttgtggaattcgtcgagcctgccgttctcgccggtgtgccggagctccgctgcgagcagggggagccgcgatttcacgtcgatcggcgcgtatcgggcggccgaggtcgctgcggccggctcgatggcgaggcgcagttcggtgagggtgcgcagctgctcctcacggtgtgtggagtgcagcttccaatggatgacctgagtgctgagcgcgtcccactcctcgaccggttgggagacgagcccgatgcgtcgacggacggtgacgactttggctgtttcgaggcttttcgcgacttcgcgtgccacggttcgcgagacgtcgaaccggcgctggaactcggcgtccccacgacggccaccgcggcggcgctttactcccggcaggcttcgcgcggcggcgccgacgacatcctgcgtgtggtctccacgatgcgcgcccaattcggcggccacgtgacccgtgcctgaagcggggcggccgcggaatgccacgagaatgatgcgatagtctgggaggtgacgatgcgcgggttgcaatccgcgcatccgggcgcggacacgagcctgcgcctgcgaatcctctaaccataggaggcgtcatgattgatggtttcaagaagttcatttcccgcggcaatatgattgacatggcggtcggcgtcgtcatgggcggtgcggtcaccgccgtcgtcaatgcgatcgtcaaccatctcatcaatccgctgatcgccatgatcttcggcaagccgaacatggacggtctgcttgcgttcacgttcaacggggcgaccgtgtcggtcggtgcgattctgggcgcattgctcaatttcctcatcatcgccgtcgccgtctacttcttcatcctggtgccgatcaacaagttccgtgacatgtccgatgcgctgctggcgaaggcgaagctcaaggaaagtgaggccgaggacgccgacgaaggcaaggaacccgagcccaccgccgagcagcagacaatcgcgctgctcaccgaaatccgcgaccaactggccaaagcctaaccagaactcgcaccaccgctggcggggctatcggcgagccgactgggcgccggcaatcgcatgctcctattcggcgaactcgctgttttccggggataatgcgtcacgctgcgcgggtaccgtcaccgtgtgcgggggcgcacagcgtgacggcattccggaaccattgcaatcactgggttcttgaagaatgcgtcacgctgtgcgggcgcgcacggtgacggtacccgcacagcgtgacgctctgatgtcgcgaatcgcacctgattccgttctcataggtggcgcgcacttagggacgcaacaacgggttatgcgccccgcggccagggggtggccgaccatgcgaccttcgaccgcggggcacgcgctccgtcagctccgcttacgacggaatgtggcgatgagaccgcctccgatggcgagcattgcggtacaggtcagcgcgaccaggacgctggcaccagtatgcgacaactttgttttgccgttgtctgcctgttgcccatttgtcttgtcatccggcttctggtgggctgcttgatccgtctcctcgtctggtgccggcttgggtgcaggttccggcgtgggctcggggcccggcgagggatcaggctcaggctccggagtctccccaccttccttcgcctgcacgacgaccgtaaaggtcttggaggtagtggctccctgactgtcggtgacggtgatagtgacgtgataggttcccggagtatcgggatccacatcatcggcggtcacattcgccgcagcgagcggcatgtcgccatcctccgcgtcgtgcgcggtcacgccgtcaagcggatcaaaagcgtcaccgaccgtaatggtccggtcactggcggtgatgacgggtgccgcgttgatcgttccggcagcacgcggccgaatcttcagcgtcgtcaacgaatgcggcgtgacggtgaccgtcggcgtcgccgcatcgaacgtgacgctgctgtcaacgggagtcacattatcttggttttccaacgtgttctctgcgttgattgctgcgtccatggtctgcacatccgcgactcggccagacagatcctgcccgaaattcaacttcagcgtgcggccgagcgcgcgatccagattgacgatgatcacgcgcagattgccatcatcatccttggaaaccaaagcagacagagatgttgcgccattgcccaacgtgggcgtcgagccgagcgtcgaagtcagcacgctgtcgccgatgccattgccgagcatctgcagggcatacgcgctcggcgtcaggaagaacccaaaccgcccctcgcccgtcaccgtgcttgcgccgtcttccggcacggcctgaataaccgcctgctgggtcgggccgagcgagtcggcgccgctgctgtaccagtcgatcaggcagtgcttctgaatataggggctgccaagccgaacatattccagcgcgaccttggcgatgtacagcgcgtgcgattgcgaccggaccagcgcgctggtatcgcggaaaatgccgtattcgctgatgaccggcaccttgcctgccggcatgagtctcacatactccttgacgcggttgacgcccgccgtctcggccttcttcatcgcgtcgtcgtaccatgcgcccgcggtggctcccgtgggggttccggaataagggtggatggtcatgccgtcgtaccactggttcgcgttcaggttcgccatgcgggtgatgaaccctgtggactcgtaactggtgtacacgttcgccgtgtgccgtgtgccgtccgtgcgctgttcggccgtgttgatctggtcggtggtgttcttgatggccttcgatatcttgacgaacccgtcgcggtcaacggtgtagctgacataaacctgctgtcctttggccggaatcgcaccatgcacgccgtctccgaacctcagcgcgcccgtgctgtaatcgacctgcacgactttgtcgccggcaccggcggtctccaagtcgtccacgatgcgccactgttcgttcgactggtcgttgccgacccatacgctgacgctgcccttgttgacggccacgaacgacgggtcgtcgacgatcgcgccatcgtcgccgttcattttcgggttgatgttggcgtagcgcatgtaacgggtcagaccggccttgccgtcgctgaccgacgctgccttgttccaatcctccaggctcacggcgtactgcttggtgaagctcgctgtgccgccctccgtgtacgcctgctcgctgccgccgctcaccgcggtggtccagtagccctgcgaggcggtgccgtcggagttggcccacgcctggttcatttcgttgccgatttcgaaatagcgcacgttgtacggctgcgggtgtccgttgtctgcgcgcaccttcgcccagtcgatgccgccgttgggattggtgccgacctgcgcgttcagatattcgatcagatccgccgcgtcctgtgcgttgccgcggccgaggctgtacacatagacgatttctgaatcgacctcgtccgcgaacgtcgcgatttcaccgatgccgaaattcggttcgatgccgccctggccggggttgttgtagaagccgtgtatctgcttgagccgttgggcgcgcggaccgatggtggtcttccagttgaacaggttggaaatcgtgcctccggggtagcgaatcgagccgaatccgacctgcttgtacagtgcggtgaagtcgtctttcacgcgcatcgtatcggggtcgaaactgccgtacccgttgaaggcgtaccgatgattgacgccgaagatggaagcgctgtcgaccgtgcgctccacggtgctggggtcggccgtgagcgtgatcggtacatgcgcctgatacgcggtgatggccgtctggagcgccgtgcccgcggcattcatcgccgtcatccgcgcgacggcgctgccggaggtgttgttcatggcgttgaccgcgttgcgttttgccgtggcgagtgcttgcgcctgcgccgacgcggcgtcgacctctcccgcggccagcagcgcgtcggcctgcgagaccagtgtgccgagttgttttctgacaagggccgtgccttgctcggcgtaaatcgcagctgcctggtcgtcggtgagcgtggcatcatatacgcggatgtcgtccacgtcgcccttcatcgaatgcgggtccatggtgccgatgttcttgtgcgagccgaccagcagcgcggtgacggcgttgacggccgaggttcccatgttcttttcgctgtcgagcgcgccgttgacatagaacttgaccttgtggctcgtctggtcgaaggaaacggcgatatgctgccatccgccgcgtgccaccgtattgttgctgagaacgtcggtcgcgttgacatacgtgtggtactggttggacgggcgcagcgtaagcagggagcggccggcgccatcctgctgcaacagcaccgcaggcttgtcgcctgtcgggtcgagcgtcgtatcgtaccggtaccacatcgcgaatgacgcgttgccggctccggtgttgacgtactggttgattttcatgtagctggacgcgcccgcgccgaagtgcagtacgttgccgaatacgccggaggggtcggcgatgatggagatgtcgtcgccgatgagttgggccgttgcgctgctggagccgccgttgttggccgcttcgcggtcgccggccgcggtgttctcgaagttccatgcgcctcgaaggtttgcggacgcggtggttgctggtgcggtggcgtcggcatcggccgcataggctgcggctcccggcgacagcgccatcgctgctgtggcgatggccgccatgattgagcgccagagcttgccgctccgacggtgtgatgtgatatgcgtcattacatgctctctgcttctgtttcggggatcactgccatgtgatcgttggggtgagccttgcctctgtgtgaaggtctgctcaattctatcaatgcgattccgtgatgcaagtaatggcgtggcgctgaaccggtgagagccggctctgtgccatccgcgtgccattagccctgacgattttggctgattcgagatggaaacgagcagaaagtgcaaatagaaaaaccctcagaatcagcttgattccaagggttctgagagtggagctagccgggttcgaaccggcgaccctctgcttgcaaagcagatgcgctaccagctgcgctatagccccgtgattccgccgttgcggcgttgtcagtgagaaaaaaagagcggctgaagtagccgctgcaattttcctgtgggcccgggaggacttgaacctccgacctcatccttatcagggatgcgctctaaccacctgagctacgggcccgatccatacgcttcaaaagcgcacgatgaactagaataccagaattgccgtatgtgtcaaatccagtcggttttttgtggctttcggcgtgtcgttatcgtcgttgtgtgtcttcacatggcttcctgcgtcgacaatcgcgggtgcgccgataagggacatgggttactgtaggtgatggctatggtgatgtctggcgcatcggcggccagaccgacttcctgcgacgaaagggtgtacagtgcagtatcgatactgttgtggcgatgaagacatgtcattcgatctcattccggaaccgcaatccgtgacattgaacggggatgccgccgattcggatgatgccggagctccggtacccgtcgcgttgccgctcgtaggccgcatctcggaagatcgcgacatcgatgacatcgccggcgttttcccgacccagcttgccgatgatatcgaagcggcgacgggcctgcgctgggacatcgccagcgatgtcatggtggccggactgcccgcgccaaatgccgcgactgcgcacccggttccgccacacgcttcatgctggaagtcgttcatcacattgagactcgacccctcatccctggagccgcaggaataccgcctgaccatcgcacgctccggcatagacgtcgtcggcggcgatacggaaggcgtgcgcaacggcgtgcagacccttcgccagatcatccgtcagtgcgcgccggcgctgcctcgactcgtcatcgcggacaaaccggcgtacaaggtccgcggctactatctcgacgccacgcgcggccgcgtccccacgctcgactggctgaaaacatgggccgaccggctgtgcctgtacaagtacaaccagcttcagctatacatcgagcacacgttcatgttcgacgatctgagcgagacttggcgcggcaccagcccgctcaagcccgccgacatcatcgcgttcgacgaatactgcgcgcggctcggcatcgagctggtgccgtcggtctcgactttcggacaccagtacatggcgatgcgcacgcgcgagctgcgccatctcggcgagttccccgaggacgccgaccgtcggtacggtttcgtggagcggcagcgtcaccacacgctcaacatcaccgaaccggagtccctcgcgttctcgttcaagctgatcgatgcttacatgcagctgttccgcacacgcaagttcaacatctgcggcgatgagacgttcgatttgggtcgcggccgttccaagcccgaagccgaacgccgcggcgtggccgcgatgtacgccgacttcgtatcgcagctgtgccgtcacttgtctgagcgtggccgcgagccgatgttctggggtgacatcgctgtggagatgccgcagatcctcggcctgttgccggataacgtcacgctgctcaactggttgtacgcgccgggcatcggcgaagacaaggtacgcctcgtcgcgcaggccggggccccgcagtacgtgtgctcggcggtatggtgctggaatgcgctgctgccgcgcctcgacgactcgtggaacaacatctcccgactcgcgcgctacggcgtgaagtacggtgcggtcgggtacctggtgaccgactggggtgattacgggcatgtcaacgacccgcgcatggcggtttccggcatgatattcggcgcgcagtgcgcgtggaatccgatggctcatatccagggtgaggccgggtgcggcgacggcgaagaaggctctgctgccggttatgccgatgccgctgccgatgccgtccgcgagaacaaggccgccgcggacggggattccccggcgccgctcccgttgagctcggagagcgacgattacaccggtggcgcggccgacgcgattgcgggcgcgccggccggcggcgatgggtcgtgtgccgagatgtgccgtcgcgtggccgaggtcgaatacggcgaccgttcgggcggcatagtcgaggcactgcgagatgccgcctgtcgtgtggcgttcggctgggatgacatggtctggtactgtgagctggatgaaggcgacggacggatgaatcgcgatgccgcatcggcgatgcatctcggcgtgcatgggttcagcggggaatacgggcgggagtgggatgcccgactgctgggcagtaccgatcttgatgaggctcggcgcacgatgctgcaagggctgtcgccgcatatcgtccgcgcggccgaggcgaacgaggcgctgctgtgcgacgccatgcgactcggcgccgccgccggccgcgcatcgcgtttgggtgcggctcggcgtgatgtgccggcgatgctggccgccatcgaggggcagcgctggttcaacttggtcggcttgtgccttgcgcggcggcatgacgtcatcacggtcgatgccggcgatatcgcccgcgcgtcggccgggttgatcgaaccggacgcaggctcttccgcagggccgcaagccatgcaggatgtctcgattcgagtggcgcgtggtctggagcgctggttcgagacctactgcgacttgtggcgttctgtcagcgcggaatcggaattggcccgcatcgtctccatcgtgtggcgctgtgccgacgccctgcgttcataagcccaagcgcacatcagaggcggggtgtcgcgcggtagtggcatgagccggtcgttgttgccgtgccggcgctcgctggctgagacggcgcgaacatgcgatccatgccgggtctcatatgtgagatccggcatttcgttgtgccgcaaggcgtcgccgcctcgtgcagtggcgtttttcatcgagctgtcgggccagatggacaccttcgcaccggtcagtttgtcgtagttcttgtcgatctgtcgtccgccgtcaaaggttccgacgttccagttgttgttgtacagtcttgcggcgttgaccttgtacacttgcgccgaacgggaccagtacagggcctgggtcgcgttcatcaacgtgtatccgtcctggacgagctcctgcggcttgcggccggcaccataccagtattcgatgacgatgtccttgttcagggagacgttcttggtgttgacgatgccgtcgttccagatgcgcagctgcttgcccttggccttgacgtatttatctatgtcattgatgaagccggtgaacgcatcattcggtgtcgcgccggctccgtactgcttttcggcgaacgtcttcaacttgctgtagttgtcgaagctggtgccgatcatgtactcatcggcgcccatgtgccagtatttcgtggtgaatacgccgtcgtattcgtcaatcagcgtcttgtagaacttcacggcctccgggttggagatgtcgagcttgttgggatccttccggcctgagttgtcggcaagctggtactccgggtagttctccagccagacgttcatgtggcccggggagttaatctccggaatcacgtcgatgccgtagttattcgccttcttgacgaacttcttgacgtcgtcgcgcgtgtagtacgaccatgtggcggccttcttggtgttgtcctcttccggcttgagcttcatctccagcagcacgtagttgaggcgcaggtcggccatgtccgacaggaaacggtcgatccagtcagtggagatgttgatctggcaggcgcacagcgtagcgccgcgctccttgtacttcggcttcgtggcgaccgtgccggcgggcagggtcagctggccctggcgaagcatctgcgagacggaacgggtgccgtagaacacgccgatgtcggtcgcgccgatgacctcaaggcccttcgagccgatgttcagcttgaatccctcatcacccagttcggccttcttcgatgcatccaacgtgagcgagatgtctttgcccgtcgctgaaccggtcgcggccttgatgtccacgtcggtgaacttggtcagctcggatgccaggctctgcgcacgcgcggccagtgcatcgctcgacacgacgcgggtgccttcacccagcgtccatgcgccggtgccgtcggtccagccgtccatgctcgggacggtggccgggcgggtgagattcacgggagccgtggcactgtacccggctgcactatcgtcggcggcgctggccgtcatcgcggtgcacatgccaccgaccatcaggccggctacaatggccgcaacggtacgcacaccgaaacgtctattggagcttttctccattgaaacttcctttattctcttgttgcggttatgacaggagagcttcatcgtctccaatggatgccgagccggcaaagcaagacaaagccgtcacaacatcatcaccgattaaacgtacactgtgttaacaaaattagcaagatgcatgaatgtcgccttgcgttccagccttttccacgcccggcacccatattccacgtcacatcgcgttcatcatcggcttacgctcgttacaaaaccggccgaccgaatttacctggtcacgctacactgctgtgagtaccgaaaccggctgggagccgagcgaaagcatgaacatataaacggaccgtatatataccgcatgatatacgtcccggcacgtcactggaagggagcggcaatgacgcacgaagacggaacgacaccgttgaatcatctggtaaaggtattgagactgggcgacccttccgaataccgcggacatacctacatcagcggggagagcctgtacttccccaccggacgcgtgtacggcgggcaggtgatcgcgcagtcgctgatcgccgcgtcgaagacggtctcgcccagccggctcccccattcggtgcacgggtatttcatcgcggcgggcgatatacgccaggatctgctgttcgacgtggagaccctgcgggacggccggtcgttctcggcgcgcagggtcaacgtgacgcagtccgaagggccgatcctgaccgccatcgcaagcttccaggaacaggggcagtccggagtggagttctccgatacgatgccgcaggacgtgccggcacccgaaacgctcaccagtgccaaggagctgatggaaccatatgccgacaaatcgccgttcgccaagttctatgcaaagaagtcgccgttcgacatccgccacgtcacgccgaccatcatgctcggcgccgacaaggacagcgcggcgcacgactcaggcaagcagctggtgtggatgaaggccgacggcgtggtggacgtgccgcaggtaatgcatcgggcgatgctggcgctcggctgcgatcaggtgatgatggaaccggtgctgcgcagggcggggctgagcatctcgacgcctggcatctcgtacgcgtcgatcgaccattcgatgtggtggtatcgcgacgtggacatcaaccagtggcacctgtacgtgcaagatacgccgaccgccgcgcacgggcgtggactgggcgtggccaaagtgtacacgcaggacggcgagctcgtcgccgcgatggcgcaggaggccatgatccgcgtgccacagcagtgaggccacggacgatgagtgcggcgggtattgaggctggggctgagactggttcggtgccgggaattgcggctgcggccggtatcccggttgcggctggtactgaggctggaccgtcgttggtgtgccattttgaactgccggaccggtctgggcagccgggccagacaccggtacggcattctcgaccttggttccacatttcgcgcagaatttagcgcctgcttcaagtgcactgcccacagtgcatgcagaacttcatgcttttccctctcggatacggcccatcacagaatgtgcgttccgatcagcggaaccgcggattccatgctctctccatggcgatcctattcctgcacctgcgaaacccccgtttatcgcggacgggggtgttcacctattgaaggggcacggagattgccggtgatcagagtgcgggatccgtggtcctgattggcaccggaccaccctcagccgctacgcggcacctcccgccagcgggaaggggcttagtggcgggttttggcggtggcggaggcgatgccgcggcggcgtttggcggccttcatcttggggttctccgggccctccatgggcggcagctggcacagccattcgccgacgataccgatcaccatgtccgccaggcatatcacagcggcgacggcgcattgcgtcacggccgtcgcatagtaatccgcctcgatatgatcgagtaccagcagaatctgcccgacataccagccggccagcgcagcgccggtcagccccagcgccttcgacagcataagcgtgtacacggccttggtcgggtcgagcggcttgagtcgggcccgcttctgcggatcggtggtggcgtactgatgcacctgcagcgccatcaccagcacgacaatgcccagcaacaggagcaccacggacacgaaccatggcgcccccaacaacgaaagccccgaggactcactgacctgcacaagcagacagcccgcgatcagaccgagcagcagcgcgacgacatactgccaccatggggtgcgacgtatcttcattccgtactccctacgatccaagtgtcggacagcagtcccacacggtcggcgtcgggtgccatggccagcagatacgacaccgggtcgccgccgagccgcgcctgcgggtccatgtccatccacggtgcgagcaccgaagcatgggtgcgggctgacggccacggcacccggcagtccggctcatcgcagaccgttcccggcatatccaccagatcgaggtcgacatccccgttcaacgactcctcgacggaaccgagcgtggcaatcagcgccttcgcgtccatccggcacgtcatttgcatgacagccgacatggcatccgacccatgcagatggctcacatgatacagcggtgagatgccctcgacctgatcaccgggaatgccctccaatgcgacaatcgccgtgcggaacagggtttcggcctcgttactgcggctgtccatcgagatgacggccgtatgtatggccggttgaacggtagcggtatcgccgtcgcccggtttccgcgccgaaccgtcgacggttccatcgaattgcggtatgtcggctgcgctgccggacggctgcaccggggcatcgtcggccatgccggtcatccaactgtcgtcgatgcgatgtacgtcctcgcggtcaccggcctcgtgcagcaaatcggcaatctctcccccgtgcgggcccgcgagccgggcggccggatcaagagccagccacggtgccaaaacgaacgcccgctgccacgcacgcggatgcggcaaagtcacattcgggtcctcgctgacgaggccatcgacatcgatgatgtcaagatccagtgtgcgcgacgcccaatgttgttcccgcgtgcgtccatgagcaacttcgatatgctgcaggcggccaagcagactcgccgcgtccagctcggtcgtgacctcgatgacagcgttgagaaaatccggggtaccatccggcatgccccatgcggcggtgcggtacaacggcgatatcccagtcacctgtgtgccttcaaggccgtcgatatccgcgatcgcggaccgcatcgacgccgcgacgtcgcccttgttgccaccgagtgcgatcacggcgtggtgcatgggcgtgacacggccttcatcagctcgaccagttttgccgtccgtattccgtccgctccgccatcgctcgatggtgacgctcacgtcggcgaacggcacggtgatcggagctttgggcttatgcacggtgacggttacgccttggactgcgggatggtcggctatcacggcgtcagcgatgagagccgccagccgctcaatcaagtcgacatgctcgccttcgatgacggatacgatccgtttggcgacgcgcccgtaatcaaccgtgtcatgcaggtcatcgctggaaccggcacgtgacaggtcgagatgcagcacggcatcgacgatgaagggctgcgcgcgctggtgctcgtagtccagcacgccgtgcgtgcccatgccttgaacgccggtgaggcgaatcgtgtccacggttgcgtcctttcgtttaggttggtggtgggtgaccaccccagtcagcttcgccgacggccctccggctgagggagaagggttagttttggtattgtcgccagagggagccgattgtcagggcggcgcggctgcggcgcacgtcatgcacgcggaccgcccaggcgccgtgttccgcgcacagggccgacaatgcggcggtggcattgtcacggtcgtccatcgtcggctcgccgatgccggcatcgttcaacgccgccgaaacgaaccgctttcgggaggctccgatcagcaccggatatcccgaccgcttgaacagatccagtccgacgagcagcggcagattatgctcgataccgggcttggagaatcccagaccagggtcgatgatgacccgctccggggcgacaccggccttgagcaccgcatcaacctgagacatcagctcgtcatacacgtccttgagcacgtcgtgttcgtagtgcgaggtgtcggcgtccggcgccgcgccgcctttcgacccggccagccagccacgccaatgctgtacgatgtacaggcagtcatggtcggccaccacgtgcggcagatctcggtccagtcgtccgccggacacgtcgttgatgatctgcgcgccctcatccagcgcggcctgcgccacggcagagcgtgtggtgtcgatggagacgaccgctccgtgggcgatcagcgccttcgcggcaccggtcacacggtcgagctcgtccttctcgctgacgcgcttggcgccggggcgcgtcgattccgcgccgatgtcgatgatgtcggctcccgcatgcagcatgtcgtcgccgtggtctcgggccttgcccggatccagccacaggccaccatccgaaaacgagtcctcggtgatgttgagcacacccatcagcagtgtgcagtcggtatcatgcaaccgctgcagttcagtcatgaattctcctctccgtcaatcgccgaaacggcggcgatgccgaccagtcacggcgatgagccggatcagtgcttggccatgatcagactcattgcctcggcacgggtggccggggtgcgcatcacgccgcggaccgccgatgtgatggttcgcgacgcgggcttgttcacgccccgcatcgccatgcacatgtgctcgcattcggtcacgacgatgacgcccttggcgtccgcgtattccatcagcgcgtccgcgacctgctgggtgatgcgttcctgcacctgcgggcgacgcgcgtacagctccaccagtcgggcgagcttgctcaatccgacgacctgcccgttggacgggatgtagccgacatgcgcgacgccgtggaacggcagcagatgatgctcgcacaccgagaacagctcgatgtcgcgcaccagcaccatttcatcggtctcgaccgggaaacgcttggacagcacctcctgcgggctgcgtccgagccctgagaaaatctcctcgcaggcacgtgcgatacggtcaggcgtctccagcagaccctcgcgatcgggattctcgccgatcgaagtcaggaacagccgtacggccttgcgcacgccctcttcgtcaatcgccatatatcctccagcttccctcaccacttatatagtcgtcatgcccgccgaaccggggcaggcacaccgtttgccgtcaaacggcaaacgcccgtgcgcccggcgagcccctttgcgggacagtcgggcgcacgggcacgaaatcaccgctcccccggcttcatgccgacggaacgtttgagcgactccggaatctccaccggaggcttgtcggaatcgggacggcgctggtcggacagccacaccggacgttccggagccttcctgatgttcgcgaagatcgcggccagttccttctcattcagcgtctccttgacgagcagctggcgaaccagctcatcgagcacatcgcggttgtcgttgatgatgttccatgcctcggtgtgcgcggtctcgacaaggccgagcacctcctcgtcgatgacctcggcggtgcgctcggagtacttgtgcggcgcaagaccatcgaaatcggcgctctggtcgtcggtgtcggcccacttaatggcgccgagcttcgaggagaagccgtattccacgaccatggtgcgggcgatcttcgtcgccttctcgatgtcgttcgacgcgcccgtggtcggatcgtggaacacgacctcctccgcggtgcgtccgcccatcgcgtacgccatctggtcgagcagctcgttgcgcgactgcgagtaacggtcggtggtcggcatgaccgcggtgtagccgagcgcacggccacgcggcagaatcgtcaccttggtcaccggatcggtgttgtgcagtgcggcggcgaccagtgcatggccgccctcgtggtatgcggtgttgcgcagctcattgagggccatgcccttcgactgacgcttcgggccggcctggacgcggtcgatggcctcgtcgatggcacggttgtcgatcagctgtgcgccggcacgggcgcacagcagcgcggcctcgttgagcacgttggccagatcggcgccggtgaagcccggcgtgcgcacggcgaccatgtgcagatcgacgtccggcacgaacggcttgcctttggcatgcaccttgaggatggcctcgcggccttcgaggtccggcgcctccaccgacacctgacggtcgaagcggccggggcgcagcaatgccgggtcgagcacgtcggggcgattggtcgcggcgatgatgatcaggttggtgtcgctgtcgaagccatccatctcgacgagcagctggttcagcgtctgctcgcgctcgtcgtgaccaccactcatgccggaaccacgcttgcgtccgacggcgtcgatctcgtcgatgaagatgatggccggggcgtttttcttcgcctcatcgaacaggtcacggacgcgggaggcgccaaggccgacgaacatctcgacgaagtcggagcccgccatcgcatagaacggcacacccgcctcgcctgcgatcgcacgggcgagcagcgtcttaccggttccgggaggaccgtacagcagcacgccgcgcgggatgcgggcgcccagggccttgtacttcgacggatccttgaggaagtccttgatctcctcgacctcctgcacggcggagtcctcgccagccacgtcggagaacttggtggacggcgtctggccttcgagcagcttgccgttgttcttcttgccgcccatgccgaacatgccggacgcgccgcccatgcggctcatcaggaaccagaacacggcgatcatgatgatgaacggcaatatcgagctgatcaggtagctgaccatgctggtctgctgcatgttagaggtccaccccttggaggggtcggccttctcgaccgcctgcacgacctgcgcgccctgcgcgaacgtgtagtagaactgcaccttcttgccgtagttgtgcggcttgttcgtgtccggatcggtcttcgtgaagttgctcttcagctcaagctgcaccagctgcttgttgtcgatgatcttggcatacgcgacgttctcggtcttgagcagggcgaagccgtccttggtgtcgatggtctgcgtgccggcgccggcgaacagctggaagccggcgaccgccatgaccaccagcagcacgccccacagccacggggacttccagaacggctgcgggccgcctgagttgtttcccttctggttgccgttggggtcgttgggcgaattgcgtttgaacgggttgccgttgccgcggttgccattgccactcggcggcatctgctgagggccttgaggatagctcatacctgattattctccttgatacacttcgggcttcaacacggcgatggagtcaagattgcggaatcgctcgtcatagtccaggccgaacccgaccacgaactcatcgggaatctcatagccgcgataccgcacgtcgacgtccacttcgcggcgcgacggcttctccagcagcgcgaatatctccaccgacgccgcgccgcggcgcttgagttcctcgacgagccatgccaaggtacgccctgaatcaacgatatcctcgacgataagaatgtgccgaccgcggacatcgcaggacaggtcctgccgtatggcgatcgtcccgctcgattcggtgcccgacccgtagctcgaaagactcatgaaatccatctgcacgggaatgctcagcgcctgcgagaacgcggcgatggtgttcacggcacccttgagcaccgcgatcagcagcaggtcacgcccctgatagtccttgcttacctgcgccgccacctcgtgtatcttgcttgcgatctgagccttggtgatcagctcatggtcgatctcgtcttgaacatcagcgatttgcatggagaccatcttggcacacgcgaatgacgtgtttccgacgaaatgctgaatgaccgctgggaagtgccacggcaccctgaccgtgccactgcgagatcagccggtcgacggcgtcgacgtgacggaacccggcctcgatgccgaccgccgcgagcgcgtgcgcgatcacgcgcaatctgatcgcccgcggctcccgcgccaacgctttcgcgtcgatccgcagcagctcgcagtctccgtcgacgctcccgcacgaatccccggcgaacgtcaccgcgtgcgccgcaaccgattccgcgataccgtcgagatacgacttctcgatggatgcgagttcggcaccgtcacagaacctgctcacgatatcgccgccggcgaacgcgttcagatagggaatcagcgtgtggcggacgcgcgagcgcagcgggaaatcgtccggcaacggttcgtccgcagccatatggtcgccgttggtcgggtcatcccaccatgtgatcccgaggtcctcgcagatgccggtcgtgtccgcgcgggtcagacgcaggaacgggcgggcgaaccgcacgccgtcacgctcgacgatccgcggcatccccgcgagcgcatccagtccggaggaccgcagcacatccatcagcacggtttcggcctggtcgtcgccggtgtgggcgagcagcacgcattcggccgattcccgtcgggccgtatcggccagcgcacggtatcgcgcgtcgcgggccgcggcctcgacgccgtgaccgtcccccgacacttcgaccggcaccaccgcgaccgggtcgagccccagcccgcagcatcgccgtgccgccgactgagccacctcatccgaatgctcctgcagccgatgatcgaccacgacggccccgcatctgatgccccacgacgcacacacgatgccggccaccgccgccaacgccatcgaatcgcgaccgcccgagcaggccaccagcaccagcggggcatcgggcgcgggggtatggtcgccgtgctcggcgaagcgcggatcctgcctgggtagtcccagatcgaccagcatggatcgcatccggccgatcgcggcacgcatcacagcggtatatggcatgggtcgaaacctttacagcttggccagtttggcggccatcacgtttatcgccttgatggccgaccactggttctccgggtcgttgacgatcacggcgaacgacagcacgccgcccttgacgcgggacacgttgccggcgagcgaggtcacggcgtcgaggctgccggtcttcacgcggaacaggccgttgtccgggccggtgacgatacggttcctcgccgtgccgaccaggccggggatggacagtccctccgccgccgcggtggcgatgccggcggtgagattgcgctcctgtacctcgatcagcgtggtcacgctgaccttcgatcctggcgtcagaccggaacagtcggccatctgcaggccggacgtgtcgatgccctgctcggcgagcgtgtcggcgacggcctgcgtgtcggtcttgatgctgttgccggcctgacgcttgagcgccgtcagacggccgaatagctgggctagcgtattgtcggaatgcctcagcatgaacgccatgacctcgttaagcggcgccgagctgaccgaggccagcgctgaagtgccgcttggcgccgcgcccgcggtcggcccggacgtcacggtgatgccgttgtcggcgagccgcttcgcgaaggtcgtcgccgcgtccagcgcaggctgttgggacagcaccgggtattggctggaatcgtcgggattggccggcttgaccatatcggtccaggtgcgtccgccgtcgacggccatcgtggagatcgccgtatagtaccggtgctccgcgttgttttccgtgacgccagccggcgtacgatcctgcccgaacagcgaatcgtcgtacagcaggtcgacctgcgtgatgccgcgctgcttcaacgcctcggcggtgcgctgcgccagcgtgcccagcccggcatggccgttgatgtgcgagggatcgctctccccgtccgacagcagcatgtcgccctcaccctgcagcaccacggtcttgcggttgtcgtcgccctggatgagataggtcttggtgtcgagcgtggagcccatgtccagcgtggtcgccgccgcgaacgcggtcagtgtcttcagggtcgatgcgggctggcggggaatcatggcgtcatgctcggctacgatgttgcccttgccgtccgcgatggccagcgagaaggatttgcccacgccctcgctggcggagaactcgtcgaggatggtcttcgcggcctgggcgtcgacgggcatggacgcgtcgacgccggcggcgaccgtgccgcccgtgagcgcgtcctgcgggtcgggaatcgcgacgctgtccactccccgcaacgtcaggatgccgggtgccacgtcatagatgtcagccacgaaataccccgccatcaccgcaacggcgacgacggcggacaccgcgacggtgacggtacgccgcgtcatcggcagatgccgaatcatatgatgtcgggccgcagcctttgatgccacgagcgaactccttagacagacgttacatcatcgccgcaagggcgccgcccgaaccggctcagcgctgcagcgacgcgaacgaatccaacgtctggacgacacggatcgcgcgcgcatccaacagcttaccgccaagccatgaaccgatgaccatggccgccacgccattggcgagaccgaccggcgccatgacccatagccaaccgcccatatcggccacaacgagcacgatcgcgacgagaatcgtcggcagcatcggaatcagacagccgaaaagctgcacgaacgggaacaatccctgggcgacggcacggccctgcggtgtggagaacggcttgtccatcgacggcaccggatacatcagcgagcagttggtgatctccgcgacgccgatgctgctgaacgagacacccaacgccagacagatgaacgtcacgcccaggagcaggccgtcagccgtgcgccaatcgccggtcaacacgaagcaggccagaccgagcaccaccatatatatcacgttgatggacgcgaacacccgcatgcgggaccgacggtcgtcccagccgcgcacgccggccagcacctccatcgtgaaaccgcggccgtcgtatgccaggccgttgccctcggtcatctgcatcatccatccgccccagatcagaccctgccagatcacgatcgtgacgccacgcgactggagcgcgaacaacgccacgaacaggacgggcatcacgaacagcaggatctgacgcgggtcgcggcgcagatacgtcagcagacgggcggacatcgcgccggacgtgctgtccggcatccagccgaacgcgccgatgccgcggaccttcgcggcacgctcgggcgcacccgcggtcacgcggtcatgacgcaggcaccagacacagccgacgaagcacaccacccacgtgacggccaggatcgccagacgagccacgaacaggagcgggttaccggtcaataggtcgtacggcaactggaacgcggctccgaacggggtccagctcagagcgtcggccacgctcagatccgtcaatgacggaaaatcatacagactgccggaatcggcggggttgtcgatgatgttcggcagctggcacagcacaatgaacacgatcatcgcgatgaggtagaacgcgttcttgccacgtttcgagcgcaccagcgtcgtcgatgccgaaatgaccagcttggccagcgacatcatcgtgatgatggccagcggggcggcgatgagctgcatgacgaccatgcccacactcatccaccggtatgcgagggaccacagcatcagtgccagcgtgccacagatcgcaggcagaccgctcaggccgccgagcagcatgccgagctgcagtttccggtcgggaatgccgtacagcgcgaaccggtgcggagccatggtcgagccgtcgccgacgagcatcaactgaatgaacaggatgatgaagccggcgaacgtcgacccgtacatcaccgcgacgtgcagcaccccgtacatccaccccgcagggatgtgatgacccgccatatcgaatacggggccgccgaggaaccacgcgagagcgccgactcccacaagggcgccgatgccgaatacgatgccgagcacatagccgatggtctgccacgtcgacttgcgcagggtggcaagggtgagcgcccagcgcagacgcaccatggtcaaagcgacttccatcatgactcctcgggcgatgggaacggggcggtgggcgcagacgagtcggcaggggcgacgccgttcgccgcgtatccgccgtcgagccacgacagcttggccgcggcatgccggccgccgaccagctgtaggaaccgctcctcaaggtcctcgccggccgacacctgctctatcgtgcccgccgcgcggacctgcccggcgttgatgacggcgacgtgcgtgcacatcttctccaccagcgacatcacgtgcgaggagatgatgaccgtgccgccggtggacgcgtactcggcgaggatgtccttgaggttcgcgctggacaccgggtcgaccgactcgaacggctcatcaagcaccaggatgcgcgggctgtgaatcatcgcggacgccaggcagatcttcttggtcatgcccgcggaataatcggacaccatcgtgtccgcggcggaaaccagatcgaaggcgttcagcaggtcgccggcgcgactgtgcgccacatcgcgcttcatgccgcgcagcatgcccgaatagatcagcagctgcattccggtgagccggtcgaatatctggtcgggctgcggcatgacgccgatctcacgtttggcggcgttgacgtcctgccacacgtcctgcccgaggatcatcgcggtaccggcgtcgggaaccagcaggccggtcaccatgttgagcgtggtcgtcttgcccgcgccgttcgggccgacgaggccgaaaaacgagccgaccgggatgtcgagggacagtccgttgaccgcaatcttgcggtcgaagcgcttgtacaggccgcgaatggagaccgccgcgcgcgggtcgggcggcggcagtgtcgcaaccgcgggacgggaggggacggatgacgatgccgtacgcgcgggaaaaccgccaatctgcggctgattgtctatactcatgactcaagcatagaccatgcagcggtatagaccaatcatcccgcagatcgatgacgggccggcggcagccagcatcggcccggccggcggagccagacatcgctgccgaacgccggtcgaagcacggtccaaaaccgctcagcccttatgcacgattggcttccactgagccttggagaagatggcctggaacgaaatcggcatgtaactgagcatgtagatggggaaactcagcacataggcgaacagctccttgttggtggcgccgatgtggtcgcgttccgcgacgatcgtcaatgcggccagcgccatcatcgtcacgaccgccagcacgatgtcaaaggcccatcccgcaatcgcactgagctggctctgccacgtcacgaatccgaacgccacgaacagcaggcccagtacgatgcggatgacgcccagcaccgtgaacgggcatagcagcagggtgaaatcgacggacgaaaaatcacgctcacgcacggcccgcttgatcagcgccatgccgtaataccggaacacctgcaggaatcccttgctccagcgcagtcgctgacgccagctctgctggaacgtgaccggctgctcgtcgtacagcatggcggtgccgcagtatccgatgcggtcgccgtgcaggatggagtccatcgtgaattccagatcctcggtcagcagatggaatttccatcccctgttgcgccgcatcacctcgcgagaaaacatgaatccggtgccgcccacatgacagctggagccgaggatcatgcgcgaattgttcaggaatcgcgactcgcggatgaaccacagggccgaaccggacgacacccagttgtcggccagattgaccgaattgcggtagctggtcaggatgcggaaaccggactggaaggccttgttcatctcctcgacgtaatgacggtcgagccggttgtcggcgtcgaacacgaaataggcatcgtagtcgtcggccacacccgagtcaatcatggtgctcaacaggtacgacagcgcgtatcccttgccgatcagctccgtgtcgtggcgttcgacgacatggcatcccatctcgcggacgacttcggcggtgcgatcggtacagttgtcggccaccagccagatatcgatcagcttgctcggataggtctggttgtgcagcgagtcgatgaggttgccgatgacgttctcctcgttgcgcgcggagatcaacacggcgtagcgcttgtccatcggcgcgtccgggaagtgcaccggcttggagaacagagacatgatgacgcagatggcctggtagatgatgccgacgccgcccaccaccatcataagcacgtcgattacggtcagcaatgccatcagcgccacctgcttcgcggattgtcggtagacccgtcaccacggcgtgggcgggcggtctttgcgggacggtcggctgccggcttcgcggcggtgccggatgattcgctgtcggacagtctatcgaaggaggtcttcgcggcgccgggctctgcagagccgtcgctgctaccatcatcgccatgcgcctgtgcggtaccgtcaccgactccgcgcaatttcacggcgttgcccgacttcgccccctcgcgcacgctgcgcgacagcacgtccttcggtatggcaatcgtttcggaatcctcggtctcgttggcctcgtcaaggtcatatatctggtcgcgcagcgcacgtagctcgtcgctgatcggcacatgggcgctcgatcctttggcggcgcgcggcatatggtcgctcatcggcttgatcacgcgctcactgaacgcctcggcgccctccacgaccttggacttcttccccggcatcggatcgctcatcagcggcgactccaccagcgcatagcgcttcgtgtacaccttgaagatggcctgcatgctcgccgtgaccggcagtgcgaggaacgcgcccagagcgccgaacaacgcgcccatcaccagtacggcgaggaacgcgacgcatgggttgaggtccatcgtgcgctgcgagaccttcggcgagagaatcaggttctcgatctgctggtacacgatgatgaacaccagcacaccgaccccgtaccacaggccattcgacccccaggcgaacagcaccggcagcgcgccgccgatatacgtgccgaccgtcggcacgaactgcgacacgatgccgcagaacaacgccagcggcagccaatatggcacgtggataatctccaggaaaacggccgtgcaggtggcgttgatggcggccaggatggagcgggagaacaggaagccggaaatctgctcctgcaccaccgtccagccgagcaggaaacggcgctgcgtgttcggtccgagccactggcacaggctgcggcgcatcttcgggcccgcggccgaaatatagtacgtcaccatcaacacggtcagcagattcaacaggaagctgaacacgcccatcgtggtggtcaacgcctgaccggcgaaatcggtgatccacgacgtctgcacgttcttgaatatctccatgccgaggttctctatcttcggcatgtcgaacgacgtgtactgcttcaccgcgtccacgatctccgtgtatatcgacgggagccccttcaccatggagatcagctgctgcacgaacatgttgccgaacagcgtgagcaaagccatgacgatcacggcgaggccgatcaggctcaccgccgacgcgaggccacgcttccagccgtgtcgcaccatcgagaccaccagcggctcgaccgccagcgcgatgaatatcgagatgacgacatccagcacgatggtcgatatcttgccccacgatgtccacacgaaaatcgcggcgaacaccgcgatgaccgtgtacaacagcgcgcgcccccaccaatccggcggtcgacgcgaatcccctttggcggggaacaccgacgccaaatccagtttctgatcatccgtttcactcatgagaccctattgtagccagcgggagtgtacgcacaggtgcttatcctataagtatgctcaacgtttcgattatcatccccgcgtggaatgaggaggagcgcatcgccgactgcctgatgaacgccacgcgccagaccgtcgcaccacatgaagtgatcgtcgtcaacaaccgttccacggaccgcacctgcgacatcgtcgaacagttccagcgcgaccatcccgaagctccggtcatcctgctgcagcagaacgaggatcaaggactgatcccgacccgcaacttcggtctgaacgccgcaaccggcgacgtgttgggacgcatcgacgccgactgcatgctcaaacccgactgggtggaggtcgtgtccggcatcttcaccgaggatccggacgccatgggcgcgaccggaccggtggtgtattacgacatgcccgcgaagggtgccgggctcgccggcgacgaccacatccgccggcacacgtaccgggcggacaacgatcaggtgctgctgttcggttcgaacatggcgattcgcgcctcagcatggcacgccatctcgggcgaggtctgccgcgacccggaggacgtgatgcacgaggacatcgacgtgtcgctgcatctgctcaaccatggtttcaagacggtgtactcacagtgcatgatctgcggcatctccgcacggcgcatggacacgtccttcgcgtcgttccaccggtacatgcaacggttcaagaacacattcgccgcacatcccgaccattggcgcgagcaccacaccgagcggcgcctgtatgcgctctacccgtggctgcacatgctgtacccgatttatcagcagcatctggccgcgaaggacatcaacccggccgagaagatctggttcgacgagcagatcaagctcgtcaagagccatttcgacaatcccgagcaggtggacgccgtcgaatgacgtcggctgacgccagccgacagatgatggtggggttccaacacggtatgtgccggaaccccaccatcatctgttagccgcatccgttgcggattatcgcggctttctcccgctcacggggccggccggcggatggacgcgccgccgcggaccggtcccgtgtcgctctatcacatcagcgaggtgtagatcttcaggatgtcctcttcggtggccttgcgcgggttgcccggcgtgcacacgtcgttgaaggcgtcgtgggcgagcggtgccaagtcggcctcggtggcacccacctcggaaatcgtggtcgggttcttgagatccacggtcagctggtggacggcctgcacggcctcctcgcgcaccttctcaaggtcgccggtgtaggcgtcctcgataccgaacgcgtcggcgatgtcacggtacttttcgccggtgaagtccttgttgtattccatgaccggggccagcaggatgccgttggccacgccgtgggccacgccgagacggccgcccagcgggtgggccatgccgtgcacgagacccaggccgacgttggagtaggccatgccggtgatgtaggaggcgtaggccatctgctcgccggccggcacgtcgccgtcggcggacttggccaagttcttggcaatcatgcggatggtctgcatgctcaggcagtcagacaggctccatgcgcccggggtgatgtagccctcgatggcgtgggtcagggcgtccaggccggtggcgaccttcaggccgcgcggcatcgtgtcggtcaggtcggggtcgacgaatgcgacgatcgggatgtcgtgggggtcgacagccacgaacttgcgcttgttggcggtatcggtgaccacgtagttgatggtggtctcagaggcggtgccggcggtggtgggcacgccgaagatcgggacggacgggttcttggtgtcggccacgccctcaagggacagtacgtcggcgaactccgggttggcggtgatgatgccgatgcccttgcaggtatcctgcggggagccgccgcccaggccgatcaggaagtcggcgccggattcggcgaacttcttgacgccgtcctggatgcattcgaccggcgggttcggcttgacgttgtcgaacacctcatacggcaggccggcctcgtccagcacatcggtgaccttcttgacagttccggtcttcagcaggatcggatcggttacgatgaacgccttggtgaagccatgggacttcgcgaccgccggaatctccttgatggctccacggccaaaatacgcggtctgattgaagatcatgcgatataccatgctggctctcctttgaatgacgcgcgggcgttgcgctcggcgtatctgctatgacgattcctatcgtacctcgaaaactggaaacatgctgggaaggtaacgcaaacacagcagagaacagttgcggtatagcgctgtagcatacaatcgcccccgcggccttacccctacgaaaaatcccatttgtcaccgcgtaagtttcttcatcgcaagtcccacaaagcagtacatgccgtaccacattatgagctgccccgcatcccgccgccctcattcatcccgccaaagtcccatccgcacgggctgaaacgggacttcgctcggactagacactcggacgacacccccatccggccaaaatccgtttggcgcggcgcggatgcgaccatacacggatgacgtggccagaatgctcatgctggggacgatgcaaagaggcgatttcatgcctgcgcatcaatcagacgcccggctgcgctccgctcaggaatgatgcacggcactcgtcaccttgatggcggtccatgcgccgcgtacggccagcaatgcaagccatgcggcgaacagcagcgagccgacacgcggcgaaatcagcccggcgatcaacgtgcccaacggcgccgtctgacatttccgcccgcgccacgcttgctcttgccttcttcaatcatgctcacgggtttactctagcgcgggtaacgcctccaaccagcaccgggtgcaaattacgggttgaaatcgccgttctgggcaattccccgtgccaaatcgccgttttaaggtccaaaaacggcgatttggcacggggaatcacggattgcggcgatttcaacccgtaatttcgggaagagtggggaaaaaagagaccgggaggagggagggcgctgggggcatgcaggaccgagacgcatgctggccctagctcacgcaatcaggtaagacccatgacccgcccgacttctcgaccagatgcaagaaacccgccatcccaatgtttccaaagggtgacgggttttccgtggtggctccgagcggcatcgatccgctgacctagcgattttcagtcgctcgctctaccaactgagctacagagccagtgaacataaaaacccggcgaaaaccgggtcttcacattccagcgaccccggccggacttgaaccggtgacctccgccgtgacagggcggcgctctaaccaactgagctacggggccatatgcttgtttgcaagcaacgagtagatatattacagagttctgggcgatatgcaacttcggcgtgtcgcagcgcccgcagagcctcccaggcaggcccgaacaccaccgaggatgaacctgaatcccagtatttccagcacttcccgcacctaccctatcagcgccgccaacggcatgatcgcaagactggtgaaggcggagtcgccgtaatccttgtagacacaatcgccgttgatgcagtacgacccgttccaggtttccggatgattcaccatgtatacccccaccgcgatcgcaaaaatgatggtgatgataacgatcacgatggcaatcgcactgatgacgatgcccgctatggcgaacgccttgccgcgctcctgcgtgcggttgatctgccgcagggcgatgatcgagagaatcagtccggccgggcagaacacgaacgacaggacgaacccgacaatcgacatcgtgttccatcgatcgttcggcgcatagtacgccggcacgccataggggttcgcgccatacggaggatacggaggatattgcgcagcgccatagggagccccgtactgtggctgctgggcgccataccccggtgctccatagctgccggtctggctgtgctgaggctggccataccctggctggcccgagtacccggcctgaccataatccggccggccatatccggtctgaccatactcaccctgaccatacggcggcacctgaccatccgcggcaccggcacccggagcccacgaaccatcgcccgcctgctcatacccggcctgcgtcggcacctgcccgtcattaccgtcagtcggcatggcacttggcgtattcgatgacatctcaggactccttcggtcgctatcgttcccgccgccgctcaccgcccggcgctacgccagtatatcctgtcaacgccttcatctcaacgccaaggcatcacagcgccatccccgaaccggcgcaatacgatcggacagaccagggccggccgcaccgccccatccgcagacgaagcgacgcgaaccggccccgtattcggtcgagtcaccattcagacggcggtacgtccggccataagccgaccgtcaacgcccagcagcccgaccggtcacccagacacccggccacccgttcagccgacctgcttccaggtggcgacgtcgatgtggtgctcggggttggcctgccacgcatcccacgcggacttgacgatgtcctccacgtcgtacttggcgtgccagcccagctcctcgttgatgcgcttcggagagccgatcaggtgtggcgggtcgcctgcgcgacgggccatcacggcctcggtgaacggcaggcccgtgaccttcttgacctcgtcgacgatctggcgcacggaggtgccctcgccggtacccacattgaaggcgtcgtacttgcgctcgtcgcggtcaaggtacttcagcgcggcgatgtgagcgtcggccaggtcggagacgtgaatgtagtcgcgcacgcaggtgccgtccggggtcgggtagtcgtcgccgaagatggccggcgccttgcccttcttcaggcggtcgaacagcatcgggatgagattgaggatcgcggggtcctccagctccaccggaccgcatccggccacgttgaagtagcgcagcgcgcagaagcggatgccgaacggctgctcgcaggcgcgggccatccactcgccgaacagcttggtctggccgtaggggttgatcggcagcatagggacgacgtcctcgggcaccacgtcgaccggcggcacgccgtaggtggcggcggaggacgagaagacgagcttcttggcgttcttggactgggtcatgccggtgagcacgttgagcatgccgttgatgttctgctggtagtaccacagcggcttctcgacggattcgccgacctgcttgcgcgcggcgaagtggatgacggaatcgacgtcttcggcgtcgaggatctcggcgaggcggtcgccggcgcccggcgcggcgatatccatgccatacaaccgcgcgccttcgatgcgggcgggctttccgtagctcagatcgtcgacgacgacaacgcgttcgccggcttgatggagcgcatggacgacgtgggcaccgatgtatccgcacccaccggtaacgagaactgtcatgtctgtcctttcgtgaccgtgagcataaccatcggcatccgcgacgactgaccataaccaatggttaacgatagttgaatgtttgattatgctcgcttttgttattttttcgaacagttttatcgtagcacatgaacataagagaacaaaatatgttcattgaaacattaccgacattccagaccatgcacagatgacaggcgagacggcccctcgaagcacggcggccacgaaggaggtcaacggccccgggataatatggcacataccacgaccgaccagaaacgaggaaaccgtgccagagcagatcgaacagccgactttcaccccgcgtccggtactgtcgttcgtgcggcgatccggccgtctggacgcgcggctgcaacgcgcgtgggacaactacgccgacacgtatctgctggacatcaacgccggcgaggggtcgctggacgtgcgcgacgacttcacgctcgaccgcgacaccatcgccgtgacctggggcaacgccaatccgctgatcgtcgaaatcggcaccggacaaggcgagaacatcgtcgccgccgcggccgcgcaccccgacgtcaacttcctcgcgctggaggtgtacgaccccggcgtcgcgcacacgctgctgctcgccggcaagcagcggctcggcaaccttcgcatcgcgcaggtgaacgcgcccgaactactcgccgcgaccgcccccggctccatcgccgaggtctggacgttcttccccgacccttggccgaagatgaagcaccacaagcgccgcatcgtgcagccgcagctcgcgcagtccatccacggcgcgctagccgacggcggggcgtggcgcatcgcgaccgacatcgaagactacgccctgcacgtgcacgaggtgatggacgggcgcacggacttccgcaacgccggcacaatcgccgtcagcctgcccaccgggcacgtcggcaagggcaacgctgagctcgccgacgacatgccgcacgccgatttcaccgaatcggagcgattcgacgaccgggtgctcaccaatttcgaaaagaagggactcgccgcgggccgggtcatccacgacctcacctatatcgcggtgtgacgccgattacggcgtgtcgcggatttgcattatcgtcgcagctcacgtaatgtatatcgagttgtcagcccccatcgtctaacggttaggacaccagactttcaatctgacaacgagagttcgactctctctgggggtacccaccggctccggtttccacgaggtatcgtggcccggagccttttgtttccaacggtttcaggccgtcagcttggccttcagctgctcgaacaggaaatcgtgcggtggtcgctgccaccaaagatgcacctaagttcccctctcccagcatctgacgcatgagcgtgtcgtccagcagggacgtcacgggcacgccgaagtagtcggccagcgccgcgatgtcggggatgctccacgtgttcttgttcttcatcttcgcgctgacgccgcccctggtcatcttcaggggttccgtgagcgccgtctgggacaggccgtgcgcggtgagggacgcggagcagaggacaaattgtcccggaatcttggacagaaagtcacccaatagacaagtgataaacaattctcccctcatccccttcggggatgctcccctcaacgccgaatcagcctccacgaagccggtcgctgatccgaagcccgaacccattccggcgaccatggccgatcgcaaggccgtccactcgctgctgatcgacaggccgtacggcgagatcgtcgcgacgatggactgggcgtgccgatctacagggcgacgctgctgcgcacctcgttgtgtcaggaacacatcgaaggcgtcatctcgcaggaggcgtgcccggtatgcgcatacgacaaacgcaaccacgccacccacggcgtcgccggacggcgcaaggcgaaagccggcgcgcaggcagaggcggtgcagccatgagcggggacaggcagcatcttgaggcgtggaagaaggccagcgaatgccgcgacttcccgcaaccatggtccgactacctgtggtcgctggagttcgagcaccgtcccggcgacgcgaaggcgttcatcgggcgctttgcggctgtttgcttatcttggtcgaaaatatcctacccaaaaagcgctcttctcttactccctcaacaacccaacggagaaacccacccacgagaacagcaatagcgcccaattttctcaccttctatttccttcaaataagaacggcgggctcctttgacaaggagcccgccataatccttttatcagccgccaccaacgcggtatgcggtgcagatatcgggatcattgacttcggaaatcatgaacgcttcatcctgcatgattcacctcagctcgaccctactgcttgtcggcttcctcggaggcgagtcgtccttcgagctgttcgacgatgtgggcgtgcatgttctcgtcgatcttgacggtcaggaggaagacgacgaggctggcgacgatgccggcgagcggcaggtagtaggcgcaggtcttgaacgtgcggatgttcgcggcggtcatgtcggcggctttggcgttgccgaccattccggcggcgacgaccacgaagcccacgatgccgttggacagggcgccggcgatcttgtcgagcatcgggcgcacggagagggtgacggcctcgttgcgcttgccggtcttgagctgtccgtattcgatggagtcggtcatgctcaggatggcggtcatctggatggtctgcgcaggcaggtagaagaggacgagcgcgacgatgacgacgggcaggttcatgggcgcgatgatgaacagcgtgtagccggcgatcatgagcgccatgccggcggtgtacagccagcggcgcgggatgcggcggttgagcaccgggtagaggggcgtggtgcccagtccggtgatgaccgggatgatgccggcgatggagaagctgtccggagctccgagcacgtacttgaactgataaaaaagcacgccggtggtggcgacgttggccacggagtacagcagatagctgagggccacccacaggagctggtcgttctgggcgatggccttgaacgcctcgatggggttgccgttggcctcggccttggcgcgcagcccgccttggttctctcgggtgccgaacgcgacgctccacgcggtgagcaagccgagcacggcgatgatgatggcgaacgccgcccagccggtgcggccctgctcccactggccggtgaacttccaggtgaaccagctgacgacgggcacgacgatgacggtgacgccgttgtagccgatggatccggtgaacgcgccgagcgcggtgtacgtgctgcgctcgtgcgagtcggaggagatcgcggggatcatgccccagtaggagatgtcgcgcagcgagtagatcacgtcgagcaggatgaacacgatgacgaacaggaccatgaacacgccggtgttcacgtccacgaggccgaacaggccggtgaacaccatgatcagcaggatgccgggcacgatgccgccgatgaactgccacgggcggaaccggccccagcgggtgttcgtgttgtccacgaggttgccgagcagcgggtcgaggaagatctccgcgatgcggatgaccaccacgagtccggtgatcaccgcgatgaggcgtttggcaagcgtcttgtccacgtcgatgaacagcgcggtggtcacgaacgtgatgaagaacgtgctcatcgtgttgtagaacgcggcctggcccaggttaccgaatgcgtatgcgatcttctgacccgtgttccgcgtgggctgcggccttccggtcgtttccgtgtgttgtgtggtggatccgctcatggtgtggtggcctccttgcgacctgtaaagaatccgtgcgcgcgaaccgctccgatcccgcaaagcgtgagtatagaactatcttgaaaaataaaaaaactttaccgcgtgtcgcaaatcatgccaacgttctgcaaccggcacttcgtgtggatgagtagtgtttgaagcctgcttgatgtgcttgaatcttaagaaatccacgtattctgcatgttacaggccttgtgccgcgaaatgctggaaagaatttgcgcaatcaagtaacaatatttatccttgttgtacaaggaacccgattcaacgaggttccctcactgcggcggcaacgacgcgacgcaatccgatgcgaaagcgaggacatcatgaacacaaccgacgatcagcggaagaacggcgatccgatcgtctccccgtccataccgacgacggcatggctcgccgacccgcgcgtgtacgcggttcaccggctcgacgcccattccgatcatgcgtgctggtctcgctccccagtcgacggcgagggcacggatctcaggcagagccttgacggcgaatggcgggtccgcgtcgagacggcgccgacgggccgtttccccgatgggacgagcgacgggccggactggagcagcgacatgtcgcctctgttcgccgcgcccggattcgacgattcgtcgttctcacgcgtgcaggtgccctcgcatctggagactgcggggctgcttgccccgcagtacgtgaacgtgcagtacccgtgggacggacatgaggacccgaaggccccggccatccccgagcacggccatgtggcggtctaccggcgcgagttcgacgcggatggcgaagtcgcccaggccgtgcgcgaagggcgcccggtgacgcttaccttccagggcgcggccacagccatctacgtgtggctcaacggctcgttcgttggctacgccgaggactccttcacgcccagcgagttcgacgtgacggacgcgatcaaggtggacggcaacgtgctggcggtcgcctgctacgagtattcgagcgcgagctggttggaggatcaggacttctggcgtctgcacggcctgttccgctccgtcgaactcaacgcgaggcccgccgcccacgtcgccgacctccatgccgacgccgactgggatctcgccacatcaaggggttcgctctcgctggatgtgctgatcgacggtgccgcgaacgccgcgacggccgacttcgcactgtgggacaagaacggcaccatcgtctggcgcaccaccacgaaagcggacggaacgctgcacgccgaggccgagatcgatgacgcggcgccatggagcgccgaacgtcccgacctgtacgagctatccgtcactctgctcgacgcggacggcaaggtcctggagaccgctcgcactcgcatcggcttccggcatgtggccatcgaggacggcatcctcaagctcaacggcaagcgcctcgtgttccgcggcgtcaaccgccacgagttcgactgccggcgcggccgggccatcaccgaagaggacatgctgtgggacatccgcttcatgaagcgccacaacatcaacgcggtgcgcacctcgcactatccgaaccagtcacgctggtacgagctgtgcgacgaatacggcatctacctgatcgacgagaccaatctggagacccatggcagctggaacagccccggcgacatccccgtgggaacctccgtccccggtgacgacgaggcctggctgggcgcgtgcatcgaccggctggacagcatgatcctgcgcgaccgcaaccatcccagcgtgctcgtctggtcgctgggcaacgaatcctacgcgggcgaagtcctcaaggccatgagcgcgcacgcgcaccggcttgatccgggtcgtcccgtccactacgaaggtgtcaactggaaccatgcctacgacgggatcagcgacttcgaaagccgtatgtacgccaagccggccgagatccaagactggctcgaacacggcgacgaacggggcgaggcgagcaagccgttcgtcagctgtgagtacatgcatgccatgggcaactcgtgcggcggtctgagcgagttcatcgacctcgaacggtacgagcgctactccggcgggttcatctgggattacatcgaccaggggctcgtccagcgtctgcccgacgggagcgaacgcctcagcgtcggcggagaatggggcgaccgtccaaccgactacgaattcgtgggcaacggcatcgtgttcgccgaccgcatgcccagccccaaggcgcaggaggtcaagcagctgtattcgccggtcaagctcgcccccgacgggcacggcgtgaccatcgagaaccgcaacctgttcgccggcaccgacggctacgtgttcgccgcacggctcctcgaagacgggcatgagatctggcatgccgactaccgtttcgacgtggccgcaggagatacccaacaccatgacatcgccttcccggacatcgacgcggacggggatacgcgcgaagtcacctacgaggtcgatctcctgctcgccgaagccaccgcatgggcgccggccggctacgagctcgcgttcggccaactcaccggcacgctcaaccccgaacgggacatcaccgagaccagccatgacgacgacggccgcgcaactcgcacgctcagccgatggaacgccggcatccgccgcgacgacgaggaaatcctcctgtcacgcactcagggaggcatcgtctcctggaagcgcgacgaccgggaaatggtcatccgtcgccccgaactcgtcacgttccgcccattgaccgacaacgatcgcggtaaccattccggtttcgaccgtgccgcatggttcgcggccggccgatacgccatcgtaaccgaaacgaaaatccatgaaagcgatgacggtctcgtagcggaataccagtacgagcttgccgatccgaaccacacgcccgtgtccgtcacttaccatgtcaactccgatatgcgtatgcaactgaccgtcgaataccccgggaacgccactgacatggccagtctgcccgcgttcggtatcgaatgggagctgcccggcgaatacgatcgtctgcgctactacggccccggccccgaggagacctaccgcgaccgtaagcagggcggcaagctcggcatctgggacgccaccgcgaaggcgagcatggcgccgtatctcatggtgcaggaaaccggcagccacgaggacgtccgctggctcgaagccaccgacatccaaggccacggattgcgcgtcacccaacgcggcgaccgtcacttcacggccagcctgctgccctggaacacctacatgatcgaggccgcacgccgccacgaggacctgcccgaaccgcgccacaactacctgcgcctgctcgcggcccagatgggcgtcggcggagacgactcctggggagcccccgtccacacggcctaccagctgcccgccggcaggccgctcaccctcgacgtgaacctcgaactcatctgaccggcaacgggcggcggcatgcaccaccatgccgccgccggccccgcctacgacgcggcgatcgaggccacgggcgctgcggccgcggacggcaccggcgaggaggcgttcgagcgcgccggccacgcggtccacggcaccacccgccaggtcctctcgctcatcaccaacccgatggacgtgatctgccgcaacatccgcaccgtgcgcgagaagatggcaacccgccccgacatcctcggctgccacctcgaaggcccgttcctcgccctcaagcgcaagggcgcgcacgagccgaactgcctcaaggacccggtgcccgaactcgtggaccgcatgctcgacacctcgggcgccaacctcgccgccggcaagctcggctgcatccgccagatcaccatctcgaccccaccgactggaccgcccaacacgtctggtgcgccggccgccaggtggagtaaactccttccagcaaaatcgacgccggtgccgcccgtcttcgagacgacgtcttacgcctgaggaacgaagcttgcgcgcggcaccagttcggtcgtcagcaggatgtgacgatgcacccgccgctcatgcttcaacccatcgatcagggtggagaacgccatgcgggccaactccctttgatcgatcgcatacgaactcagcggcggcgacgtgtaccgggcgatcgactggttgttcacactcaccacggccaactcgtcgggaacctccacgcgcagtgcgttcaacgcctgcaacgcccccaccgcaagcacgtcggcggccacgatcaaaccatcgggcatgctgccggcctcacgatggtcagccaccaactgctccgcgagacgatagccgttctccacggtgaacgtgccggacgaatacaccaatccgtccgtttccaatcccagatgcgcggcccactgacggaacgacagctcgcgaatgtcctcgggatagtcatgcatgcccatgatgctgcccacgccgccgagaaacgcgatacgactgcggcccgccgcgatcatcgcgtccaaggcgtccagcatcgtctgcgacagatcgggacgcacggagtcgaacaggcgcggcgccggattcgtgtcgatgcacacgccatgcgggagcaccatatgcagggcgcgcaggtccgcttcgggaaacaccgtggctcccacggtgatgaacccatcaaactccgttgcgcgttccgtcaactcgcgtatggaccggatgaacgtgagctggtccaattccaacgactccgcacgctccgcaagaaccttccgcagatcggcgaagtacgcgtcctgcaattcctccccggacggaggcgcatccaacaccgcgatcgcgggacggaacacgttgcgataccccatctcctcgcacacgcgcaacacacgccgacgcgtctcctccttgatggagaacgacgggtcgttcaacaagcgtgacaccgtgctctgcgacaccccggcccgtcccgcgacttccttgagcgtggccatgacatcctccccgcaaactttagtaaagggttttactacagcataacccgggaaggcggggttagcggcattggcggcgtggaagtttacccatgactggtagactgcacatgtcccggcaataggggcaatgcatagggggtggcgggcatgtgcagcaacattcccgtcaccttacgattcttatagcgtgtcaggtaaaagaattaggattctcaatccaccttccggccgcgcctgcagactcaaatggccaatgatgcatagcgacaatctcttgcactatggataaacccaatccgtgatgaggtgatgcagatcccacatgcgtatttatcctattatcctcccctctgttaaaaggtgacaggaaatcatctatcctcgtatcggaaagatccatgccggtattggatatgtctatcgcaatgcaggactcgccttcgtattgcctgtcgttggctaagtttatccatacatgtggttgagccgcacgattatgctgaatggcattcgtaataaggtttgcaatcatctgtctaattagcagaccatcggctaggatatatgcattctccagattggtatgtacttgaactctatctccgataagttccatattttcctgaagaacattgcgaatgatctcagctacattaactcggctaaggtcagctcggtttaattgctgaactttcgacaattcgagcagatgattgacgatttcaaccccagcatgatttgaagccaaagccttttcgacgaaaggtctgcaacgctcatcgaaaagctggttgtgcagcggaatctccaatgcggccgaagtggccgcaagtggattttttaactcatgtgacgcatcggcgataaattccttttcccgactgattgcgctgttgagatcctttaacatgaggttgtatgcggatgcaatagtgtacgcctcgtcgttttcatatggaataacgataggttgcctttccaatccagcgtcggacgcgataatctgagaggccacactattgattcttcgttgtgtcctagtggcgataatccaagttattcctccagataatatgccgaaaacaatgatgggggctatgcttaccgccaatatcagatcccgggattttatgtctccttgttccatagttagcgttaaagcatccttaccggagtcatacccggcagaaacgtaatccttaccggagtcaggaggaatggcttgcgaattcaaactatgttgttcatcggcatcttctgcctgagtaaaagatttatttacggtcactgtttccagttgccggttcacgacataatatgtcatggcggtcaccactccggtaagcatgaagaacacgatgacgatcgtggtgaccaatcttcttcttgtagaccactgaaacggtaaacgcagtttcggatggctggaatggctcccattcgacgaaggatattcaggctttttcatgatatgcgatatccttgtccgggaacggtttcaatgaaatcagtgattccgattttcgtgcgaatcgcatagattgtggtcttgacgatccctctcgtatgagcgtgatcatcctgccaaatctcacgatatagacattccgcactaatcaccgcacctcgcgcctcaatcagcgtcctcaatacggcaagttctcgtttcccaaactttagttctgcaccgcgaaccgtgatggatcccgttctgaagtccgcagaaaagtcatcccggttgtagaccatgtcattcaccatgctcaaacgccgacgcaccgcattaactctggccagcagttcggcgtattcaaatggtttcgttaaatagtcatctgccccaagatcaagcccgcggactatgtcctcggtctgagatgccgcggtcaacatgagaatgtgtatgggatcacgccgttcgcttaacctcttagcgatttcgtcaccatgcagtccgggaagatcgcgatcaagtatcagcatgttccactccccggaattcagttcctccagggcatcccggccatcgtaaacagcttttgcctccatgccttccatggagagtcccatccgtaccacatcagcgagattggcgttgtcttcgacaatcagaaccttcatccgtccagctcccttcgcgaaacaatgcgcacaccatagcattcgcgtccaacctggtcaggaatcggtcaggttcagtcagcggcaggtcaaaacccgccttgccagccgtgcacgtcgtagctttgactccggctggacggacttccccgtcgcggcctctttcacagaagaaaggaaacaacatgatgaacatgaagaaaggaatacatatgtcaaaagatgcgttgcgcgtggttgcggctgccggtgtgttgtcagtggtgttgggtttgggggcgtgttcgatgccgggttccgggaatgccggtgcatcagatgggggctcctcctcgtcttcgtcgtcttccggatcgtcgtcgtatgaggcggagttgaagcaggcattgcagtcggcgtcgagtgatttcgagcgcggggtgttggagcgcgcggtcaaggccggcaggatcagcgagtcggattaccgcgaggcgaacgagaagtaccaggagtgcatggccgccaagggcgacgacgtggagttcgacacggaccagtccaccgggttgatgcaggaacacatgaacacggacgataattacgattcggccaaggcgaacgaggacagcatggcgtgcgcgaagggcacgaacctgcagatccgcgacctgtacgagcgaatggtgcagaacccgtcgaacgcggacgagatcgaactggtcgtgggttgcctgaaacgacgcaagctggtgcctgattcgttcacgaagcaggattacctgaccgagatgggcaagcccgaggggtcgtcgaagctggacacgtcgtcggacgcgttctcccagtgcctggcgaacccgagcaagtagaggaagtgttgctcgtgtttcgacagggaagaatagtgcccgcacgcgtcggcgggtgaacggcgtggggttcgtggcggcgtgcatggccgcgtgtctggcggcgggcatgggcctggccgtggggctggagcggacgatgacgccgccgtccctgtcggattcctcggatgcgggaaatctcgcgttggggtcggaggagttcgacgacgtgcgttccctaaacgtggacgtgacggcgtcgccggccggtggggtcgcgttcccggtgtcgggccgggccacgttcgcgtcgtaccccgcggacggcgtggtgcgttcgggctcacgcgagtacggcgtggatggcacgcctctggtgagcctgcacacggacactcccctgtaccgcgatctggcgtacggggacaagggcgacgacgtgacagcgttgcagaacgagctggccgcgctcggctacggcggctcccggtcgggcgtgttcgactgggccacgtgggacgcgtggcggcgcctgtacgcggcgaacgccggcacggccacggcggcggcccgagtccagcagggcgcgttctcccgcgcgttggcggtgtggctgcccgcgcagacgatgagcgtgtcatgcgcggcgtcgctgggttcgaccgtgaccggcgattcgacggattcgctcgcgttccgcagtctggccggggtcgcgtcggtcaaggccgcgtccctgccggacggccgcatccaaggcgatcgcgtggtcgaaatcaacggcagggactatcccatcggcgacgacggcatcgtatcggacacggccgcgttgcaggcgatggcgggatggtccacgtacacgggcgcgcacaaggacggcgaggacgtcacgagcgtgaccgtgacctacaagctcaaaaagccgatcggcgtgtactcggtgccagcgtccgcgctcaccgggctcaagggcagcgacggatgcgtagtggcgaccgacggcacaagcgtcaaggcgcacgtggccggcagctcattgggccgcacgctggtcacgatcgacggcaaggcgcccgcgagcatcaaggccgatccgggacaggcggtgtgcgatgcgcgttgacctcgaccacgtcggccaccggtacgccgacggtccgctcctgttccacgatctgaccgcgagcctcatgcccgggcacgtgtacgcgctgaccgggccgagcggcgcgggcaagtccacgctgctcggcatcatcgccggctggaccacgcccgccgaaggccaagtgacccggcagggaatcgactcgatgcgctggattttccagaacccgcacggcgtggcccaacgcaccgcgatcgaccacgtcagcctgcccctgctcgccaaggggctcccgcgccgcgaggccgaggaacaggcgcgcacgctcatggaccggttcaacctgacccgggtcaccgaccgcaggttcgcggaactgtccggcggagaggcccagcgcctcatgctcgcccgcgcgttcgcggcccagccctcgctcatgctcgtggacgagcccaccgcccagctcgacatgcacactgcggccacggtcagcgaatccctctcccgtatcgcccgcaacgacacgatcgtcgtggtctccacccacgacccgaacacgcgcgacgcgtgcaccgacatcatcgatttgaagaactaccaatgaaccacaccacgatgaaagcaaccgccgtcatctccgaggcatggcgctccatcaccagcggcgcagcccgcctcgccccggccgtcctcgccctggccctgaccgccgccggcatgggcgtcatggacatcgccgccggctcaaccatcctcgaccaggcaagcgcataccggcaatccggagctgacatcctcgtactcaacgcgcccgacggcatcgacgcggcatcctgcgaacgcctcaccagcctcacgaacgtccaggccgccggagcgatccgcactacggacccgctcaccctcgcggccctgcccgacaccaccacgcccctctaccagatcacccccggcctggccaaactcctcgacaccaaacaggacccgaacacgaccgggctgatcgcatcccaacaagtcgccgaaacgctcggcacctccaccggcggcacgatcggcctcgccgacgggcgcaccgcgcgcgtcaaaggcatctaccaataccccgacgacggacgcacccccggatacgcgtacgcgctcatggaggaaacacccgccaccggcacgttcgacgcctgctgggccaagacctggccgcaaaccgaccggacccgcaacgccctatggtccaccctcaccccgaacgcgaaaaccaccggcgacgatgcacccaccctcggccagctcaacaccaccaaaggcgacggcttcgacggacaaaccctctaccggcaacgctccacacgcatcctgcccgcctgcggcgcactcatcgccctcgccatcggatacctgctcatacgcggccgacggctcgaaatcgcctccgcactgcattgcggcgtacccaaacccgcactcgccacgcagatcatcatcgaaaccggcatcaccatcctgctcgccaccgccatcagcctgcccatcgacatgaccgccgccagactcctcatcgacaccaccgaccgaaccgccatcaccctcaacgccatacaaaccaccatcaccaccaacaccgcctacctactcgccaccaccatcaccgccctccacatcaaagaacgacatctcttcacctacttcaaagaacgataaagcgcagaaaatcattaaaattacgtgatccgtatattccgaaatcctcatcatcgtcggcggacactatcagcacggcatcctactcgattcataggctgccgttttcatttatcaatgctctcacgaagggagcgtaagacatttagcggccacatcgaggtagggggctggccatgctgatcggctcctcgttggtctgcatgacgcgcgggaggacggtatgccgtggcggtgcgaatggcgcatcgtccgacgggctggcgcacggtgtttgtgtcgccgacgttgctgatgttgccgggggtaatattgatgatggcgttgccggcgcgtgttcgggcgaatccgacgtctggcacaagaccgtcatctgctggctcgtcctggtcgcatacctgtacatccaatgcgagaactatgcgttcgccgcctcgaaggcgaggcgcgagcgctgattcctcgcgggccgacgcatcgacgcgccccgagatggaccaaaatccagaataaccgacattcgccgctgttccgtctttcgcccaaggcgtatatctacccgtatcttgaggtgcatcatgtattgtcgcggctaactaaccggcgaaacgcggcatgtttcgcattttgggcgaaaagcccaaggcccacaggaggtattgatgacgttcgttgcacggtcggtgcgctatgttctcagaaaacgagtgcgaaccatagtgctcctcatagtattgaccatcataacagcgagcatgctatccacgatcgcggtttctcgagcagctcaacaggccgccggacgaatcgagaaggaagcggtcggcggattcgtgctggccagcaatctgcagggcagcatgctcacgcctcgcggaggcggcatggtgcgtcccgccgacgtgcgcaggatcgcccaactgcccggggtcgattcgtatatggtccgtcagaacgccaccgccgacctcgtgggggcgaatgtggcgaaggtccccggcggcgatgattacgatgcgaccaaggagcagcagttcggcaacgccgccaacgtcataggcacgaatgattcgtcgaaactcaacgtgttcacgtcgcgcacgctcggcatggccgaaggacggcatctgaaggcctccgacaagtacacgtcgatgatccatgaggatctcgccaaagccaacgggctcaaagtcggagacacgctcacgctcaaggccaacgcctacgacgccgacaacgaatcacattcgacggcgaccgtcaagaccaccatcgtgggcatattcaagggcgacagcgccagaaaggtatccagccgagcggaactgaccgccaacaccatctacaccgatctggataccacacgcgatctgtaccagtacaaggacggcaaggaaatataccaggacgccaccttcgtgctgtccaagggcgttgacgtggagaagaccatggacgccgcaaagaaactcccggtggattggaacaattatcagatcacgcgcaacgaccagtattcatcgagcatgctgcatgccgcccgcggcgtgcgctccatgatgcgcggcgccctgatcggcgtgaccgtctcggccgtgctcgtgctcagtctcatgctgctgctgtggatgaacgaccgccgtcaggagatgggcatactggtgtcccttggcgtcggcaagccctccctggtcgcccaatacctcaccgagatggtgctgatcggtctgccgtcccttgccctcggctggctgtgcgcgcagggaatggcccaatggctcggcaccacggcgctccattccgtgaacgcctccgcggcgaaggagctgagcagcatgggacaggtcggcggcgaccttgaatccagcatgtcggtgcgcaccctggattcgctcacggtgtcggtcgacgggaccgccatgctgtacgtggcgctcggattgttggcggtgatgctggtgtgcgtcgcggtggcgtgcataccgatgctgcgcaaatcgccgcgagacctgtcggagattcgatgatgagcatgaatgtgtggaagcgtgccacgttggcgatcgtacgcaagccggtacgcagcggcatcatcggtctgctgatgctgatggtcttcacgagcctggtggcgcaggtcggagtctcgacggccctgcgtaccatgtccgacagcatcggcgcgggcatgggcatagggtttaccgtcagcgccggcgagaatcccatcagcgccgaggaggcgagccggttctcgcgtatccccggtgtgacgaagaccgcctatgcgacgaagaccttggcgcaggtggatggcgcgcgcccggtcatgccccggcagggcccccgattggactccgatctggccatgcaggtcagcgtgctgggcaccaccgattcctcattgtccgaggaattccagagcggcctgtaccgtctggagcagggccgccatatctcgggcgacggcgacaatgtgctggtccaccgcgacttcgcgctgcagaacggcctatcggtcggctcgacattccgtctccggcaggaggggcgcaacgccacggtgcgtgtggccgggatcttctccggcaacgtgcaggcccaaagccccttgccctcggacacttccgagaacctcatctattcgggtaggcgagtgacctccgctctgaccggaaacgaccagatcggcatgatccgatgcctgtcggataatccgcaggacctgtccgcggcggtcagtcaggccaagaccatggccggcggcaagtacgacgtcaccgacgattcggcccggctctccggcgtcctgcaatccgtgcagacggtgcgtgatctggtgcgcatggtgctgctgtccgtctgcctcgcggacgtactggtgctggcgatggcgctggtcttctggattcgctcacgcatccatgagataggcacgcttctggccctcggcatcggcaagatgcggatcgtcgcacaactcgccatcgaaaccggactcatggcggtggtcgccgccctgtgttcgctgggcaccggcgccatgctgtcgggatacgtgtcttcccgactgttgcgcgattcgggcgtcgcgccgttggaatcgttgcacgtggaggccttgccgcctgagcagacgctgctcatcctgctgctcggatgcgcggtcatcgccgtggcccttgccgtgtcatgcgccgccgtgctgtccaaatccccgaaatccattctttcctctatgcgttaggagtcaccaattatgtctaactgtctgcaactggaccatgtcgattacgcctacggcgcggcgaagatccttgttctttcggatgtcagcgcggatttcgaatccgggaagatgtatgcgatcaccggcccgtccggcgccggcaagagcacgctgctgtcgctgctggccggcctggacgccccctcccggggagtggtccgcttcgaaggggaggacatcgccacatcgggctatgcgaagcaccgtcgagagcacgtgtccctggtgttccaggaccataacctgatcgactacctcacccccgaagagaacctgcggctggtcagcaccaaggccgatatgaagatcctcgaggaactgggtttgagccgtgaggaatccaagcgcaacatcatgcacctgtcgggcggccagcgtcaacgggtggcggtcggccgcgcgctggtcgccccgggccgcgcgatcctcgcggacgagccgacgggcagcctcgacccgaagatgaccgacgaggtgattcatctgctgcagcacgccgcccatcagctcggcaaatgcgtgatcgtggtgacgcattccaagcgcgtcgccgactccgccgatgtcgtgctgcgtctcaggagcaagaaactgacccgggtgtgacccacctgggccgggcggcacccatacaccgcttcggcattctggcaccccgcaccccggcaccccggcgacccactcgcgttgccggggtgccgtattcgttctgcgacataatgtcgtgctaatggaaccatgccagtaatgaatgatgaagtgcccggcgagggcgatttcgacgcggggcgtcgacgtggcgagttcgacgatatcacttggcggattctagcggtggttgcaacacctggtgtttttttggtgttgcaaccaccgctagaatccgcctttctggtgttccccgaatccaagcagccacccaagctcgtcgaatacttcggcaaggtgctcccctatgccatgaccggcctgctggtggtatacgcgctacgcaacacgccgatcctgaccggttcgcacggtattccggaactcatcgcctgtgccgtcatcacattgctgcatctgtggaagcgcaacatgctgctttcgaccgccggcggcaccgcggtgtatatgctgctgatacagctggtgttctaggagcatgcctggcggcgagtcccgtcaaggatggatgaggaacccgccgcccaacctgccgcagaaccgtcactcgaacggatacttcagcccccacttcgcccgcagctcgtccatgagctcgacgatgcgcagcgaatcggcgtgcggcatctcggcgcactcctcgcgcccgtcgagaatcgcgttcgccgcggcggcgacctgatactcgtaaccggtcagctgcgccggcacatcgtaatgctccgccacggcatggtcggcgccgtacacgtcgatcgcttcgatgttgttgatgttgcggcacaccacgtaccccttgtcgccccaaatgcagcccgcacggtcggagcaggcgagcatcgacgacgtgggcaccgccatcacgccattggcgtaatacagcgtggtcgagttctgcgcgtccacgccggtcggggcgtatggcgtcatcgacgtctcgacgcgctcgaccggcacctcgccgtggccgcccatcaccatgtcgatgaaattgagcgggtacacgccgacgtcgagcagcgcccctccagccatcgcgggatcgctcatacgcgccttgcccgacaccggatagcacaggttcgccgaaatcgaccgcagctcgccgatcgcgccggaggccacgatccggtcgacgatggcccgcgacggcatgtagcgcgtccagatagcctccgtgcacagcagaccgctgccgtcggccgcatcgagcagcgcacgggcctgcgcggcgttcgcggtgaacgacttttcgaccaggatgttcttgccggccttcaggcaggcgatgccctgctcggcgtgcaggctgtgcggcgtggcgatatacaccagatccacgtccgggtcggccagcagctcgtcatacgagccatacgacaccgggaacccgtattcggccgcgaacgccgcggccctgcccccgtcacgcgcggcgaccgcatacggcgctaccagaccggcataccgcgggtccgccgccatcgccaccagtgttcgcgccatcgaatgcgcgatgcgcccagcgcccagaatcgccacgttgacgcgcaacccctgcgcttcggcctcggcacgtctgccgttcagtctgctcatcattcctcctcgaacgttccgatacatgttccgatggaatacgcgggtatccccgcgaaaccggctgtcaatgcaccagaataatccggtgaacgatatccgcccggctcgccgcggcgcaatccggcgaatatgacgcgacgcgcccggcagtcatgccaaggcgcgtcgcgtttcatcgcatctcgtcgcgtgccgccacgctccggcggccggccgcatgccgtcatccgatctgccgttccacccaatcgacgatgtacggcgcgacctcctgaatctggccgatggccacctggaactcgtggggcccgccataccagggatccaccaggtcgatggaatcctcgcggccggccgccggcttgggcaggttcgggtcgaaactgcggtacatgtgcacttcggcgcgcttggaggacggcagctgccgcagcagcgcgcgcatatgcgaggccgtcatcggcaggaacaggtcggtttcctcgatctcctcgcgcgtgacgcgatgggcgaaatgatgcgtggggatctcaggctgatgtcacgctgacccgtgtcggcaaccatgaggccgatttcctgattgacgggcgggccgtccataccgccgtcaagctggaaggcgtgtacaacctgttcaacgcggcggcggcgctcgccaccgtccgcgcggtcatggcgcaggatattgcttcggcgcaggtcgccgagaccgtccccgccgaaaccatgcccggccaggcctcgcatgcgtcagacgcggcgatatctgacgagagcccagtagacagcccagtagaccatgaccggcttctggcggcgctcgccgaggtgacccccgcgttcggccgcggcgaaacgattgcggtcaacggcagcgacgtgcagctgctgctcgtcaagaacccgatgggcttcaggctgtcgctcggctcgttcccgcccgacgggcatgacacgatgattgccatctgcgacctgtacgcggacgggcgcgacatgagctggctgtgggatgtcgatttcaccagcctgcgcccgactggcgtcgcgatggtgtcgggtacgcgagcctgggacatggcgttgcggctcgaatacgatcaggtcagggtggagcagaccggcacggatctggaggcggcggtgcggcagttcgtcaccgcccgtcccggtgtgcccaaacacatctactgcacgtacacgtcgatgctccgcgtgcgtgccgaactcgccaagctgaccaccgtcgccgatgccggcgtcgggcgatgaacggcgcggcgactgacagcatgagcgggaaaggtgaacggatatgggaaaagtgatcgacgtgatgtccctctacccgaaggacatgaacatctacggggattccggcaacgtgctggtggttctgcgccggctggcactgtacgggtatgagccgcgcctgcacgcatacaatcagggcgacgaatggcccgagcgcgtggacatgatcctcggtggcggcggtcaggacaccgggcagaagaaaatcaccggcgacctgttcaagcgggccggccggctgcgcgacctggccgcggacggtacgccgatgctgatgatctgcggcctgttccagctgttcggcgaatacttcgagacctcggaaggcgagcggttggacggcatcaacgtgctcggcgcgtacacggtggggcagagccaccggatgatcggcaatctggtcgagcacagcgacgaattcggcgacgtgatcggctatgagaaccattccgggcagacgttcctgcgcgagggaacgttgccgctggggcatgtcgatcatgatggtaccggcaacaacggcgaggatcatacggaaggcgctcgtgtcggcaatgtcatcggcacgtacatgcatggctcgctgttgccgaagaaccccgcggtcgcggatttcctgattcgggccgcagtgacgagacggtacggggagttcgagccggaccagtccagcgagcagatgttcgaactggcacggttggacgctctggcggacaaggcccgcaaggtcgccgccgcccgcccccggtgaattggacggttccgtgccctcggactctgcgatgcttgacgggtcgatgagcttgatgggccgatgagcggattgccggggcgtggtttccatctcatagcggaaaccacgccacccctatcgcgttatgcgacgggtgggggtaatcttggaaccacaagtaaccaaaggaggtatcatggctgatttcgatttgggtgaaggcctgcgccgggtgtttctcgcgggcgttggggcattggccaccggcgttgagctggggcagcagagctttgagaagagccagcagatcgtcgacggtctggtgaagaagggcgagctcaccgtggaacagggcaaggcgttgaacaccgagctcaagcacaaggcgcaggaggccaaggagaaggccgaggaaaagactgagggcgccaaggagcagagcgatgccggtgccgccgccgaagatccttccccggcggaaggctccgctgcttagcatgccggagcagcacaccatgccgtcctataccgcgggcggccatgccggcgacccacggcatgatccggaacgggggaaatccgcatcggggtcggacggttcggcgaaagacggtgtcgtgacgcgacgtgccggcaaacgccgcgaatgggacgggtctcccaccatcgggctgttcaacaatcatcgcgacaccttctccagccgatatcacctgacgaggcgcgggaaagtcaagcgcctcggacagatcatgcgcattgcgaaccagttcgacgtggtgcacggcctcactccggtgaagatgaggctgatgctggaggcactgggccccacattcgtcaaggtcgggcagatactgtccatgcggtcggagattctgccgcagtcgttctgcgacgagctcgcgaagctgcgcgccgatgccgacccgatgccgtatcagatcgtcgtcgacacgttgacgcaggaatatggccgccccataggcgaggtgttcgcccgcatcgatccgacgccgctcggttccgcatccctcgcgcaagtgcatcgcgccacgctggtcaccggcgaagacgtcgccgtgaaggtgcagcggcctggcgtgcgcgagatcatggcgttggatgtgtccatcatgcgttcgatcgcccggactgccacgaagatgctgcccagtgcgcaggtggtggatcttggcggcgtggtcgaggaactgtgggatacgttcgaatccgagacggattttctggtggaggcgcgtaacctcagcgagttcaagcgcttctgcgaagcctatcggtatatggactgcccgaaaccgtacatggatctgtgcaccgagcacgtggtcgtcatggattacgtcgagggcatcgccgtctcccataccgatcagctgatcgaagccgggtatgacctcaaggaaatcggcaccaagctggtcgacaactatgcgacgcaggtgctggacgacggtttcttccatgcggatccgcaccccggcaacatcatcatctccggtggccagatcgtgcttatcgatctgggcatgaccgggcggctcaacagccaggcccgcagcgtgctccgggagatgatcttcgccgtcgccaaacaggattccgccgcgctggcggacggtctgctgcgtttcgcgggcaccgagtccaatcctgaggattaccccgcgctgctggccgacctggacatggtcgtcaaggagttcggcacggtagacctgggcgacctggacatagcggcgttcctgacgtcgctgacgtcgttggcccaaaggcatggcatcgaggtgccgggcacggtgacgacggtcggcagggcgttggtcacgttggagggcctgctggatgaattcatccccgacgtgaacatgattcagatcatctccgaccatattgccggcagcaagtcgttggatcgagcggcgaaagacgagatcaaggcgctgggcgtcgagggacatcaggcattgcacggcctgctgtccgcggcgagcgagtccagggtcgcgatgcgcatgctcacccgaggccagctgcgcatgaacatggaggtcgttggttccgaggaaccgatgcgcctgctgtcggacatggtcaaccgtctgacgatggcgttgatcgtcgtcggcctgttcgtcggatcgtcgatcgtgtactacgcgggcatgaagccgatcatcttcggcataccggtcgtgggattcatgggatatgtgatagcgttcatcctctccgcatggatcgtgttcgacatctacttcaagggacgcagatcaaagcgccggtagtactcgacggaatgatttgcgccccacggtccggtcggtcttcaggccgggcagttttacgggccggtcagttttccaggaacagctgcggtgccttcatgaagttgttggcgcagtgttccccgcagaagtaataggtcgtgccgtcgtgctcgcgcgtgatggcgtcgttgttgacggcgacggtcatgccgcacacagggtcggtcgcggtctgcgtcgcgtcgttcatgtctgcggaatgcatgtggttcatgtgcatgggttgctccttgttcggctgatggtgatggccctcatcggtgtgatggccatcggcacggggacggtctccggtgtcgagaatgatgttgcgcgcgccgtgttggtcgggtgctctcctgtcggcgtctcttccgcctgcggcggtgaaggagacggtgtcggggctcagtgtgacgcgccgcatgcggttcgcgttcagcaccaggcagacggagctgagcgccatcgccaggcctgcgatcatcgggctgagcagccagccggtgaaggggtacagcacgccggcggcgatggggatgccgatgatgttgtagccgaaggcccaggcgagattctcccggatgttgcgcatcgtggcttgggataggttgagggttttcaccacgcctcgcaggtcgccgctcatgagggtcacgtcggcggattgcatggcgatgtcggttccggtgccgatggctatgcccacgtctgcctgcgccaaggcgggggcgtcgttgatgccgtcgcccaccatggccaccagtccattggggacgtcggcgatggcgggggccaccgacgactgtgccgcggcggcgtcgcgcgatatctgcagctgccttatccagtaggccttgccgtcgggcctgacctgagcgatcaccgtgtcgatgccgacttccgcggcgacgcgttcggcgacctccgccttgtctcccgacagcatcaccgtgcggataccagcggctcgaagcgctgctatcgcctccttggaacccggcttgacgctgtccttcgtatagctcggcttggcgtagtcggcgtcgtcatcgatggctccgacggtgatcgtcccggtcttgtcgaacacgacggttcggatgtcgcgggcctgctccaaggccctggcggatgtgaccagcacgccattcgtggcgccgaggccggtcgccgcggtcaccgatagcggcgtggccagtccgagcgcgcaaggacacgcgatgatcaatacgctgaccgccgtcaccagcgcatgggctagtttgggttgcggcccgaacgttatccatatggcaccggtccacaatgcggcgataatcaccgcggggacgaacacgcgggcgatcctgtcggccagacgctgcacgggcgctttggtcgcctgtgcgcgtgcgaccaaagcgatgatctgggagagcaccgtgtcctcgccggtgcgtgtgaccttcatgaccacattgccctgctgcatgatggtcgcccccgtcaggggctctccgacgccacgccgggccagaacggattcgccggtgatcatggactcgtcgacgctggcctcgccggccaacacgacgccgtccagcggtatgcgctcgccggcgcggatcaccagcagatcgccggtcttcacgcggtcgatgtcgatgtcttgggattgggcagggtcgagccatccgtcgccggatgccttgccggcggccagatccttggccagtggcgttccgacatcgaggatgtgggcgacacgtgggcgcagcttgatcagtgattgcacggcctttccggtgccctcacgggctttcgcctccaacaggcgtccgaccagaacgagcgtgatcactacgccgaccgactcgaagtagggctctctcgacccctcgggcatcagctccgagacgaagcacaaggcaatgctgtacaggtatgcggcggtggtccccaatgccaccaacgagttcatatccggagaacgatgccacagtgccggccatccgacgcggtggatcggcgccccgcagtagaacatgaccggggtgatgagtatggcctgcagccaagggttcatcagccatgaaggaacgagcgagtgactgacgagcatgagcatcatggggacgaacaccgggagcgtgagaacggtgccgatggccaccagcatgccggtatggcgaatctcctgacggcgttcctccgcctcctgccgctcggccagcagcgcatccgcggcggacatcctgggcgtgccggccggtatggcggtcccggtcgatgcagtgccgtcgtccggttttgtggcggagtccgtctccccctcgacgcgaagcaacccatgcaccatgttcatgccgcatgcaaaggggtagtcgccggccggcagcggcggaagcgacatctcggtggtctcgttgcccggcagcatcgtgtccgttccgagatcggggaacacgacatgcgacgtgcattcgccggtctccttccgatcgaacctcagcgtgatcggaatgccggcttgcatcgtgacgatatcgggggagtacccacccctgaccgtgatggtcgcctgttgaacgccgtcatgcagcgtcgcccgggcgcctccccttctgggcgcgaagaagaatcgcaggatgcaccatgtcagcacggcggctatcaccagtgccgccacaccgaggaagatgtcgaattccatcgccgctcctttcccctctctatcataatctcggatattaactataccctatacccctagagggtatataatgcgtgttgtcaggaatattcgcgctgggcggaaggctggttatgcagggttacgacggagacaaggcgaagatcctcgcgcggctgcggcgtgtcgaggggcaggtccatgcggtcgcgcagatggtggaggatgatgtatattgcatcgatgtgctgacccagatctccgccgcgacttcggcattgaaggccgtgtcggtgatgctggttgacgaccatctgaaccattgcgtgcggcaggcggcggccgagggcggcgaggtggccgacgaaaaactgtcggaggtcgagaaggtgatttcccgactggttcgctcataagtgcggcactcgctcgtccgcgggatgatgtgtaataatacacatgttcgatgaagtgcttgatgtggtgatcgttgcggtggtggcgttgttgggtctggccgccggattcgcgctgggcaaaatgcgtggccaagcctccgcccgcatggcgaaggcctccgaggtggacgcgctgaggggatcctgcgaggccatgaaggacgacaatgcgcggcttgccgcccaagtggctcaggccaaggcccagtccgagggacttctgcagcaattgtcgttcgcgaagtcccagcttgctcaggcgcagcaggcggaacaggtgcgggtgcaacgtgagcgcgagcgggccgaggtcgatgggctgcggcgccgggaagagcaggaaaaagcactgacagagcagggcaaggtgctgtcggcgttggctcctttgcagaagaatctcgatgagctgcagcagaaggtctcgaacatcgaggaggggcgcaaacacgagatgggcgtgctgggtgagcagctcaaagggctgggtgagcagcaggcgaggctcgaccgtgagacgagctcgctctcggcggcattgcgcaacaacaaggtccgcggcgcttggggagaggcgcaactgcgcaacattgtggagtccgccggtttgctggagcacgtcgacttcgatacgcaggtggtgatgaccggcgtcgacggtaagacgctccggcctgacatgatcgtccatctgccgggaggcaagacgattcccatcgacgcgaaggtgccgtatgccgattatcagcgggcctgcatgattccggaaaccgcggggcctgaggatctggaacggcgtgacgagctgctgcggtcgcatgcgaaagctttgcgtgaacacgtcagggcattgggtgataaggcgtattggagtgcatgcgacacggcccctgatttcgtgatcgcgttcattcccaacgaggcgttgctgcaggctgcaatggaggccgatccgacattgatggatgacgccttcgcccgcaaggtcgcattgacctcgccggtcaccctgtgggccgtgctgaaatccgtcgcatacgcttggcagcagcagagcctcaccgatgacgccaagaccctgttcgacctgtcgagggaactgtacgagcgtttcgccgtactgggggagcgtgcgaacaaactcggtaccgcgctcacccgcaccgtgacggcgtacaaccaattcgcatcatcgttggaatcccgcgtgctggtcaccgcgcgcaaactgcagaagctcgatcaggccacggtcatcgggtcggtgaacatcatcgatccggacaaatccgatgtccgtgaaatcaccgccccggaaaccacctccgaataaaaccaacgcaagagcatccaaaggaataccagcatgactcggcccccgccagcgaggcaaatacgcaaccgcgcggatatgcatggccattgccggcggtgacttgacggcacgcaacgatatcctgagaaccatgaatgaagagcaaggattccgcaagaccgggacgaccggaaccgctgtgggtacgaacaacattccttccgacgcatcgccgagtcagacggatgacttctccatgctggagccgcgcgaacagctccgacggctgattgccgcggaaatggaaggcaagccgttctgcgagctcgccggcgtcaccttcgaccatcgcggggcggctatcgtcggtcacattcttctggacgcgcttgaggagaacggctattccatcgatgatttcgacgccgtcggtgcgttgaccgccgcggccgttccactggtcggcgcgatgattcaggcggcggcatcgcgcggtgaagacctcgacggattcgtcatggacttcgtatacccgtccatcaaaggcccgtccatcaagggcaagcgcgtggtattgctggattcatggctctcggagaaatcctatgtgcagacctcgtcgctagtgacgctgcgcaacggcaatgagctgagcctcgatttcggcgtggtggagcatgaaggcgcgaaagtggttgccatcgcatcgctgatcggcggcgtcgacatgaccgaacccgtcatcgaggtcgtcaaccccgtgagcggtgaacggcaggagctgccattcatcgaaatctaccacgaatccgaactgcgatagccatgcacaagcccaaccccatctctctggcggcaaaggcttcgggggagccggaatttcgtgaagtcggcgtaggaccatggacgcaggagcaccccggtgagccacgcccggatgaccctaaatcgccgaactacgatcgacgctacgatacgacgctgctggatgaaggcgatcgtcgcaacgtgctcgaccgttaccggtactggaccgtgaacgccattcgcgacgatctggacgcggccggtcgccacggcttcgaagtcgccatcgaaaactggacgcacgatttcaacatcggttccatggtgcgcacggcgaatgcgttcaccgcgaatcgcgtgcacatcgttggcccgcacaaatggaaccgcaagggctcgctgatgaccgagctgtaccagcacgttgagtatcatcccagcatcgacgaactcgtcacctgctggaagctgcgcatcgcgggagaaattgccgccgcccaggcacaggccgccgccgcggcgatgcacgcgcatcaggctcactccgatgcgagtgcgcttctctcggacgatgacgaatccaacggatccccccgattcgcgtccgcaacggatcattcgggctatgatgcggtcgcgcgggccgacgctcgcatcaggacgctggaatcgtcccgcatcatcgcattggatatcattcccggtgccgtaccgatggaaacctaccgttttccggaacggtgtctgatgctgtttggcgcggaaggccccggattgtcgaacaaagctctcgaactcgctgatgacgtggtatacatctcgcaattcggttccgtgcggtccatcaacgccggcgccgcagccgcagtggccatgcacagctggattgcgcagcacgggtgacgcgggtgtgtatgctcgaatcatgataacgatagaggccttaccaaacgcttcgggcgtaagaccgtgcttgataatgccagtttcaccgccgaagacgacaaggtgaccggtttccttgggtcgaacggcgccgggaagtccacgacgatgcgggccgccctcggcttggccacccccaatgcgggccgtgcgctggttgacggagtgccgttcgtcaagacaccatcgccgatgaccgccgtaggagcggttctcgacgccaaatccgcgcataagggtcggtccgcctacacccatctgcgtggcctcgcccttaccaacggcataccgcgatcccgcgtcgatgaggtcatcgaattcaccggccttgcgagcgtggaaaagcgcaatgcaggagcgttctcgccgggcagggccgtgcggtgctgttgagttcgcgcctgatgagcgaggtcgcattgaccgctgacgatctcgtcatcatcggtcgcggccgcattctggagaccacgacggtcgcggcgttcgtcgcagagcattccacccattcgatccgtgtcgcgacgccggaacccgacaaactgcacgcggtgttcgaaaccgcgccgcaggtcaccgtccgcgaggtgccccgcaatgccaacgacccgcagcaaggccgggtgttccgcattgaaggtgccgcattggagccgactgcgcgggcgttcgcgcaggcgcagtacgagacccgcgcgataccggggcaggtgccggcccaatacggcgagcctgccgcaacctacactcagccgaacacgcaggaggtgccgcgatggcgcagcctcatatcccgccgtagcctcagcccgtgccgtcgctcggcgtggcgagactggtgttcctcagccacgaggtcacgccgctggctgccgacgagtggaggattccattgatcggcctgctggtgttcaagaaatccgacatcaaatgacacccattcggccatatcgtcgcgcgctcgggcacagccgcgcgatatggccgctgccgcagggccgccggacaccgcgcaacatcgtgagaatgtaatggtgcgtgtcacatacggctcatatagttaaggccatgcctacattcacacgtgaagaaatcgagcacctgggcgatctcgcccgtatcgcgctcaccgatgaggagatcacccgtctgcagggtgagctgaacgtcatcgcggattccatcaacaaggtgcaggaggtcgccggcgatgacgtgccgccgaccgccaaccccgtcccgctggaggcgtacctgcgccccgacgtcgccgaaacgccgctgacgcaggaagaggcgcttgccggaggcccgaagaccgaagccggcatgttcgtcgcgccgcgcattctgggaagtgaggagtgacgatgagcgacaccactgaactcgtcaagctgtccgcggccgaaatggccgccaaggtcaaggccggtgaggtctccagccgcgaactggtcgaggcccacctcgccgtcatcgacgccgccgaaccgtccatcaaggcgttcctgaaggtctccgccgatcaggcgctcgaccaggccgacgccttcgacgccaagagcgccgacgacaaggccgcgctgcccgaactggccggcgtgccgattgccatcaaggatatgatcgtcaccaagggcatcgagaccaccgccgcctcgaagatcctcgaaggctgggtgccgccgtacgacgccaccgtcatcgagaagctcaaggccgccggcatgccgctgctcggcaagaccaacctcgacgaattcgcgcagggctcctcgaccgagcactccgcctaccagaccacgcacaacccgtgggacaccgagcgtgtgcccggtggctccggtggtggctccgcttccgcggtcgcggcattcgaagccccgatcgccctcggcaccgacaccggtggctcgatccgccagcccggcgccctgaccggcaccgtgggcgtcaagcccacctacggcggcgtgagccgtttcggcgccatcgccatggcctcctcgctcgaccagatcggcccggtctcccgcaccgtgctcgactccgcgctgctgcaggagatcatcggcggtcacgacaagcgtgattcgacgtcgattcccgaaggcccgcgtccgatggccgctgcggcccgcgagggcctcaagcgcgaccttaagggactcaaggtcggcctgatcaaggaactcggcggcgacggctaccagcccggcgtcgaggcccgcttcaacgaggccgtcaagaagctcgaagagatgggcgccgaggtcgtcgaggtctcctgcccgcacttcgagtactcgctgggcgcgtactacatcatcatgccgtccgaggtcagctccaacctggcccgctacgacggcatgcgctacggcctgcgcgtgatgccgccgaccggtgtaccgcagaccgccgccaacatgatggcctacacccgtgaaaccggcttcggcgacgaggtcaagcgccgcatcatcctcggcacctacgcgctgtccgccggctactacgacgcctggtacggttccgcgcagaaggtgcgcacgctcatcatccaggacttccacaacgccttcgagaaggccgacgtgctggtctccccgaccagcccgtccaccgcgttcaagttcggcgagaagatgaacgacccgctggccatgtacatgaacgacatcgccacgattccggcgaacctcgccggtgtcccggccatgtcgattccggccggcctgtccgacgacggcctgcctgtcggattccagttcatcgctccgcagcagcgcgacgaggtcatgtacaagcccgccgccgcgctcgaagccgcacttgaggaaagctggggcggcccgatctggcagtccctgaagaccccgtggttcgacggcctgaacaagtgacgcatcggaaggaaaacaaacatcatggctgaaaaactgatgaagtacgccgatgccaccaagaaatacgacgtggtcttcggtctggaaacgcacgtggagctgtccacgaacaccaagctgttctgcccggcccacatcgagttcggcggcgagccgaacacgcagctgaccccggtctccctcggtctgcccggctccctgccggtcatcaacaagaccgcggtcgactacgcgatcaagctgggtctggccctgcactgcgagatcgcagagtggagccagttcgcccgcaagaactacttctacccggacatgccgcgcgactaccagatctcgcagtacgacaagcccaccaacggcaacggctacctggatgtcgagcttgaggacggcaccgtgttccgcgtgccgatcgagcgcgcccacatcgaggacgacgccggcaagaacacccacgtgggcggtgccgacggccgcatcgaaggcgccgaccattcgctggtcgactacaaccgtgccggcgtgccgctgatcgagatcgtcaccaagccgatcgagggtgcgggcgaccgcgctccggagatcgccggcgcttacatgcgcgctatccgcgacatcgtgcgtgcgctgaacatcagccacgcccgcatggagcagggcaacatgcgcgccgacgtgaacgtctcgctgcgcccctccgccgacgccccgtacggcacccgttcggagaccaagaacgtgaactcgttccgtggcattgagaaaaccgtccagtacgagatccgccgtcaggcggcgcgtctggacgacggcaaggagatcctgcaggagacccgccactgggatgaggccacgcagactaccgccggcggccgtctcaagtccgacgccgacgactaccgctacttcccggatcccgacctcgtcatgctccacatcaccaaggagcacatcgaggagatgaaggcccagatgccggagatgccgcgcgagcgccgcaaccgtctcaaggccgaatggggcctgagcgacctgcagatgcgcgacatcctcaacgccgacgcgctcgacctgatcgaggagaccgtcaaggccggtgccaaggccgccggtgcccgcaagtggtggctgggcgagctgagccgcgaggccaacgccaagggcgtctcgctcgaagagctgccaatcaccccggccgacgtcgccgaggtcgagaagctcatcgccgacggcaagctcaacgacaagctcgccaagcagaccgtcgaaggcgtgctcaagggcgaaggcaccccggatgaggtcgtcaggaagcacggctacaagatcgtcgaggacaacggcgccatcgaggcggccgtcgacgcggcgttcgaggccaacccggatgtcgtcgagaagctcaagagcggcaacatgaagccgatgggtgtcatcatcggagccgtgatgaaggccacgcgcggccaggccgacgcgaaggctgtcaccaaggtcgtgatgggcaagatcaagggctgacgccccacgggttcgccggaatcccgagaccctgaaattccggtttgaagaacggcccttggccgcggtgctgaaccgcgtgtcgagggccgttcgtcatgccgcaggcgctcccacggccggcagacacgtgggcaactccttcacagcaaacggtcagtcgggtaggatatcttctgtaccgacttctaccagcgtcagttgaggaataacgaatgtctgaaaatgccgcattaccgctcgatcaggacgtatcccgtgagctgccctcgcagatcaccataccgccgatcaagggggagatggtgcacctgcgcccggccagcgtcgacgacctgccgcgcatggatgagctggacgcctactatggcgcctccaagatcaccggcaaggacgctcaggcggaacgcgccgtcgtacacacgtgggtgagacgctcggtggcgtgggcgaacgggcagaagcccgacgagtcgggcgtaggcgatccggagtcccgccgcaccatcgcatgggcggtactgaccgacgccgaccatgacgaggacggcgaaatcgacgcgcagtcgacagacaacgtcatcggcatgattttcctgatcgacatcgatggctggtcgcgctccgcccgcatccaggtggtgctgggccgtgactaccgcgggcgcggctactcgcgcgacctgatgccgcgagtcatgacgtacggtttcgcgcctgaaccggccggcctgggcatgcaccgcatctgggtggcggtgcccgagcagaactcgcgttcgtgctccgtctaccagtcgctcggcttcgagccgtccggcgcctcgcgcgacgctctgtgggatgcggagaacaacaaataccaggatctgattgtcatggacacgctggtggacgagtatgatcccatccgctctctcgacgcgttcggcatgcacgtgattgaggacaatcccggtgtgcaggaggcgatgagcgcccgtgagcactcgatcgccatcaggaagaacatcgccgcgcaggccgagcccgcgccggagcccgccgcggtcgaggagagcgcggatgccgaacaggcgccccgaatcgagaaagtcgccgcagaccgagtgccggaagcgcacaatgacgatgaattggccgcgccgggcgaggaaagcacctggccgtatgggcagggcgaacgcaaaccttcgaaggaagcttggtggcgtatcctcggacgtggccgtaaacgtgatatggaggatgacgaatgagtgccgaggatcttgacaattacgaaaccgacgcggaactcgccctgtacaaggagtatcgcgacgtcatcaagctgttcacctacgtggtggagaccgaacggcgtttttatctggcgaacaaggtcgatttcaatgtgcgttccgccggtcaggacgtgtatttcgacgtgcagctcaccgacgcatgggtgtgggatgtgtaccggtcgtcgcgtttcgtcaagaacgtgcgcatcgtcacgttcaaggacgtgaatgtcgaggaagtgcagaaaaccgatatcgacatccccgacgatatgaattgaggcgctgacggtcggaccggctgattacaggccgactgcggtcggccgtccgccgtcatctgccggtgccgtgtgcgccccaaaccggcacgtcgccgtttcccgctctcgttttcgttgcgatacgcggcttctcgtgtatggcgacggaaggattttgtaagcagaacaacaaaatcggcgtgcgtttccagcggttcatatatactgtctctgattcagcgataaggagacctcacgtgacgcagaagcaatccgtggtgatcatcggcggcggcccggctggcctgaccgcagcatgggagttcgtcaacaacggcggctccgacacatacgatgtgaccgtactcgaagaaacgcaggagttcggaggcatctcgcgtaccgtcaagcacaacggcaaccgcatggatatcggcggtcaccgcttcttctccaaggacgaccggatcatggactggtggaaggacgtgctgccgctgcagggcgcccccagctatgacgacaagaaactcggccgtgagcatgacatggagccgggcggtcccgaccccgaaaccaccgaccaggtgatgctcaagcgccaccgcgtctcccgcatctactggaaccgccggttcttcgactacccgatctccctgtccgtcaacaccttcaaggcgatgggcttcaagctcaccatggtcgcgggtttcagctacctcaagtccatgttccataagctgccggagaccagtctggagaacttctacatcaaccggttcggccgcaagctctactccatgttcttcgagggctacaccgagaagctgtgggggcgtcatccctcgcagatctctgccgattggggtgcccagcgcgtcaagggcctcagcatcctcggcgttctcaagaacgccttccgcaagctcagccccaagaagcgcaagggtgaggtcgaaacgtcgctcatcgaggagttctggtaccccaagctcggccccggccagctctgggagaccgtggaacgccggtgcgtcgacgccggtgccaccgtcatcaccgatgccaaggtcgtcgagattcgtcaggcacagggccgtatcgaatccgtggtctacgagtcctcggacggcaagcgcaccgaactgcacgccgaccagttcatctcgtccatgcccgtcaaggacctcgtcaacgccatcgacgcggcgtctcatgacgatgacgccgaagcgtcttcggcgcctgtcccgcaggacatgacccacatcgccaacggtctgccctaccgtgatttcgtcaccgtcggactgctcgtcaagcacatgcgcctcaagaacaccaccgacatccccacgctcggcaatccgcccatcgtgcccgattgctggatctacgtgcaggatcccggttacaaggtcggtcgtctccagatcttcaacaactggagcccctacctcgtcaaggatgtcgacgataccgtctggatcggcctcgaatacttctgcaacgagggtgacgatttctggaacatgaccgacgccgaggccaccaagttcgccatttccgaactgacccgcatgcgtgtcatcaacggcccgcaggatgtcctcgactcccatcgcgaacgtgtcaagaaggcgtatcccgcctacttcgacacctatgcccagatgtccgaactcatcgaatacctcgactccttcggcaacctttactgcgtcggccgcaacggccagcaccgctacaacaacatggaccactccatggccaccgccatcgaggccgttgccaacatcaaatccggcaagacctcgaagcagaacgtgtggtccgtgaacacggataagtcctaccacgaacaaaagtaacccacaccagatatcgcccccgctagcgggggcatttgtttatgtctgcgactcggcgtccgtttttgcattggtctccagcccgttatacagtatggaaagtccgaaacgcatggagtgcgtcgggcgttcaaagcggcaagaccgcaatcattcttagtgcagggaccggtgcaatacggtctgctaaggaaaggcaaacgagtggcaactagccagaatcttgaaggtatgaagctgatcgagctcaaggagctcgccaagcaaatgggtctgcgcggtacgtcgacgatgcgcaagccggaattggtcgccaccctgcaggctgcacgatcaggcggcgaggcgccggcgggcgttaccgtgcgaccggtaaagggcgccgcaagcaagccgacccagcagacgcagcccgctgcacaggccgcgcagactccggaacaggctcccaaggcggagcccaagggaagtgcaccggtgtcagcggcggatgatgcggtggccggactggtcgcgtctctgcccgagctcgatgcagcctcgacccgcacgccgcgtatctcccgccagaaggccgccgaatccgacagcaaggacgaccgcgccgcggctcctcgccgtcgcacccgcgacgatgcaaaggcgggccaggtggctgccgatctgtttgatgaacttgacatcgcgccggcggacgatcagccgcgtcatcgcgatgatgcggctgattccggcatgatgcgtcgtcgtcgccgtaccatcgaaccgcgcgagcgcgaccagcagaacgacaccgtccgcgacctcgacgatattctcgccacgcttccggtgcagaacgccaatgcggacgccgcccgcggcacccgtggtgaccgtgataatcgagatgacgacgagcgcgaattcacccgccgcaaccgtagcgaccgcgctgaccgttccgaccgcggcgaccgcggcggcgatcgcaatgaccgtggcgaccgcggtaacgaccgcaacaacgaccgtcgccagcgccgcatgcgcggccgcgaccgtggcggccgcgactacgatgatcgcgacacccgcgaagtgcgcatctccgaccatcaggacaacggcggcgacgatctcgtgccggtcgccggcatcgtcgacgtgctcgactcctacgccttcgtgcgcacttccggctacctgcccggcccgaacgacgtgtacatctcgatgggtcaggtcaagaagtacggcctgcgcaagggcgacgccgtgaccggatccatccgcgcgccgcgcgagggcgaccgccgcaaccagcgccagaagttcgtgccgctgcagtccgtcgacaccatcaacggcatgagcgtcgaagaggcggccaaccgcccgcagttcgccaagctcaccccgctgtacccgcaggagcgcctcaagcaggagaccacgccgaacaagctcaccggccgcatcatggacatcgtttccccgatcggcaagggccagcgcggcctgatcgtctccccgccgaaggccggcaagacgatcacgctgcagaacatcgccaacgcgatcaccacgaacaaccccgaagtgcacctgatggtcgtgctggtggacgaacgccccgaagaagtcaccgacatggagcgcaccgtggccggcgaggtcatctcctcgaccttcgaccgcccggcctccgaccacaccaccgtcgccgagctcgccatcgagcgcgccaagcgactcgtggagctcggtcaggacgtggtggtgttgcttgactcgatgacccgtctcgcccgcgcctacaacatcgccgcgccggcctccggccgcatcctgtccggtggcgtggacgcccaggcgctctacccgccgaagaagttcttcggcgccgcccgcaacatcgaaaacggcggctcgctgaccatcatctcctccgcgctggtggagaccggctccaagatggacgaggtgatcttcgaggagttcaagggcaccggcaacatggaactgcgtctgagccgcgagctggccgacaagcgcctgttcccggccatcgacgtgaacgcctccggcacccgccgcgaagagctcatcacctcgccgcaggaactgccgattatctatcgtctgcgccgtctgctcggcggcatggagcccgagcaggcataccagacgctggtgccgcgcctgaagaagaccgcgacgaaccgcgacttcctctccgccattatccagcagagcaacagcaacccggtcaacggcaactgatccggcagacggcctgaacgagaggagcccccgcttcggcattgaagcgggggctcccgtctatatccggcctgctttcaggccatgatctgcagatgatggtatccgggcgtatggcggcccagcgcggggtcgacgtgacgttcggcgaacacgcgcatccgtcgcacgccctcgcgcagctcacgcccgtccccggcgtaggaaagcctcacgaatccggccccctcactgccgaaggccgttcccggcaccacggcgacgcgctcctcgtccagcagcatacggctgaacctgtcgcaatccatgccgcaggctcgcacgtccacgaacgcgtagaacgcgccctgcggctcgatcaggcgcagcgcggtgcagccgtcgagctcgtccagcacgatctgccgcttggtgcggtattcctcgcgcatggccgtgacatgctcctgcgggccggtcaacgcggccacggcggcatattgcgccgtcgagttgaccgatgagtgcatcagctcggcgagcttgctggtctgttcaatcagcggctcggggccgagcaggtagccgatgcgccagccggtcatggcgaaggtcttggacaggctttcgacgacgaccgtgcgctcgtgcatgccgtcgacggcggcgatggagggcgcgattgacgcggagccgtcgaagacgaacgggtgatacacctcgtcggagatcgcccagatgtcatgccggatgcagacgtcggcgatgcgctccagctcggatagcggcgtgacggctccggacgggttgccgggggagttgagaagaacagccttcgtgcgcggcgtgattgctgcttcgatatcgtcggcgttcagccgcatctggtgttccggtttgagcgcgacgggcaccggcactccgccgcacatcagggcctccgcatcgtacgaggtgaagtacggcgacggaaggatcacttcgtcgccggcgtcaagcagcgccttcatcgccaggaacagaccgatggtcgcgccgtcgaccgcctgtatctcggtgtcgacgtcgtagcgcagccccttcaccttttcggagtatgccgccacggcctcgcggaacggctcgatgccgagcacgttcgtgtatgtggtgtgtccttcgcggatcgatcggcatgcggcttccacgatatgcggcgccgcggtggcgctgggttcgcccacgcacagcgagattgcgtcaggcacgtgctcgacccggtcgaatacgtcccggatgccggaacgggggacgctgagcgagtgctgcgaaagtgcgggcatggacatggtgtcacctttcaatcatgaacaagaatataaaatatacagtagtacattgaaaaacagtaattattactatatatttcgtaaataacagtaagaaatcaatggaataacactggattgacatcgcgataagctgtcatcagacaagttcgcgccggaaccgctccacatgcaggttgcggcgaaccgtatgacccgggaggacgtgatggcacaggcgaatacgcgcaatgacgaggaaccggacgcggcatcgcgcaaggtggagatcaggccggagggctccgccatgctcgacgccacggacgagtccatcctcgatgcgttggaggaggacgggcgggccacgctggctcagctgtcccggctgtccggcctgtcggtgtccgcggtgcagtcccgcgtgcagaagctggagaagcgaggagtcatcaaggggtatcgcgcggtgctcgactatgagctgcgcggtctgccgatcagcgcgttcgtgtccgtcacgccgctggactactcgcaggaggccgatatccccggcaagctgcatgagctggaaggcgtggtgtcctgctactccatagccggcgcgcccagcttcatgctggtggttcgcgtgtcgtcacccagcaaactggaagagctgctgaaccgcatccatcggacggtgccggtcagcaccgaaagcacggtgatcctgcagacgtatttctgacggatgccattcgccgtaggcgttagacatcccggccggcattgaccatatcgttccatcgttgaggaataaccgacggtctgggttcggcccacgcgctatggtaggcagtatgagtgaacccgagaacagcgattgggcgaagccgtcatcccgcgaggtgggaggcggcggatccgaaaccgtcatcgacgccgacaccgcacggcatgatccgcagaccgcggtcaccgtggccaagatcaaggcgctcaggcagtccatcgacaatgtggacacggccatcgtctccttgctcgcggagcggttcaagtacacgtcccaggtgggtgtactcaaggcgcgggccggattcgcgccggcggattacaagcgcgaggactaccagatcgaacggctgcaccgcatcgccatcgacgccgggctcgatcccgacatcgcggaaatgtaccgggaattcgtggtggccgaggccaagaagcggcatcagcgcatcgccgacgcgggaggggatcccggcgtgctcgacgtgttcgcctgatcggcggagatttgccgctctgcccgcatcgtcggtggcgtgcatatgcatgcctgtattcggcatgcgggccgcgtgatgatgaatgaaagggggagcgacgatggcgcatatgaccggggtgatgacgcgaagcctggcggctgccgccacgctggccctgactctggccccttcggcgggcgggccggtcacggccggtgccaatccggccgaaggagatgccgggtattccaagacgcagaatgtcatgtctctcgccaactcggacggggttccgggacgcctgtacgtcaccaaccagttcacggtctcccgcggcggcgacatcgtcgactacgtggccggcaacagcggtgacggttccatgctcgcggcggaatacaaggctgtggaaaccggcaagaccacacaggagcgggtgaaggccgggcaacgcgtgttgccgtggtcggtcagcatcgcctacggcctgaacggcccgcaggtgaagccgtcccagatcgccggtgccagcggactggtcgatatccgtatcaccgtggagcccaatgcggccgtgtccaacggctacgcggagaacagcattcccgtggtggcgttcaccgtaccgtcttccgtctccgacgatatcaccgtcggagacggcatgacgctgacgatgcaaggatccgacatgcttgtcagcggcgtcggggagcccggcaaacgcacggtgttcgactgctatatgaacgcgaagaacttctcgatgagccaactggcgttcgtgaccgtgcaggccgatgacacggcgtcgttcgtcgacgaggtcacggctgtctccgaccgtgctgacgcactggtcaacacgctggtcgtcaccggttccgcgtcggaccgcaaactaatcgaacagctgaccgccatgcgcgatcgcgagcagaagctcggcgagaaggcgatcaaggagaaaaccgcagcgcacaaggctgcgttctcgtcgtatatggcgcattacgtggggtcgtacacgacccatctgtccggcagcatcggctcatccacgcagatgcaggcgctgatcggcacagccggcgaactgaccggcgacaccccgatggcgcaggcggtcaccgacctcgccaacgcggtcaacgcggtcagtgccgcgcatgagcacgacggcgcagtacatgccatagacgacctgattcagcgcatccgtcagcgcggcacgtcgggactcgccgatgagatcagccagaccatggcccaggagtccaccgagggcgcaacggcgtacaaggccgggcagagccagctgtccaacgcgatgatcccctattcgatggcctacaccgacgtgtacaccaagcatctgagcgagctgaccggaggcacgtcggcgggagccgcgcggtatcagcaacaggcgattgacgccgccaacgaggagttctccaccagcgccgaccttcaggacgacaatcaaaaagtgcagtcggcgatggacgccttggcggcggcatccgaacatacgggcgcggcgaacgcattgcaacagatcagcatacagttcgccggcgcactgaccagcaccgcctccaccggcgatgcgcaaggcggcgatgcggctgcgggccgggtgcgttacggatgggccggttccgacacgacgtcgatggcggcgaaggccgagcgcaagcggctggccgccgtcagcaagcaggagcgtgaggaggccgagcgcaaggcgcaggcgttggccagtggcaagaccgatgacgactcgcagtcaggcatgagtatcggcgatgtgatgggcaacgccagcggcctgggcatgctcggcggcgccgtcaagagcgacggcaaggatggcaacaaggatagcggcgacggcaaggatggcaacgtcagcggcagcggctcgtcttcggcggcgggcacggcatccggttcgaagtcggcgtcggttccgaagttctcgccggtatacggcatcgccggcatgaaccccagatcgccgttgcagagcacgtcgtctgagctcatcgacgagacagtggcgattggtgacgtctccgacatgctggttcaggccgcgcaatcgttggccggcagcggcagtgcgtccgtcgacggcaaaccggtcgcgcgtctcgctgccgcgttgagacggttgtcgtgcgacggtgccaacgcatactccgaccactgcatcgccgacgggcggcacagttacgacgtgctatccgactggaaccggcataccgaggacctgcgtctgctgatcatcatgccagccgtgtgacgggtgcgcggcatacggcgcacggcacgcagccggcatgccgccgtcacgatgccgtggatgcaaaacggccccctcgtggatccgagggggccgtttccgttagtgagaagcaggttacttcttggccttcttcgccggcggctcaccgagctcgctggcatcgatgacgacggtatcgtcgccctcgccttcggccgcggcctcctcggcgtgcttttcggcgagatcgaacttgccgatcacgcggccggcctgcgccacgtcgtccagagcggacttgatggcgtcgatgccgtccttgacggcggccagcgtcaccgacaggatcggggtcttcatcgagaccttggcctcggacttgatcttgcgcagctgctcgacggccttgccggcccaagccagcgtctccggggaggcaccggtggctgctgcggcatagatgtcggccttcggccaagcggcgcggtgcacggacccctcgccggtgtgcatccagctccacacctcttcggtggcgaacggcaggtacggggccagcaggcgcgcgaaggcgtccaggcctaggcccagcgtcgtgcgcgcggacttcacggccgcgtcgctcggcaccttgccgtgcgcgtcggcagtgccgtacgcgcggttcttgaccagttcgatgtagtcgtcgcagaactgccagaagaagctctcgatgacttccagcgccttggaatgctcgtaggcgttcagcgcgtcggtggcctggcggatcaccagcgccagcttcgccatcacggcgcggtcgagcggctcggtcacatcggccgggttccagacggcgtcggccgtctcgcccacatgatggttctcgtcctcgcgaccgatggccagcgcgaacttcgaggcgttgagcagcttgatcgcaagacggcggccgatcttcatctggccttcgtcatacgtggcgtcgaggccgagacgggccgcggcggcccagtagcgcaccgcgtcggcgccgaactgctcgatcggcttgttcggcacgacgacgttgcccttggacttcgacatcttcttgtggtcggggtccaggatccagcccgacagcgtggcatgcgcccacggcaggcacttgttctccagatgggcgcgatccacggtcgagaacagccaggtgcggatgatgtcctgaccctgcggacgcagatccatcgggaacgtggccttgaacagcgccttggaagcctcgtccggctcctcccagcgggtcacgatctgcggggtgagcgaggacgtcgcccacgtgtccatgatgtccggctcggcggtgaagccgccgggcacatcgcgctgggattcgtcgtagccttccggcacgtcattggtcgggtcgatcggcagacggtcctcgctcggagtgatcggatgatcgtaatccggctcgccggaagccttgaccgggtaccacagcgggaacggcacgccgaagaagcgctggcgggagatcagccagtcgccgttgaggccatgcacccagttctcgtagcgcacgcgcatgaaatcggggtggaagttgagctccttgccgcgctcgatcagctcggcgttcagtttggcgtcggtgccgccgttcttcaggtaccactgacgggaggtgacgatctccagcggcttgtcgcccttctcatagaagttcgtcatacgcttggtcggggtcggctcgccgtccaggtcgccggcctcgcgcagcgcgtcgacgatgatcttgcgggcggagaacgtggtcttgccggcggtcgcggcgaacatctcacggccggccgggtcggtgatccaatccggggtgtccatgacgatgcggccgttgcgctggatgatcgggcgggtcggcagcttcaggtcgcgccaccactcgacatcggtcacgtcaccgaaggtgcagcacatcgcgatgccggcgcccttgtccatctcggcggccgggtgcgcgagaatcggcaccttgaccttgaacagcggggagtacacggactggccgaaatactgcttgtaacgctcgtcgttcgggttcgcgatcagcgaggtgcaggccgcgagcagctcgggacgggtggtctcgatgtagatcggcgtgccgtcctcgaaacggaaggcgaccttgtggtagaagccggggtattcgcggctttccagctcggcctgggccacggcggtctggaacgtcacgtcccacaggccgggcgcgtcctgctgatacgcctcgccgcgcgcgaggttgcgcaggaacgccttctgcgccacgcgctgcgggtgctcgccgatggtgtggtaggtctgcgaccagtcgatcgacaggccgagggaacgccatagcgcctcgaactgcttctcgtcctgggcggtgagcttctcgcacagctcgatgaagttcttgcgcgagaccggcacctgatccttggcgtcgatcttcttgccgtcggtgccctcgaacggcggcttgaaatcaggatcgtacttgagcgacgtgtccacgcgcacgccgtagtagttctgcacgcggcgctcggtgggcaggccgttgtcgtcccagcccatcgggtagaacacgtcatagccttgcatgcgcttgaatcgcgcgatcacgtcggtgtgcgtgtagctgaacacgtggccgacatgcagatggccggatacggtgggcggcggggtgtcgatggaatagacggccttgcggtcgcgggttccctggaacttgtagactccgtcctcgtcccattcgccgcgccacttgtcttcgagcccgtcgacgccgaccttgtcgggcaacggggtgaggtgtgccttgatgatgctgttatcctgctcttcggtcataagcgacagtctagaaagcaatcgtgacaacagccgcgcggctgcgtccgccggcgggcgggtccgggcgcatggacccgaatcagtccgtggtggtcatatcggcgagcggcagctgcgtgtaggtcatgttgacgggcactccggtgatgttgctgcggtacgcgctgatcggcttgcgtgtgcagatccagtccaccggcgaatcgtcgtcgagcgtgccgatgaacgactggaagttcttcgcgtagtcgtcgctgctgaaggatttcagcgccttgctccacgcgttctgcgagtcggtgctgacgaagccgatgtacgagttgctgtccatcaggaggtccagatcgtcctcgccgtcggtctcgtagatcgtgaagtcgtattggcggtcctgcgtcacggtcttgctccatgtggcatcgtcgaccatcgacacggacacgtccgaatacgcgggttcggcgtacatcgtctgcttgacctgttcgccgatctgggagccgtattccttcggatagacgaaggtcagcggtcgtctggagacgcggaaacggaagtatttgatcaggtcgttgcccttgccgatgtcgtggccgaacgtctcatccgtcttctgatatccgtcgtcgagcggtgacagcggcccggtcatgaccgtgccgccgcccagcgcctcggtcatcgcgttcttgtcgatgaggtagcgcactgcctgccggaaccgcttgtcggaaaggatggactgcgtgttgttgctgaaggcgagcacgaccttgcggttgctgacgccctgcttcttgacgatgccgtcatctttcaccgcgtcggcggcggactgatccagcgcgacggccgcgtcgatctggccgttgttcagagccttggccagctccgtggtgtcggccgcgaagttgacggtgacggtcttggccttggacttgctgccccaatagtggtcgttgcggctcagcgtcagctgcttgccggattgccattgggagacggtgaacggtccggacccgctggcctgctttgcgtagtcgatgttctcacgctggttgtagacgatgccgatgcgcgtggtgagcttggcgagcagccgcgggtcgggttcgcgaagccgcagcaccagcgtgctgttgccgtccgactccacgttggacagcgcggacagttcgtcgctgccgacatacttcttggtgatgatctgctgcagggaccatacggcgtcggacgaggtgatcgtggtgccgtcggcgaacgtcgcgccgctgcgcaggttgaagcggtaggtggtgccgtcttcggacaccttccacgaggaggcgagcgacggctggatcttgttgttgtcatcgcgcttcagcagcgtctcatagacgttgccgagaaggacgcggtcgagcgaatcgtcgtcggttgtccggatatccaatgattccggggcgccggtgatgccgacgctcactttgacgcttgattgcaggccgctgaaggtgggcagcgtgtatttgcggtgcagcagggaccagcccagccagacggcgcagccgagcacccccgcgacgatgacaaagatgatggcggacttcgccgaactgctgatggaggtatgccgtgcgctgtgctgcatggctccgagtgtaatgcccggggtaaacgggtcgacgggggatccctgatgcgtgggataccggccgggtccgtccgcttggtctatatcagtgagctcgggcaggtgtcatgaagtgggcacacctcgcaatcgggtttgcgcgcgtgacaggtggcgcgtccatgcagaatcagccggtgcgacaggtcggtccactgcgacggctcgaaatacgagcagatctcccgctcgatatgcaccggatcgggactggacgagttccagtcgccgcgccagcgcagccgtcccgtcacgcggatcacatgcgtatcgacggggaatccgggcacgccgaacgcgttgcccagcaccacgttggccgtcttgcggccgacgccaggcaacgtcaccagcgagtccatcgtatcggggacctcgccaccgaaacggtcacgcagcactgcggccaatcccagcagatgcttggtcttggaacggtagaagccgagcgggtggatgatgtcttcgacgtcctgcggattcgctgcggccagggatgcggcatcggggaaacgcgagaacagctcgggcgtgacggtgttcacccgcttgtcggtcgtctgggcgctgagcacggtggctatcagcaattgcaggggagaagtgaaatccaaggcgcatttcgggtgcgggaacgcctcgacgagcaatgcgtactcctcgtgcatccgctggatgcgtgcccgtttggattcgcgtggcatgatgcgccggtcttactgggcgttggcgtcagtgtcgtcggaagccgtcggagccgcgagtgacttgtctccctcgccctcgggcgggtcgaaacggtagccgacgttgcgcacggtaccgatcagatgttcgtattcgccgcccagcttggcgcgcaggcgacggatgtgcacgtcgacggtacgggtgccgccgtaatagtcgtatccccacacctcctgcaggagctgcgcgcgcgtgaacacacggccgggatgctgcaccagatacttcagcagttcgaattccttgtacgccagatcgatgggcctgccgtgcagcgatgccgtgtagccgttggtatccaccacgagatcgccggaacggatctggccatcctcggtgcgctccgaatcgtccgtggtgctggcgcctgtgatcggcgcattgccgcgttccgacaccagtcgcaggcgcccctccacctcggcgggtgaagcggaggccaccaccacatcggcgatgccccactgcgagttgacgacggtgaacccgccctcggtgaggatcagcacgatcggcgtggccaggccggaagcgtgaatcagccggcacagcgtcttcgccgtggcgaggtcatcccgggcgtcgaggaagagcacggtgttctccggcatcttcaccaggcttgcggcgtccatcggcagcacgcgcacgcggtgggacagcagtgcaagtgagggaagcacggtggcagggtcgtccgcgaatgtcatcagcgtcaaatcagtcaaccgcttcccctttcctgaatatggataaccgtagtacccatatggttagtggtcatattgtaggcgcataatgtggacagccgacgctaggctagagttagtggaatggcggtcgcgaggctgccgcggattgcgatttgtggagtgtgatgacgatgggcgacggcgaacagcgtgccggaagctcgattggccgcgtacttgcggttcaggcggtggcatacgtggtgctattcggcgtgacgggcgtgctggagttcacgttcgggaaccagggcggtgtggcgcaaggggttgcgatcgcgctcgccgtggtgctgctcgtgctattccaggttgggtggccgttccgtgccggcattgccgaccgcctgatcggcgcggttgcgggcgtgctgtcgattctgtgcgcgcggacgtcgttggccagccagctgttttaccccgcgtacgagggcgggcgtcttgcggatgatggacgtctggtgatgtatcagctggtgcgttgggcggcgtgcttcgcgatactgctgatcgcggcgacgatcatcgcgttcggccggcagatggtgcgcgcggagcgcagccacctgattcgcgcgctgtcgcactgcatgacgggggccgtggtctccgtcagcgccgcgggatggtgttttgtgcccgatctcatcgacatgggctccgcgtcgccggataacgggctgctgacgagattcatcatcgtggccgcggcgttcgtggtagtggcggtgctgttcgccgtatgctcggtgtcgtggagccgcgaggcggatccggatccggccgctccggcgccgtggctgggtatcgggctgctgccggtgatgctcagcggtctgctcgtgttcgccgcgtcattcgtcatgcagctgatcttctgatatttgacggttttcttcggcggggaatattggtcttcgccagtatgcgatgcggggagtcgggattcggcatcgttgccggggctttcccgcatgtgggtatgaagagggtgtgcgcctgttgggctttgttttcgtcaagaaccaagcagggcaatagggagtccgtacccgtcattcagccaacgcgcttctttcttgcgggcggtggagttcgtcggcgaagggtcgccatcatgagcggtctgatcgagacggtcgccacggaccgccctccggcgaccggctcgcatggaggagcctgggtcgaggacctcggctgcgcgcaatgacgcacacgcggggaagacatgtccccttgggcgctacgacgaaatccgcaccggcaagacgatggcctcatcgtcccggcaatatccaaacacggaaagtcccgaacacggacgctgacagccgcatattttcagtctcgttgcgttaccatgctatgaagccaaggtgctcaagcagcaccttaagaccgatgagcacgagcacggcaccgccggcgatctgcgccggcttctgccagcgtgcgccaaacacgcggccgatatacaggccggcagcggagaacgcgccggtcaccacgccgatgacgatcaccgaaaaccagatgttgacctgcatgaatgcgaagctcacgccgacggcgaacgcatcgatgctacacgccaccgcgagcggcagcatatggcgccagtcgaactgggccgtctcccggctgttctcctcttcctctccgaacgcctcgcggatcatgttgccgccgatgaacgcgagcagcgcgaaaatgatccaatgatcaaccgcggtgacgtatttgctgaacgtgttggccgcgaaaaagcccagaagcgggaacaatgcctggaagccgccgaaccacaatgcggtcttgatgacgtcgaccggccgcacgcgcgtgacggtcaacccctttccgatcgagacggcgaaagcgtccatggcgacggatacggaaataagcagtatctcaatcatagctggaacataaaggttcatcccgccggcttccccgggggatgggcctcgacggataaaccgcctacgcctagggggcacggactttgagaactgccgggccagcaagccggctttgaatccaagcgaatgctgttcgcaagtcgtgaaaactacaaggcactactgtaacacaacatcgccccgctggcgggacgagccgtgaagcaaacagcggaatctgtttgtaggcgagccagaaagctgtggtcgataagataatataatgcccccgctggcgggggctgtcacggagcgactgggggtggtcgtggcacttaagcccccagtcagccgatggctgacagcccccgccagcggaggcggaagcgaagcaaatcacttcgacgcgttcgcgagacgctcgcgcgcctccttgatttccttctcggcaacggtcctgcaattgaggacggccttcggccggctcatggttggctcggtcgctgtcgcgtcctcgcacgttgccgccggacagcttaccgggctgtcctgaagcaaatcacttcgacgcgttcgcgagacgctcgcgcgcctccttgatttccttctcggcaacgtccgcaccggtccagtagtcgccggggaggacttccttgttgggttccagggccttgtactgctcgaagaagtgcttgatctccttgaggtggtactcgttgacgtcgttgacgtccttgatgtcgtcgtagcgcacgtcggcgggcacgcacagcaccttgtcgtcgccgccctcttcgtcttccatgtggtacaggccgacggcgcggcactcgatgacgcagcccgggaacacggagttcttgaccatcaccagcgcgtccagcggatcgccgtcctcgccgagcgtgccttcgatgtagccgtagtcgtccgggtagcccatggcggtgaacagctcacggtccagggtgatgcggccggtctcctggtcgacttcgtacttgttcttggaaccacgcgggatttcaacgagaacgttgaacgtttctgccatgatattgctccttagagtcgattgacataatcacactccacaataccccgtcgtacgccggaagcgccacgatttcgcccaaaaacgcagatggggcccgtcgccgaaacgacgggccccatcaccgaaacggtcagcctgccggccgcgcgtccctcatgcgttctcagtcctcatgcaccacggtgaagatgtgcgccacatcggcccacggtgccaacgagacgaagttgtcccagctccacgcgaagtcgcggccggtcagctcgtcgtgtatgtgcgcaccccacttcggatcgatgccatagtcgggcagctccagatgcaccatggcctgatgcgcctcgtgaccgtccaggttcaccaccacgatcagcgtctccggcttgtcggtgccggtcagttcggccggtgtgtggcgggcgaatgcgaggatgttcgggtcggaggattccagcaccgtcaggttgtggtagctgaacaccttcggatgctcgcggcggacgcggttcaggttggtcagcagctcggcgatgccgtacttgtcggcggccgaccagtcgcgcaccttgacctcgtacttctcgttgtcgatctgctcctcgaaaccggggcgctgcttgttctcgatcagctcgaagccgttgtagatgccccagctcgggctgcccatcgcggcgagcaccgcgcgcacagcgtggccggcgatgccgttgtcgcgcacgtaggcggtgaggatgtccggcgtggtgggccagaacgtgttgtgctggtagtagccgtcgtcgccgttcgtggtctccaggtacttgcccagctcctccttggtgttgcgccacgggaagtagcagtgcgactgcgtgaatccaacgtagctcagcgcgcgcatcatgcccgggcgggtgaacgcctcggccaggaacaggatctccgggtgcttcttggtgaccgccgcgatgacgtcctgccagaagcgcaccggcttggtgtgggggttgtcgatgcggaagatcgtcacgccggcgttgatccacagttcgagaacacgctcgacttccttctcgatgccgggcatgtcggcattgaagtcgatcggatagatgtcctgatacttcttcggcgggttctccgcgaaggcgatggagccgtccggcttgtggcggaaccaatccgggtgctgcttgacccacgggtggtcgggtgagcactgcagcgcgaagtcgagcgcgatttccagacccagctcgtgggccttggcgacgagcgccttgaaatcgtccatgttgccgagcagcgggtcgacggtgtcatgcccgcccagctcggaaccgatgccgaacggcgagcccggatcgtcggggccggcctccagcgcgttgttgcgtcccttgcggttcgtcttgccgatcgggaagatcggcggcaggtacacgatgtcgaagccttcggccttggcgcgttccaggccggacaccgacgtcttgagcgtgccctggacgatcttgccggtctccgggtcgacgtaggcgccctcggaacgcgggaagaactggtaccatgcggcgaagctggattccggacgctgcacgaggaaacgctggggctggctgggcgagacgccgtcgcgcagcgggttggtcagatgcagctgggcgaccggttcgctggtcgccgcggcgagacggtcctcgggcgtaagcgatgtgtccttcatggtggcggcagcggcgacgatcgtcttgcgctgcgcggcgctcagcttggcgtcggcggtcttcgcccagcgttccagcaattgcgcgccggattcgagggcgttctcgacgtcgtcgttgaccttgactttgatggccgcgtcatgcagccaggacttgtaggtgtcctcccatccttcgatggtgacgctccattcgcccagctggcgcttgatggcggcgaattcgggctgccacggcttgacgtcgctgtgctcgccgcaggtgagcatgacctcccagcggtcgaggccggggttggtgcaggtcatcggcagacgctgcatctccttgccgcggtggttgcgcacgatggcggtggcaccgactttggtgcggccttcgatgaagacctgcgcggtgaccttgaacggttcgcccagctcgacacgggcggggaaacggccggattcctcgttcggcgtcacgtccatgacggcgatgcgtccgaactgcgacgggtctgcgacgggaatggactgcgcgggaacctcaccgttggcgacggcggccgcagtggcggctttcgtcgttctggaggcgcgaggcgtcttggccgtcgtgcgcttgcgcggcgaggtggtacgtgatgtggactgcttgcccgacgaagtgcgacgggttgcggatttcgcttcggtcttgtcgtccgaatgcgatgtggctgatcgagatgaactactgctaagcgctgacgcgcctttcttttcttctgccataccgcccattgtatacggctgatggccaatgggcgattgtggataaccctctgtcttatatgccgagaaccgccaaatgtggataactgtcgtggggagttatccacaacacgccgaagggggatagccttcgaccacattgcctgaaatccggtggccgacggcgtccggcatggcatggtgtcatcaaccgcccatcgtggacgcggcgggatttcaggaagggaatatcatgaacatggttgtattcaggcgatgtcaggccgcgctgggggtcgcggccgtcatggctctcgcattggtggcctcgctggtgtttgccgccatgccggccgcggcggtgacgttgagcagggcggatgccggcacgtttctgcgctatgagcatggcggcgagcaggtcatcggcgtcatggcgaaggattcgacgaacaactattactgcatcgaggctgacgaacgcgtcgaataccagctgggggagagcgtcaagctgcgcgacgacgacaccgcgcgccggctcggctggctgatggaccattatcgcgacgggacggccgtggagcatgcggcgatcgcggtgctggcccatgatctgctggacctgaagccggacacgtggaaatcccggcgcgtgtccgtcatgcgcgacaatccgacgctgcggcgcaaggtagagcagatgtgggaggaggcgggatccaacgccccggcgaatgcgacggtgacgcgtacatacgccgaaggcacgcggaccgggcgcgtcacggtgtcggtgaccaatgcgcaggggaagacgatcgccgggatcagatacgccgcgacgctgaacggtccggcggtgttcgcgaacgggagcgcgacggtgaccgggatatccggggcggagccgatcgtgtactcgtggaaggcgaccggcgagggtgaagtgaaggcgagtgtggcatatgaccgcaagcaggtggacgtgttcgcagtcgcgggaggccaggatctggtgcgttacggcggctcttcgcaggtgagcggcaaggcggtgaatttctcggtccgcaaggagttcgtgcccacactgggcaccgccgtcgcggccaaggtggtcgacgccgggcagccggtcgtggataccgtcacgtccggggtggatgacggcgattcctgggcgtccggattggagttgcgggcgtccggatggtatttcgacgggctcggcgtgggcgatctgtccgagccggtcatgcctggtgccgacgagacggcgaaggagttcatcgcgaggctgggcacaatgggattccggccgtccgcttatggcgaggcgtcgttcactgctcccgggcagcgcgtggacgtgagagcaacggccgagccgggcggcgacgcggcgtatgaggcgccgcgaggtggaggattcggcacatgggtgtgggcgttcgaagtcgagaagttgagcgatactgcgcgacaatatataggtaaggatgtggtcagcgggttcctggaatacacggagacgaattcgaaccgtgctcgggtgagtgtggaatccacggtcacggagcataccggcgtggttggttccgaactgagcgacaccattacggtcgacggattccccgatgatcacggatcctttggcggcaatgtcaagcttggcatcggcgctgaccgggcgatggcgcaggtgagcgtgtggtgggcgggcgatccgaatgattccgccggcgacgaggcgtaccggcctcagggggagacgccgccggccgaggacagcaatcaccggttgattggcgtgtgggattatccggcggtcaacgggcgtatccgagtgggtgccggggcgccggacgctcatggcgatccggtgcacatcgtggccgaatcgcacggatggtacgtgttcgtttggagcttcgacggcgatgaccgggtgatgccggcgtccagcgcatacgatgacgcgtgggagcgcgtgcgcatatgggatgtggcacggccacgcaagccggcgctgaccacgcaggtggagccgggcattgtgcgggtcgatgagccgttccgcgatacggcgcggattgtgggcgatgtgcccgaaggggcctatgtgacgttcacggcgtacgaggcggtggaggaaggggcggtgcccggcatgaacggcgtgctgcttgacgaggcccgcgccgaagtggaccatacgctgttcgagcagacgatcgccagtccgcaggtgcgctcgccgaaggcgggactggtgtattggagagcgtcgcttcgctcgcgtgacggtgatgtgctggtttcgcatgagctcggcgtcgaaggggagaccgtaaccgtcgaagcgcctgatgatccacccgctgagccgaaggcggatccagagcccgagaagccggtgctgtctcataccggtgcgggggtcgtcgccatcatcgtcgtcggatccggagccgccgcggccgccatcggtgccctggccttccgccgccgatcccgtcgctgacgctgccgctggcgaaggttgtctagcgagaccgggggatggtttgaggcacttgagaaaggcgcaatagaacaggaaggctaggaatcttgtaattcctagccttctatttggcatggatttgaaccatgggcctcaatggtatatgggtcaggcgtgggcgttttcgcgacgtcgcatggtgcgcaaccggtcggcgacccatgtattgacgacggcgttgcggctgattgccagctcggcggcttcctcgtccagttcactgaccatccatgcgggcatcgtcagcgtgattcgcttctccagcgggggatgatgttcgactacgggattgccgagatcgacatagctgaggatgtcgtcgccgttgtcgaacatctcctcaaactggtcgctggtgatcgccttggcatcattttttggctttcatggcatgcctccttgttcttgcgcgatcggcgcacggatatgatgcggatgcgcttgccgcgtttggttgtaatcgccgtccaatgcctgccgtcgatcatcccgagcacgatgtggcgcacatcgtcgtttccgggattcggggcggtcagcgtcactggaggcgtcgagccggtcgacaagatcgcggccttccgcgtactacgatcagggttttgattctcgactccgtattagttatatacaaatcagttttatgtatggataaaagatatgtgtaacaatatcatggtttgtaaattcctaatccaagacttgaaagtaagtctatgcattgctaatctagttcacatgactgcagtgatggtctcgccggcgttaaaggcgcagaagcaagagctgagccttcaggatcgcgttacatacaacatgaaggttcttatcgctattcgacagacctctcagaaggatctggcgcaggctatgggaattgccgcaccgactctatcccagaagttcagtgggcgcacccgatggaacatggatgatatagaaaaagcctccgatttccttgatgtgaaaccggaggcattggtagcggggcatggatttgaaccatggacctctgggttatgagcccagcgagctaccgagctgctccaccccgcgccggctgttttcaaacagctctatctaagataggggagaatgcgagattgtcaaatcggcgtgtcggatttttgcgctgagtgaaatgccgggattgataaccggtcataactcatggcgataacctgacggcgtatcaatatcccggccattgccataataagaacatgcctatcaagatcccaagcggcctgcccgcgcgtgccatcctcgactcggaacgcatcttcgccctggagaagcccgaggcggagcgccagcgtgtgcgaccgctcaaattggtgatcctgaatctgatgcccaagaaggtcgaaaccgagacgcagctgctgcgcctgatctccaaatcgccgctgcaggtcgaaatcgacttcatgaagacatccacccacgaaccgacccatgtcagtcacgatcacctggtcaagttctatgagacgctggatgccttccgcgacaactactatgacggtttcgtcgtcaccggagccccggtcgagcacctgccgttcgaccaggtcgattactgggacgagttcaagtcgattctcgactgggcgagcacccatgtgttctccaccatgtacctgtgctggggcgcgatgggggcgctcaactaccggtatggcgtgcgcaaggttgacctgccggagaagatattcggggtgttcccgcagtacctgcaggacgagtactgcttcctgaccaatggtttcgacgagatcgcgctgcagccgcactcccgtctggcgggtgtgaacgaggccgacgtggcggcgaatcccgacttgcaagtgctcacttggggtccgcagtccgggcctggcctgatcgccactcgcgatttctccgaagtgttcgctctcggccattgggagtacggcaagacgacgctccaggaggagtacgagcgcgacatggcgagggggatgggcaacgtcccgttcccgcacaactacttcccgcatgacgatccgcaccttgagccgttgttcgcatggcgatcgcacgcgaatctgctgtggcgcaattggctgaactgggtgtatcagaccacgccgtacgatctcaccgaagtgcccggattgcgggcggagcgccggcttggcatcgatcgtttccgccacgcgcccgccggcccgcgcaaggacgatttctcaccgttcgtccatgacgactacggcgtgatacgtggcgaatgatggttctcgcctgcgctgcggtcgtttgacggggatctgggaccatcccggtcggctcccgctgatggtctttcggatctggagggtgcagatgacctcggaatcccgctgtaattgggcggagattcgagatttgttgcattagcacggtttggtgtccacatggcgtacaaaagagggccatcgccgtgctcaataggtggaataccgcctcttttgtccatgccttatgagcggtgtttaaaaaaccgtccaaataatgagacaatgaccaatatgttaacgctcacaaatttggagaagaaacgccgtacagcccttgaaaaataaggcatgttgcgtgttgtccaaggtggtcataggataatcacttagtcattcggagcggaatgtctgggcaggaactccggttggtcggtcttatgcccgggcagcttcgataacggctggacggacgatatccaaacgtcacattcgcctcaaccgttgggctaaactgacagctgataatgagagcaggagggaggtcaacgaatcgaaggcggcgaaggagaaggccgacgcggaggcgaaggccagggccgaacaggaggccgcggcggcggccgcggctgccgcgcggcaggcgcaggcgcggcagtcatggccctcgtccggttcaggccacaccggctacaccggcaacggttattccggcgacacgtccacaccgagtggcggctcgcccggggcatcttcctcgggctccaccggaagcacccactacgactgggaagaccgagtcactacaaacgaatcatgcgcttccggaggcttctgccccatcggctgattccctcccatcccctctcctctttcagggccccgcggcatccgtcgcggggcccttcccccccccgccggcggatgtccaaaccgacgccccccggacggtggttccatggtgtgcgtgcaccggacgcgcccgattccctttctccctgattctcatttcgtggcccagggccttcggactaatgacccatatggtgcctaggacctttgtaatcaatcccggcgctcttgccatccccgtcttgccgggcaaggttcttccgcagcgtgtcgccgaatctgtccagcagatccgctctgttgcggatcggaccggacgcgcgaagggccttgccctccctgatcctgcgaatcgttccgatgcgcttcgcgagctggtcccggatggcgtcgaggcgttcgggagcgaacatgcgcatgcgtgacagttcgtgcgccgcctcgtcgggccagtccgacagggcgtccaggtcgaaccggttccagtcctccaccagtctgagctgccgcaaagccgagggcttgccggtcgcggtgtagaacggcttggcgaaccagtctcggccgtccacatcgagctcgccgctccacaggctcgcgccagtgtcgtagatcggggccggacggaccgcaagggtctcgatgtcacggatcagaccgaagttgctgtaatgcctatctgtattgcgcatgaggtaatcggccacgagccaatcgtccgtggcgtcacgaaccgcccgttcgtctgcgccgaagccgacggcggcgcggatccactggtcatgcgagttgagtccattgatggttctggcggattggagcacctgccaggcggagaccagctcctcatgattggagagcatgtcctcgcacgtgcagaccaagcggttgccgctgcgcgccggcgaatacgggacggcgggaacgcccagccgcacgcagagcttcgaggcgatgacctcgttcatcggctcctggcccgtacgtcccgacttgacgagcagcctcctgccggtggttttgtcgatcgtccagcgtttgggaagatcgccgcccgtggagacgtcgggagcgttgaggctgatgtcatgggatgacgagtacgaggtgagcaggatctcgcccagcgcctcgtcgaagggattgtcgaagaaattgatgcccttccattcgaccggatcgtcctcacgtttgacccagtactggtccgacaggctcagcccgtaggtcctgtcgagcagttcgtcggtcgatgccgcgccaagcgattcgagcacacggcgaattccgtcacgggtggaggggattgcgcgggacctccaccattcgtcgatcctcttggcgtacagcgcgctcttgccgtgcgtggtgaactccaggggcagacgatcatggtcaaggacctcgcccgaggagcacgcgcggccggactcgggatcgtattcgaacgcaaggaccggatggtccccgcacatgatcagcttgcgtggcatgctccccttcctttctgactcggcgtttcagaaaataaattctacaggcgcgaatcgaacgtggatgcggcggcccgtttcatggcgcggcgctcggccctggttggccgctcgagaatccactcggcgagcatacggatgaggatggatgcgacgatcacgccgatggatccccagaagcacgggacgaagtccggcttcgcatggtcggtacagaaccagacgaccaacgcgaggatcaatgccaggccggcggccagggcggcgagcttgtggaacacgagggcgagcgtgcggatgggatgcgtgaccagtcccaccgccagcgcgacgacgacgagcagtgcgacgatgcccgcaccgatgatggcgatgcccaggtatactgcgagcatatagagtccgaacatgatcggtccttccttctctcttttctagtccgtttcttcgggcaggtaggtgtagtcgacggcgacgccctccgcctcgagcagcacggcggcctcacgcacggcggcggcgcgccgtttcgcggacgcctcggccttgatccagtcgggcaggtcgtcgggcaggttggagacgcgcgagaacgagagcgtggcccgctcctctcccctgtggcgttccacgatggccacgacggcacgcctgtgttcggcgagatagtgctcgagcatgtccttcatcctatccgagggttggatccggtatttctccgactcgtatttcttgaccatgtccacggtgaggttcgcgagcacggccacgtcgtgctgggtcatgccgatgcgttcgcgcgtcgcgcgcatccacgccttggactcgctccaatccccttccgccatgatccctcctggatattagaaagccgggttcgcccgcgcgaacctcgattatacttttagtataatcgaggttttcggcagggcggacccggcgtttcccggtttcgtcactcggtcggggtcggcgggttgtcgccggcgttggccttacgctgctggtcgagcatttgctgctggatcagaacgctgttggtctgggccgcgtactgcttctgggccatgtccatgctctcctggtggcgttgcccttcgacgtcagcgaagacgagctgctggatcgccagcgcgagctgcatgagcttggccttcttcaggatggacaccttgacggtgttgcggccgccggcctggttgacgaagtcaagctgcgcgctcatcgtgttcgccaggttcgcggcggcgagcacgaggaacaggatccccacaagcgcgctgtccttcatgcaggcgagacccgcgatgaggaagatgttggtgtccacggacgcgatgttgcgcaacgggatcgtctgtgtggacgagccgagcgggattacgcccaggagggtgttcgggctcttgcactgcactcgcatgctgctcgcggcgatgctggtcttgaaccagaacaggatcaccgacggactgaaccggtcgccggtgatgttggtctctttagtctcctttctctagtgtttattgccgaagtcgaagatgacgccgcgatccttgtcgacgacgagcgaggcgtcgaatttgctgcccttcttcgaggtgaagcccttcaggctgaccttccgtccggcgagcagccggcgtatggcggagtcggtgacggttttgccggctacggtcgtccaggcgcgccagccgcatccttccgtggtcctccatgtgccgtcggattgtttctcgcgccggttggtggagcattggaacaccttgcccgttttgatgacgggcttgccacagcgtgggcatgggccgaacgactccgtgttccgcgtcttcgtctgcaaatggtcctgccggacggtggaccgcgcgtcggccgggatgcgcacggcgaggtcgcggaactccgtttcgacctgcgcggggtcagcgtggttgtgctcgacctccgagagtcgtcgttccatgccggcggtcaatgccacgtccttgagcttcgtggcgaccacgtcgatcagggatcgtccctgatcggtggagcgaagctgcttgcccttgcggtccacgtatccggagtggacgagctgttcgataatgttcgccctggtggcgggcgtgccgatgcctcccgagtgggattcgtcgtcatccagggcggccttgagttccttgtcctccacccagcggctggcgtgctccatcgcggcgagcagcgtcgcctcggtgaacggcttcggcggcttcgtctttccctcggacagtgtcgcaccgccctgcgggaccggcgcgatgaagaccccgtcggtgaggttgacagggatgatgttgcccgcggtctcgtcggtgtcatcctggtcttcctgcggggcggcatgctcgatggcgtgccatccgggcgagacgggctggtcggaacggctggtgaagcgacattcgccttcgggcagaaggcggccttcgtccggatgcttttcgcaccaatgcgggtcgatgttcgcgacgacgttcgtcacgtcgtgcacgtagtcgtcgcccacggcctcccacatgcggcgtgccacgcgcgtcagcacgaggcgttcgtcatcgccgagttcgtcgagcgccgccctgtcggcctgcatggtgggaaggatggcggtgtgtccggcgaccttcgcgtcgttcacggtcagttcgagtcgcggccgttccggtttcgcggacggttcgatgaagccggtgacgagccggtcgccttcggcgaggccgcgcagcgtgtccaggtcgtcgtgggtgatgtaccgcgagtcggtgcggggatacgtggtcagacgcttctcgtagagcgactggagcgccgtgagggtgcgggcggcggtcaggccgtgcagtctgctcatgtccttctgcaatccggtcaggtcgtacaggctcggtggggcgtcgtgctgctgcttgcgttcggccttgaggatctggaaggtgaaatcgtccgagttgacgatccgcagcagcgtctcggcgtcctcccccttgtccaaacgttcgccggtcagcttccatccgcccatcggggcgacgaccttccagtacggtcgggccacgtggccggcgatttgccggtcgcggtccacgatcatggcgagcgtgggcgtctgcacgcggccgacggtgaatctcgcgttgtagacgagcgaataggcgcgcgacgcgttcatcccgatcagccagtcggccttcgcgcggatcatcgccgaatcggcgagtccctggtattccatctcgtccttcatggacgcgagggcgccgcggatggcgtcctcctccaggctcgcgacccacaggcgtcgcatcggcttggagactcctacatgcgccacgatcctgcggaagatggcctcgccctcgcggtcgggatcgcacgcgtcgacaagcatgtcgatatcgccgcggcgcatcagtcccgcgacgaccttgtactggcggtccgcgcccttgtcccggctgaccttccattgccagccgggtgtcgggtcgatgggcagcgtgtcgaggctccactttccccaatcgtgattcttgtattcgtcgggcgcggccaggtcgacgaggtggccctgcgcccaggtgaccaggtcgccgccgacctggatgtagccgtcgtgtttttccgcgtgcccgccgaccgcctgggcgatcgcctggccgaccgaatgcttctcggcgatgatcagtcgcatctcgcatcacgtccgatcatcagtagttgccggacgcccatgcgggccgtccgtcgtccgaggtgtcgggttcggctgcggcctcctgcggggcggtctcgtcgtccgccgcatggacgtcggatccggtcgtctccggatccgattcggcgacggtttcccgttcgggttcggcgggcggggttttccttccggccggcgcggcgacgagctcgcccttagcatcgaacgcgacgttcttctccgttccggtcatcgccagcttgtccgcgatcatcgtccggctcatgccggggaacgcctcctcgaattgcttcgccgcgtcgcgcagcacctgcgcgcttttgcggaaattgtcgagacggctgtcgaacttcttcgccgccgcctccttgcgcttgaacgactcgcgttcgtcgcgcaggaagtcgtccacgtaatcggatgccatggtcgtgttcctttccgttatcgagatccggcccatgccggctatgaaccatgctcccgccatgtggacggctccggtttggacaatcggctccgccaggatcacgcggacgtgatcctggcggagccgaggaaacggagcggcggcatggatgccgcgctctgccactgccaacccttcctgtatttccaggcgtcgcctggaagggaatggttggccggccatggttcatcatcgcgacaccgcgcccgcgtcttcgggcctgcgtgttccatgcttcgtctcgggaagggcttcgcccgattctccctcgacgggcacggcccacgcgtcctccgccgcgcggcggcgccgcaaggctgccccatgtccggcgaaaggaaacgccggcggaaccaaggaggaaccatggaaaagaaatcaaccgaccttcagcacgtcgtgttcgagaccgaggaggcggggcgcgtcgaggcgatgtggagcagtctgcgcctcaacggccaagatgttccggacgggtggcaccgctacgccgtcaggggcggggacgacggatgggagccgtgcagcatcgaaccgttcgtgtgggtgaaccacaccgccgacatcatcacgcccgtcgacctcgagctcgacaagcacgaccggatgctcaccatcagggactggtggtttgacgacgagccgttcccggccgagtgacgggccgggaacgatgccgcccgcacgacgcgggcggcgcctccagcggccagaggacagctaccgtcctctggactccaatatcctagaatggaatacaacgagagccaggaggcgacggacatgaccatcgactattcaatcaaagtgacccaatgcgaacccatgcccggctacaagctcaaggtcacctgttccgacggggcgaccggaatcttcgacatgtcccgatacgtcgaacgcggcatgttcaaaccgctcaaggacacgcagacgttcggccgcgtgcgactcacgttcggcgtgccctcatggcccggggacatcgacatcgccgcggaacgcgtccgctccggcatgcaaatcatctaggagcccgcgcgcccctgccccgaccgtcaccaagacggccggggcttttttcatgtctgcatgcatgacggacatgacgcgccgccgaccccgcgttttttcgcgaggccttttcatttcccgcgctccaagtgtccaaacccatcgccgttcccacgacggacgattggcgtaagacaccggccttcccctcaaggccatgagcgaaaggagcgaggagtgaacgcgatcatccttcacggcattgcgcaatcatgccgtgcgaaatcgctcccaatccatgaaatggatatgggagcagcaagcgacgtgattggatatccaatcactcgattcgcgatgcgaatcggcttgccgggaagacccgtgccccatggtcggcggagcctccagaccgctcgcgcggcatcacagaaaacccgtccccacacctcacacggaggcgtggaatgagccgggccgagaacaggacgcactgcgtcgagaagatcatcaggttcacgccggacgagtgggagcgggtgcggaagctgtatgaggagctgaccaggtacgcgccggagcaccggtcgttcagctcctacgcgcgcaggatgctgtccgaacggcgcatccacgtcaccgagatcaggccgctgacggacccggagccgatcgcgcgcgagatcgaccgcatcggcgtgaacgtcaaccagatagcccactgggccaacgcgaacgagcacatcaccgccgggcaggtggccgagctccgcgcgtcgttcgaccgcatcgagcgtctactcggcgacctgttcgccgacaggcgcgaagcccggaaggacgtgtgagcatggcggtggtcaagctcggcaggcccgtgaaatcgaatctcggcggcgacaacggggcgatggcgtacatcatcaaccccgccaagaccgacggaggaagactggtcagctccaactacgagcggaccaggacggactacgacgcgctggccgaaggcatgctcgacgacaaccgcaggtcgccgaaaggcatccggaaggacagccggctggcctaccacatcaagctcagcttcagtcccaaggaccccgtgacgcccgagcaggtgcacgagctcggcgtggaattcgcgcgccggatcaccggcggcgaatacaagttcgtggtcgccacgcacaccgaccggcaccacctgcacgaccacatcatggtgtgcgccgcctcccggtacgggaagcatctgaaggccgagctgcccaaggacatcatcgaccagtggcgcgcggtcagcgacgagatatgccgccgcgaggggctgagcgtcgtgttcaaccccgtcgtggaggaacagacgcgcaagatgcgtggcggtacgacagccgccggcgacgccggaacgtcgccggcgcgcgaccccaaatacgtcgatgaagcacccgtacggagcgcgaacgaaccggagacgaaggcgcggaaggcctcgggcggggagccgttggaacgccggtacggcatgtcgatggaggagatctacgcgtccgcgaaaggcctgggcgtcaaggacaggctccgcatgctgatcgacctgacctcgtccacggcggagaacttcgaggactggaaggacatactcgacatccgaggcgtggacgtgacggtccgcggccagcacctcacatacacgctcaaggacaccggcttcaagatccgcgacgcgaaactcggccaggcatacgacatgacgaacatcatggccgggctgcaaagcacgcccgtcatccccatcacgttcaaccgcagactcgtcgccaaacagaccaagaagacgatcaccgtgtggctgccaggcacccaccggaagaagaagatcacgttcgacgcgaaacgtctcgtggacgacggcggctccacactgcgcgcgttcctcccccgcgaccgcgaccagatcatcctcgacccgtccaaccggtacgccggcaagaccccgacgcccggcctctaccagtggttcggcgagcccacaagccggctcgaaccactgacctcgcccgaacggctgcccctcagatacggggtcagccccgcccagcagcgctactaccaggcacaggcgcgccgcctcgaccgcctcgccggcgaggcgaaggcgctgaacgcggcgatccgctggaccaggctcgcgggcggcgacagcgccaagggactcggtctgctgcgtgcgaaggtccgcgaatcgcacgacgaactccagtccgccgtcatcgcgttgcacgacgcgatccaacgcggcgaccccgacctcgtggccgagacacgcggcgagatggaacgccgcgaggccctgtgcgaccggtatgagggcgagctggcagccatcgaacgggaaatccacacgacccgcgaccgcgagcaaacggagaccgagcagcgcgaacagcagcagcacaagcgtggacggtccatctgaaccgtcccaggaaacaccaaccgacaacagaaagggaaccgcaatgccaatcgaggaacaggctgaggagaagatccagaacgccgtccagaccatcatcaccggaggcgcgaagctcatgctcagaatccccaagggcgtggccatggcgatgctccgcggcggcatgaaactcgcgaagaccggtgtgcacgccgccggcgaggccgtcaagaacaagatcgacagcggcgagatgtccgagaaacgattgcagcaaaagaaggacggcgacctgcacgagctgcaactcgacgactcgaccatgcgcgaagtacagcacagcctcaagaccgccggcatcgactaccacctcgaacgcgccgaccaaggccagttcatcctgcacttcgccggcaaggacgaagaccatgtccgccacgccgtgcaacgcgcgttcaaaggcatgggcctggacgtcaccgacgacgacttcaccgtcgagcagacggaacagacccgaaacgagccagaacccccggcgcgggagaccccggccgaaccagccacgaagcccatgccgacgcagcgcatcgcctgggacttcgtggacccggaggtcatggagatggccgcgaacagcctcaccgcccgccaccccgaactctcatgggacaagctcatgggcgacacaacatgcgacgagcagtccggccgcaacttcgcggaccggatcatcggcaaggccgccgccgacccgagcctgcgcgacgagctcgacgacatcctgcgcgacgactacgggcagggcgcgcaaacccaggagcggacacgcaagcagacgaccgagccgaaccggaagacgccgacatcgaagccggaaagcgaaccggaacccgcaccggacgaagcccggacaccggccacgcgacagcagacacaggccagagcagacaatcccaggccggccggcaaagagcaaaaaccgaagccgatccgatcaaagaaggcactgcttgaacgcttcaagacccgactcaacgagaacctcgccgaacagaagaaccacatgccacccacccagaacagggaccgcacgccccgcaagggccgctgaaaggaaaaaccacaatgaaccagcaggaacaggcgacgaaacgcgccgcgatcttccaggacaccatcaacgggaccaacgacccgaccccatggccggtgaccatgtgggcctcgtccggcgacacgatatggacggccggcacggcaaggactgccggcgaggactcggtgggcatgatctacgctcccggcgaaaccatcgcccaccggaacacaatcgccggcgacaccacccgcgccaccgaatccttcgccatcagaccggagagcggacagagcccgatggacgcgatgctcgcgggcatcgaacagtgggaccaccgccaccccgaccagtgggacaccgtgaccacaccgggcgagtaccgcatgacggatccgacgaccggccgaccgctcccgatgggatggagcgacagcctcgccgtggccgcgtccgcggcaggccggctcgaccccgacctgctccaggccagcctcatgcagaacgcggtcgagcacgagccgcgcccctgcgtgttcttcctggaggacaacggctacgacctcatggtcttctcctggcatcaaaaccagcagggactgttcgacgcgatgacattcaaacacctgcaatacgacgacctgagcatgcaggtcacgaccatcagccacagcgaggacatgagggaatccttccccgccaagaccatgagcgacggcgaactgctcacccaaagccgcgtctaccgggacgaataccagttctggcgcgaacacgacggcggacccgtcgcccacggcatgaccggccgcgtcatgcgcagcggactgctcaaaccgggactggagcagaaaccgctgctgaacctgaacgacggccggcgcgccccggactgggacgagttcaccgaccaggccgccatctcgatcctccagggccgccccgtctcaccgacgccagcactcccccagcaggagcggcccggacggtccgccgatcccgcggacgagacgccggaacggcaggaaccggcgcacgcgaccacggccacgagacaggtctggccgaacgcgtgggtggcgaacaggctcgcgcacatctatatattgcatgcgaaggacggacgcgactggccgaagatgatcgtcggactcccccgcggcaccgtcatcgacggacaggacctgaccggctgggccaccgacatgttcatgagcggcaagaaccagagtcagaagaacgagggacgggccgtcaacctcagattcagacccggcaccccggtcgaactgttcaccgggcgcggcgcggaacgccgcaccgtgcaggtcgacccgcagacgctcgtccaggcaatcatcgacgcgcagaagcgcagccgagacgccgaggagacgctcgacacggcatcggtggaactcgcctcgaagaccgtggaggaatcctggccgcaaatcagccgcatgcagggccggttcacggaataccggcgcgctggcacgtacaagccggccgtcgcattgaaatgggcgcgccgactcgtcgaccggaccgccggaggggacgagggacggtggaccaaccgccaacgccgtcaggccgccaggctcctcatccaggaactcgccggcgcacaggaaccgatgcaggacagagacaaaacgccgacccggccaaccatcgaacaggacgcggaggcgacggacacgccacggaaaacggaaccgaccaaggagacggaacagggacgggaccacgacgaagccggctcgccggccgccgacccgggagcgaaagccgaaccgccggagacgacgcgccgcgacgatccggagcgacggcacacggacctgaagtcaacgctcgaccggttccataccaagctcagggagaacctcgacggactcaacacagccacgccggcacccggcatcgaccggaaccacggccaacggaaaacactataagaaaggggcgaaccatggcgagaaaacgcctatacgcgaagcagacggccccggccgaatacgagcagatcgacctgttcagccttctcgaagaggaacaaagacaggccgacaggatagcggagcaggtgcgcggatacgagataacggtgggccacgtcgcggtgcaacggctccgcgtgcgcggagcggacgacgagacgatagccgccgtggcggccgaataccgggagaaccggctccgcggactcggccggcgggacgcgcggatcgccgccgagaacaagctcggggtcggcgccgccactcccggcgaaaccacgccgcaacctgtggtaaaacgttttacacaattctccggcacggaaaacaacactgaagaaaggaacaacaatggacgagatgacatggaccgacccgcagctcaaggcacgctacgaggagaacagcaggaagctggaacacctgaaggagacgctgccgaacctgtattccgaggacgcgctgccgtacaaggtgttcacgatgaacagcgtccacggcatccagcggatgcgtctcatctggctcaaggagcaccatccccagtggttcagggagatgatgatggccaacgtgctcgaggagcatctgcgggacatcgagacgcgcacgagggaacgccaggcgcagatcatggaccagctgatggagtccaggcacctgctcaaccggacggactgcctgaaggcggcaccacagctgaccgacctggaccggctcaacgggatgaacgaggcccagtcggagtcgatgagcatggcgatccacgaggtcgtggagagcttctagcatccctcgacgcgcagcgcgcgcgttcgccccgcgaacgcgccgaagcgaacatcgccgccatccagaccctcaagaaactcggcggagacaacggcggccggccctcagcgaagcaaatggatacgctgcgcggatattccggctggggcggatgcgcggacgcgttctcggacaagcctgaatggcggacgatccgcgacgcgatagaacaggccctcaccccggaagagtatgcgcaggcgcgcgcctccacactgaccgcctactacacgcccggcccggtggtcaaggccatgtgggacgcgctcgacatcggccccgcacccatccaggtgctggagcccggatgcggcaccggcaacttcatggccggcatccccgacgacgtcgcggcgcacgtgtcgggcgtggaactcgacccgatcagcgcgcgcatcgccgccgcgctgaacccgtacgccacgatcctcaacgcggacctcgcggactgcaccatccaacagggatcgttcgacctcgccatcggcaacgtgccctactcgggcgacatcagcctcgactaccggaccacgggaggcggcacgtcccgcctccccctgcacgactacttcatcgaacgctcggtggacgcgctgcgccccggcggcgtcgcgatgctgctgaccagcaggtacacgctcgacaaacgctccgagaccatgcgcgccgacctcgcgaggaaagccgagctcatcggcgtggtgcgtctgccgtcctcgacgttcgcccgccaggccggcaccgaggccgtcaccgacgtgcttgtgctgcgcagacgcgaacggacgctcgaccgcacgcccgacgaggcatggatccactccacaccgatcgccgtgcccggataccgggacgtgaccgtcaacgtcaaccaggcggtcgccaacgacatgcccacgcacgcggtgggcgacatcagaccagtgatcggccggttcggcggcgacttcgacgtcgtcttccagggcgacacggaacagatcggcgaacggctccggacgatgctctccatgcagatcgcccacggcaggccgccgttgcagctgggcgagatggaaccggccgaacgcgcggaggtcatcgtccgcccggaccatgtgaccccgttcgaatactcggtcgaccctcgcggcgtggtctggtacggcgacggcgccaccgtcaccgaggccgcccacggtcagggagacgaggcgcgccgactgcgcggcatgatccgcctgcgcgacctggcgcgcgaactccaacgcctcgaactcgaccccgcccgcgtggacgaccccgccgtggaggccaaacgcaaggaactcgaccaggcatacgaccggttcaccggcgagttcggacgcctgaacgaccgcgccaacctccgcgcctacgacagtgaggaatccggccgccacctcgtcatggcgttggaggagaccgacgaaaaaggaaggttcgtcggcaaggcgaaatgcctctcgcagcggaccatcagccccgtaccgcccatgcccgaccatgcggacagcctggacgacgcgctgaacatcagcctcgaccgcgccggcagggtcgacctggaactcatcgcgcgcctcgccgacaccaccgtcgaggaggccgaggccggcctgggcgaccgaatcatacgcgaccccgacaccggcacggtcatgcccgccgaggactacctcaccggcgacgtgggaacgagactcgaccacgtcacggccatggccgaacatctgagacgccgcgccggcaccgaggccatgaccgagttcacggcatccacctacgcgacgccggaggacatgcccgccacggagcgggcaagcgaatggatcagcgaggcgggcgcggacgtgtggcgcagcctcaaggacccgtactccgccgaatcctacagggatccggcaccggtcatcgaacgcatcaacggccgggacgcatggaccatgggctggagccgcaacccggaactcgtcctcgccctcgcctggcgggcggtggaggagcttcccgaacagcacgcgcgcgtcaccctcgaacggtccgacaccggagagaggaagccgtggcaagcgccggcatggcaccaatcgcacggcaccagcccgctgtgggacgcattgtgctggacatggcgcgacggcgacgccccgcagaactacgcgccgatcctcgccgaccgggacatgcccgtcagggacctcgccctcttcgtccacaagatcgcccacaccgaccggctcgacaccgccgacaagacagcgatcctctccaacctgttcgaaagctggcgcgccgacgacgcgaacggccggcccgtctggacggacacgaccatcggcggaatggcacgcactctcatgcccgacaccgacgatcacacgcggctcgccgaacggctcgccaccgacatgtccctcagcgaatggatctggggcatcgcccgcgacatgcccgaagacctgcgccaagggcagaagcacaacgcctacggcgtcccgccacgcgtcgtcgacgcacgccccgacgactaccaggcgttccacacacgccgcgaggaacaaatcaagcaatggcgggaactgccggagcacgccgaggccgcgcgcgccgaccaggcggacgcggaacggctcgaacacgtggccggcctgctggaacgcgtacagcccaccccattggaggccgagcagatcaaggcgccgttgggagccccgtggatccccgccagggacgtccacgacttcatgatggagacgttcaacgtgcgcggccacgggctcacacccggcaagctcgcccaatactcggtcgactggattccccagctcggacaatggcgcgtcggctactcgggcggcggcgacatcgactacaaggccgcgaagacgtacggcaccgaggaccgcaacccgttccaactgctggaggcatgcctgaacaacgcgcagatcaccgtcaccaaggactcccccacggagaccacggcatccggcaaacccaaacgcgtcaaggaccagaaggccacgatggccgccatcgagaaggccaacgcgatccgcgacgcatggaaccaatgggtgttcagggaccccgaccgcgcgcgaaggctcaccgccctgtacaaccgcagattcaacagcatgcgcccccgccacgtcggcggatcctacctgaccacgcccggcatcgcccacggcgtcgccctgcgtccgcatcagaaggacgcggtggcccgcgccctgcgcagcgacgagggaaccctcatcgcccacgtcgtcggagccggcaagacgttcgagggcgtcgccctctcccacgaggcgaaacgcctcggcaaagcgtccaagccgatgctcgtggtccccaaccacctcgtggaccagtgggccggcgacgtgctcaggctctacccggccggccggatcctcgtcatggacaaggatgcgcaacgcaaccccgaatcggtgcgccggttctggggacgggtcgccaccggcgactgggacgcggtgatcgtgccggaaagccggttcagccaactgcacgtcagcaaggaacgccggctgaggaacatgcgcgcccgcgtcgacgagttcaccaaggccgtcgaggccgccaccaaggccaggggcggcaaggacccgaccgtcaaacggctggaggcagcgcgcaaaagcgccgagaccgccatgcagctcctgcgcgacggcaaggagtcccgcgacgacaaggcgctggcgggcatcgagttcgaatcgctgggcgtggacatgctcatcgtcgacgaggcccaccacttcaagaacctcggcgtgcccgtcgcctccgcggacctgggcatgcaactgtcgtcagccgcgaaatgcgaggacctgctcgacaaatgcgaatggctgcgcgaggccggacacggcggcaacatcgcgttcatgaccggcacgccggtctccaacagcatgagcgagctgtacaacatgcagcgctacctcgcgcccggaaccctcaaggcgcaggggctggacacgttcgccgcatgggcgggcgcctacggccaggtcgtgcccaccgtggaactgaaacccgaaggcaacggcttccaggtcaagcaaaggttcgcgcggttccagaacctgcccgaactgatgaacgcggtgaagcagttcaccgacatgatcaccaacgacgacatccagctgcccctgcccgaactggaacaggtgcccgtgccggtacccatcaccgaccggcagaaggaggagatggaggaactgtccgacagggcggaccgcgtgcgcgacggcgacgtgccaccggaggacgacaacctcctcaagatcacgggcgacggacgcaagatcgccctcgaccccaaactcctcaaaggccacgaaaacgaccggccgttggagaacggcaagatccaggcatgcgccgagaacgtcgcccggatctggcaagaggagatgccacacctaggaacgcaactcgtcttctgcgactcgagcacgcccgcatcgggcggatggaacgcctaccaggacctcaaggaccggctcgtccaattgggcgtgccggccgagcagatagcgttcgtgcacgacgcgggcgacaaccccgccaaacgcgagcagctgttcgccaaggtcaggtccggcgagatccgcgtgctgatgggaagcacccagaagctcggcaccggcaccaacgtgcaggaacgcctcgccgcgatccacgacctcgactgcccctggcgtcccgccgacctggaacagcgcctcggccgcatccaacgccagggcaacacgtacggccacgtgcgcgactaccggtacgtgaccgaaggcacgttcgacgcgtacagctaccagaccgtggaacgcaagcaaaggttcatcagccagctcatgagctcgaagagccccgcacgcgaggccgcggacctcgacgccgacgtggtgactctcgccaacatcaaggcgctggccaccggagaccccgacatccaacgccgcatgacattggagaacgagatcaaccagctgaagctcctgcgcgcctcatgggcgcagcagaaggccgacacccgcagggacatcggccagcagctccagccacgcgtcgaactcctgcgccagtcgatccgcgagaaggccgacgacaagccgctcgcctccaaggccctgggcatccaccagaccgcccgcatgaacggccgatgggagggcatgaccatcaacggacagccggtcggcgaccggcagaccgcatgcaggctcctccaccaggccgcccaccaggcgcacgacggggacacgatagccgaatacgacggcctgcccgtcatcgcacgccgcgccgacaccaccggacggatcaccctggccgtcaaggcggtccacgaacacgaatccggcaccgagatgcccggtccatacctgaccggaccatccagcatcgtcagccagctcgaccgactcgtcaggaacatggccaccgaccccggcaagctcgcggaacggctggccgacgccgaaagggagctcgccgccgcacaggagacactggccgaaccattcgcccacgaggacgaataccggcaaaaacaagccgaactcgaacggctgacgtccaaacccgacgaaccccgggagacggaaagtagagaccaggaaaccacaaaaacggaaaggagcgcacgcatgccattgacacgggaagacatcggacgactgctcgaacaggaccccaatatcgacggcatcacccagggcggcaacgccatgggacactacctcgaagcccggctcacggacggccgcgccgtgcagatcgacctccacgacaaccccgcatggaaggacacggaccgtctggccggccggatcgaggtattctacgccaaccggccacaggcggaatggcaatacgacgacaacgatctggccgaccgcgaacacaccgtcatcgaccccgccgaacccgacgcgctacaggagctcggcaaggcggtggccgaatgggaacgcgcgggcggcctccacaaggcccgcgcatccgagccgagccacctggccgcgcaccagccgccggaggaatacgcctaccggtggcggaaacccggggaccccgacaggcacatcgcatacctgagcaccgccttcgaccgcgaccaggcgatgaaggcgagggaggacgccggatatctcgtgacgaaggtcgaggaggatccggccatactctacgagcagcaccgcaaggcatcctgcatgcgcgcgagccacatcctggaacgatacgaatcccccgacccggccgccgtcagaatcctgcacagcatcgtaagcgaggtcaacgcgcacgaccccgagaacgacatcgccgcctacccgtcagacaaggcgatccagctcgccggcgacggtctcaccgaagcggacatcgcggagaaacgcgagatgggcggatgggatccacggacggacccgctcatgcgcatcaacgagcagggcgactggacgggcgtcacccaacagcaggccgaccagctcgtctgggagaaccgcgacgagatcctcgcccgcgcgtcatacgacggcgaactgtccacttggacgctgcaccagctcgaccagctgaaggagcacgagccggaacgaggccgcgacctcgaccggccggagccggaacgcccggcgcccgcgcgggagcagcacacacccaaacgccacggactgggactgtaggcccacacacccaccgggggcggcgcgcggcttcgcacgccgcccctcaccttataggaggaacatatggcaacggaagaacagcgcgccacggagcccgtcatctggttcgagggcacgctcatcagggacccgcaaccacacggaggacacgacgactggctgctcgaggcactggtcgatccggacggaaacgggcgaaagatcaccatccatgccagcggcggggatcactcggagaacatcggccgcaacgcgcacaagggagcccgcctcatggtcaagggcaccgccggagacgaggaatccggcatcgacatcgaggccacaagcctcgcattcgaccccagccacgacgagccggacggagagcgatgacacggaccaccgtcagcgccaccaggccggacaagaccggtgccggcgaatggatcgacatccacagccgcaccggccggctcatgtccacgctcatggccgacggccaaccattcagcattgacgtcacgccggacggcatgaccaccgtcacgcccctcacgtccccgaaggacgcggcgcaggccgacggcgacaacgccaagaccgggaccagcccggacggcgcgaggatcaccagcaggaagacgctgtacgagcggttcaaaaccaaactcaaagcgaacctcgacgaaagaaaacaatagaaaggaaccatcatggaacgaataaggggaatcgtcgtcaggacgctgaccatcctcgcgggattctggatcgccgacctcgcggccgcacgcgtccaggccggcatcgcggccggcgaaagcatcgaacggatcatggatggcatgacgaccatgttccagcatccgaccgccctgggattcgaccggaccagcctcctatgcggactgggcggcgcgggcgcggtcggcctgttccacctctaccggtggagtatgagccaacgcaactggcgcgaaggcgaggaatacgggtccgcacgctggtccaccagccgggagatggccccatacaccgacagcgacaccaggcagaacctccagatgacggccaccgagggcctgagcctcgacgcccaggccacgcgacgcaacctcaacaccgccgtcatcggcggctccggctccggcaagaccgccacccacgtcatccccaacatcctcaaaggcagcatgaactacgcgtgcaccgaccccaagggcgaactctacgcgaagaccggtggaaaactggagaaaatgggatacacggtccaacagctcgacctggtggacctgaccagctggacgaaattcaaccccatgcgctacatcgaccccgacaagcccgacgtggcgataatgcgcctggtcaccaacatcatggacaacaccaatggctccacacccaaggagcaccagaccaacgacttctggaccaaatccgaacgcagcctgctgaccgcgctcaccgcgttcgtctactacctgcccgacgatatcctcaaggactgcctgaacatcgaagccggccagaccctcaacgcggtggccgacatgcgcgacctgctcgaggccagcgaacaggacgagaccaaggaaagccaggtcgacgccgtcgcccggaccgccactgaaatatacgaggagacccgcgccgaatgggaacgcgagggcgcggaccacgacgacccggacctgcgggaggcatggcgtctcgcccagggcctgaagttcgccgcccgccagtaccggcccttcacccagggcgccggagataccaagaagggcatcatcatcagcctcggcgtgcgcctcgccccactgaccgtcggcccggtcagggagatcctctccgacgacaacctcggcatcgaccggatcggcggataccaggacgagcacgagggcggctacagacgtcccaacgggaagacggctatattcctcgcgctgcccgacgaggacccgaccttcaatttcctggccgcgatcctctaccaatgcctcttcgacagcatcatccgccgctgccgcatctaccccggcgaatgcctcgccacgccactgcactgcttcctcgacgagttcgccaacgtggggcgcatcccgaacttcgacaagctcgtcgccacgatccgctcgcgcaaggtcagcgtcagcatcatcctccagaccatcgcccaattgaagaccatgtacaaggactcgtgggagaccatcgtcggcaactgcgacagtgtgctcttcctcggtggcaacgagcagtccaccaccgaatggctcagcaaactgctcggcaaggagaccatcgacatccgcaccaccagcgattcgaagggcgtgtccggcagccacaccaccaactaccagcgcaccggacgcgaactcctcacgcccgacgagctcgcccaattggacaacgacaaatgcatctacaacctgcgtggactccacccgttcctcagcctcaaggcatggcccggaaccaccatcgccagaccgaaatccacgctcaagcactccaaagaatggaaggcagcggcatgaagcccaacagctacaagttcattgtctccacgaatttggatcgcatggaccgtacatcattcgtctccatcgccccgggaatcgctgtcagagccgactattgcatccgtgcgatggaggaccgcatcggaaaatacgacatccgcctgcacatggggtacagcgaggaagagcggcgcatcgtgttgcggaactgcgagatcggcaccacgcgcgaacttaaaatcagagacatcgcacggctgcccatcgagcagatcatccgttcttatcatcccccactgtggtcttatgagatcacggacagcgggaccaatatcttcggcccactgccggattgggaacatgatgtgctgagcagcgttgattttcccgcgctccgcaagcaaggccctacacccgacaccttgaaatgggcctcacgagtctattcggtcgctcagctcaacaaaggtcccgcaacaaaacgtttgacggaagtcttcggtatccctctgcggacagcctcacattggctgacgctcatgaaagagcgcgttcccgaatcagtttcgacgaggctcccatcacccatcaccgttcacgacgaaaccgaactcgacacagctcctggcatctctctaaagaagcttctggaataaaactgtctccttcggcaacgtcgaaggagacagccaaatcatgcccatatattcttacaacaccaagtccggcgacaaactgtatcgagttagctaccgcgacccgaatcacattcagctcactaagcgtggcttccggcggcggcagccgcggctgcttcctgttcggccttggccttcgcctccgcgtcggccttctccttcgccgtcttcgattcgttgacctctttcacggctttcgcgatggcgtccgcgtcacgggccttgaccgccttcagcagggtctcccgggtcttgtcgtccgccatcttgccgtcggtctccttgtacagcgcgatatcatgcgacggatacgagttagatgccgacaatggacaaacccgaagcatccacataattatgacaaggtgttgttaccctcgtcacttatttgactaagagtcacgttggcatatgattgcatggtcatctttctcgatgcgaacatatattcagaatagtatcctcttttattcgctgaataagctatctgatattcatattgtttaacgttcttatcggaatacaacctgcatatttgaggcgctttgtcataagtgagtatccagttccaatccggctcagcgacgaggcgcttcgcaaccagagagtggatggttgcggttgcatatgaattataaagattccgtccctgcacatagtaaggaggatccgcaaatatgaaactgttcttcatatcgcagaatttgccatcagaaagcaatttgaagaaatggctggcctctaggttgctaacagtgattctctctctttccgctgctattcgctctatcctcttcttgagtgtgcttttgttaaatcgagaagaaatgttgtatttcccgtcttgggcggcacctcctatcggcccacctttgatgacgccacttacgttcatgcgattaagcatgaagaagtcgaatcctttccgtcgaatatccgaataatggttgaaatcgtatcttttcctgatagccttccagtattccgagtatttcgaagattgagccgtgggcttttcatccgaatagtcaaaggggacgcggtcgatttcacgtagtagatattcgggttcgttgacaagagaataccaaaacgaatatacgccgtcatcaaggtcgttgataataactgcctctacacgacccgacaacaaaagattgatagcgacgcctgctccgcctgcaaaaggctcgatataggttccggttatatggttagtctccaacacgtttgccacgaaacgtgtgattttgcctttcccgccggggtatcgcaacggggtattggaaccgtttgtcagcttgctttgcgccataaacatgaatgatattagaagattcccattttggccagttcgttcgagtcatacgccctgttttttgaactgcacatattgctgacagagcatagcaaacaataccgcatcattcgacagcctcatgatggtatctatgtcgtaatccttcatagacttgtgcgacccaagcgatgagtattcaacggactcgccgaaatcggtattttcgattacactatgagcctcttggtaggtgtcgaatacaatcctcccggcctgcagatagtcttggaatttgttgtttttaaacagtctatggacatatgagacgttctctttatgctttgcgctgacccctatgttgggaagatgaatctcatcgcaggatttgtccaatgcaagaagtgacagttcgaagatcacacgtatcgccggcgcaatcaagaatgctttcgcccatcttttggtgctgtcgtcctccagtactccatatgcgttcaaagcggaaagcataaagttcgtgtcttcgaattccggcgcgtcggtcatccattccggattgttgtacatcgcaccgaggtgccggtctcgatttgtggcgaacttgctggcgaaatcatgattgagacgtttcgcggcaagtcttggcgacctgaccgttccttggcctttttcctgaagaggaatgattatgtcctgcttgatgacatcgttcttgaggcgcgaaataagggtgccgttctcttgacaataccccttaacctcatcagcaagttctttgactttgtccagttgctcgggggttattatatccggattcttgatatcaagatattccttgaccggagccgagttgaaaacccttctcgtgctggtcgtagcgttcgaacctccgagatagcttgtcaaggaatctccaaactgattctggaacggcgtttcaagcttgtccgaaaacgtctgctttcctgaaaagcgggctttggcctcagtgctccatggaatcgtgccggcaccgtcctgagggccgttgtgctttcgattgaggatttccctcagctcatcctgttcatcgtcgccgaaaacaacgatgtccagactgctcggaatgttctgcggatattccgcaacaaggttcttcaatctcttgtaatcccggtcatcaagaagttcacggtaacaatctgggttttgcagcaatttgattgcagacaatctcctattcgcatcgtgaatcacatacttgtcgccggcccttgtcgcaaggatcggctcaacatcgttctgatagccattctccgctattgacgatgcaagattcatcaattgccgctttgatgtcgattgagactgtgcgctgaagttatagattttattgagttcatccatctggtcgattgatggttcaactctcgggttcgtctcccagagacataaatccgatacatcgacatttatacgttccataaatagttcctccgctccaccaaaacaaactcaattcattaccttatcctatgtccaatgatatccccagacctcagtgttatcctctccccgttatctaattgaaagtacaacacacccgttagattcagcttgatgatcccgaacaccgcgcacacttggaggagctgtgccagcggttgagagcacccatacatgagtcagtgcagccaacatacgaggaggtcgccgactgggtgcataacctcgcgttgtccgtctgccggagagagcatgaagtcttcggctttcccctgcgaacggcctcgcattggctgacactcatgaaagagcgcgttcccgaatcagtttcgacgaggctcccatcacccatcaccgttcacgacgaaaccgtataaccgcgatcaaaaacggaaaacggctaaacgcagccacgatacgagccgactgcgtttagccgcataaatgtcgccaacgcgacgattaagcgatctacaatggccaagcacaacaatacgccggagattgcattaaccaaaacctgagactctggcgcggcgggtgctctaccggtcagagccccggatcgttgccgggcaagccggtgccctcgtctgatggcgcgggcacggaccatcccggcgaggctccgaccgtattggcggaggacgacgagcctcccgaagacgggcgtcgtccggttccggaaccggatccggaacttccttgggattgcgattggcttcctcccgaatatgagggcgtttgccgctgtggagccgattgggattgcgatgcctgcgcctgctgctgcgcggcggcagccgcggctgcttcctgttcggccttggctttcgcctccgcgtcggccttctccttcgccgccttcgattcgttgacctctttcacggccttcgcgatggcgtccgtgtcacgggccttgaccgccttcagcaggatctcccgggtcttgtcgtccgccaccctgccgtccgtctccttgtacagcgcgttcgcgtcgtcgacggtcttgtcgagtttgctgtcggtgacggccttggttgcggtcttgaggtcggtgagacggttcttgagctctttggtcgttctgcgcagcgcctcagtggtcctgtccacgtctgatgcggcggcgtcgggcgcgcaggaacccttgattgtggtcgtctttgcgtccaggagccgattcaacgcgtcaagcgtcttgggatccgcgacctggccgcgactggtgtccttcagtagtttggaggctttggccgtggtcctgtccaggtcggactggatggtcttgcgtgtcgcttcggccgagtcgcatgcgctgattgcggtctcatgcgcctcttgccgcacggcggcggcgtggcgggttttgatttgcggtcctatccaggacacggcgatgaggctcgcggccatgacgatcgcgacgagcgctttcccgaccgggaagacgcggcgaaccttcagatcgtcgaggtcggccgagtaggtgacggccgccgacagccctcctggtctctcggtcttcccggtttccgtcggttccggttccgatatgggcgggaggctcattgcggttggctccgggtcggcgacctgttcgagtgccgcgaaatcgccgtcggcgtccttcggggccttctccgcggaatcgtcgggatgggactgttccgtttccggttcgtgggaagaaccggaaacggaggattgcgaccgggatggctcctcgtccatagatgccggctcgggttcctgttctggtttgtcttccggcggcagtggcgcggatggtatggcgacgcggcggcgacggcgcatggattcgggaggcttcggcgccgctccagccgcgtcgaagccctgtgtctgcgcgttgtgccaccagtcgatgagtgccggccatgcgtgcgggtgttcggctatgaggcgcatccacgggcgccagccggggtcgttggccatggcgtgcagctggtcggcagtgagtttggggctgaggatcggctcgcccgtcttcctgtcggtcctgatcatttctcgtcgtccttgtcttcctccggcgtcttgtcgccgaggacggtgtacgcgccttcgaacggcccgctgatgccggtgcatttccagcccttgtcggcggcccatcgccatgtgagggtccatggcgattcaaggccggtccagacgctgcacgtcgcggtcgtggaggtgccggcgttcatgccgccggatgcctgtacgtcgggctggtcggcgattcggtcgatggggatgttcaggccctgcgcgtcggatgcgaagtatcgtttgatgagccggtcgcggtcggcggccttggaggtgtatgtggcggcggccttcggggcgagcttctcgcatacctccaatggtttctggtgtcttgcggccggcgtggacgttgatgtctccgccttgacgtcggatgccgcgagcttgttccgattttccgtgccggacggatgcatgaggatgaaggcgatgttcgcgacgaccatgagaacgacggccgcggtcgtggccgcgatgatgaggatgttccttttgcgctcgtccatttccctttccttcctagtgaatgaagctgacgccgccgcccatggccttgaggtcggacgcgctgatcgtctcggtgacgaccgccatccagcctttgccggattggctgatgaggatcgagccgtcggagttgacctgttcgacgaccgcgacatggccgtagtatccgctggagccgtgcacgccgggctcgaagcagatcacgtcgccgggcttcgggctccggccaaccttgtatccgaggcgggctgcggtgtcgttccattggcctccgttgcccatgtgcgcgtcgacgggtttgccgatctggttgcgtcgcatcgcggcccaccaggtgcactggtaggtgtcgtagtcggggaagcgcgtgtagtgcaggcccatggcctcaatgttcacgtgccagctgtcgctcatgacgagtttcgggctcagcgcgccgacggtcggacccgaatcgccggtaccgcccgaggaggtgtacttggtccgggccaggtcgacgatccgtttcacgtagttggtggtctccgtgaagggcggtatgccgccgtatttcaggacgctgccaaggccggcgttgtaggcggcgagggtcagctggagcgtgtcgccggtcagtttcccggacttcttggccgtctcgacctgcgaggcgaggctgcacatgtagttgccctggctccagatcgcgtcgtgcgggttccagatgtcggccttgccgtcgccgtcgccgtccttgcccgcggacgcccatgtggacggcatgaactgtgcgatgccctgtgctccggcggagctgccggcattcggattccaattggactcctggtcgatctgggcggcgatgatgctcggcgtgacgacctggcagatggatccggcgcggatcacgtcggcctcgtattccgcgggcatgcccgcgaccgtggattcgctggcgctggatcccaggaacgcgcccatgacggccaggagcacgccgagcaccgcgagcatggccgcgatgacgggcatgatgggaaggctgatggaggcggctcctgcgatgacgcgggacgcggccatgcgcacgaagttcgcggcggcgcgggcggcgcgcacggcggcctgtccggtggctttcgctccgcgtaccgccttggccggcgcgcggcggtgccgccagatgaatttggccgacgagttgacgcctttcacgcccgcgcgtgccgctttgaaggacaggtcgcgtgtggtgcttcccagcttcgacgcgaagtcgtcgtcggcagtggtgagccttgcgccggcttcgtccatccagcccatgccggtggatcccatccgtttgacgctccggccggcttttccaaggcccgcgcctatgtgcttgccgatccgcttgctcgccttgcctttcgcggcgaacctgccgatcttatcgctgggcttcgcctcggacagcgccttgggtttgccggccgtcttgcgcattcccttgcccgaccgcagggcgcgtttgccgcggttcatgatgcgccgcgccttgccggccgtccagcccacgccgtgcatggtggaggacatgccgtacatgccggcgcgtcccgccatctcggcggcggtgtgacccatggaatcggtgatgtcggtccggtccgcgccgaactgcgcggcgctggacaccacgccggtggccgcgcgtccgatgcgggcgcgtgtgcctccggcgtggtgggcttgggttccgctcatgcgtttactttccttcctggaaggtcgtggagtacagacggtagaggtcgccgcccgcggggatgcgaccgtcgaacggcacgtaggcgctgccgatcttcatgagtccctggccgggcagcacgccggtgaagtactggcgctgctcctcgctcagggtcagcagctcgcacagggcgtccgcgtcggtgctgttctggctcaggagcatgaggaaatcgctgttggacagcatctcgcgcgcgtcctggaggtcgaggatctcctcgacgttctgcgtgatgccggtgacgccgagcccgtatttgcgggcacgcttgtagatgtccttgaactgggcggcggcgtactggttggagaagaagcggtggaactcgtcgacgtacagccaggtgcgccgcccgttggccttgttgcggatgacgcggttccacacctggtcgatgacgaccatcatgccgaacgtgcgcagctcgccggacaggccggacacgtcgaacacggtgaaccggttggacaggtccacgttggtctgcccgttgaagccgctcatggagccggtgatgtacgggttgagcgcgtcggcaaggtaccggctcacctggtcgccgcccgcctgcaattcgtcgtgcaggtcctgcaatgtgggctggaccactcccccgccctggttgcggtaacgcgtgtacaggttgctgacgcactggtcgacgagtcccttctggagcgggtcgaggccgtcgatgccgcctatgagcgcgccgatcatggagaccacgttgttggtcttgtccttgacggggtcggaggccgaatcatcctccaggacgatgtccatcgggttgacacgcgtgccggtgccggcgctgatctggatgatctgtccgccgaacgcggccgcgagggcgaggtattcgcgttccgggtcgatgacgatgacctcgtcgtcacggttgaggaacatgccggcgatctcctgtttgacggtgaaggatttgccgccgccggacgtgccgagcacgaatccgttggagttcatgtggctgcgccggtccgcgaggatcgggttgccgctcctcgcgttgcttccgtagaacaggccgtgcggctcgaacacctcctgcgtggtgaacgggatgaggatggccgcgctgttcgtggtcagggtgcgtttcatgggcagagggttgttgcccagcggcagttcggccgtcagcccctccatctgcatgaacttgaggctctcggccgtgcaggactgcgcgttgaccttggccttcacgttcctgcacgcgacctccagctcctcctggcttgccgcggacactccgatcacgatgatcgagtccacgagcctctggttggtggagcgcagctcgtcgcgcagttggccgagctgttcctgctggtcggcgaggtcgtcgggaaggtcgtcggggtcgaggccctgcttgcggttcgtgcgccgctgatccatgatctgcatcttgacctcggcgttcttgcggcgcacgagcgtcatgctttcgccgcggtccatgggcgcgaggtggatgctcacgtcgacgcgggcgcgcagtccggtcaggtcgttgaccagctggtcggacagttccggcggcaggccggacacccacatggtgcggtgcaggtatttcgagtccagggattcgatgtcgagcatggtcgggtttcgcgcgtcgatgctccacgggcacacgaggtccttggtgtcgggtttgccgggctgatgctcgaaacggcgttcgtcgaaccggaactcctcgccgggccggagcacctcggccatgaggcgcagccggtgctcgcggtcgagccgggtggccttgcatgcgtcgatggagcgcatctggctgacgaggttgttgcacagggcgttcaggctcgcgacggcggcctgctcgtcgctttcgcggacggtgacggtcagggtcttgacggtgctggtgttgcggctgacggattcgagtttgccttgggcgaggcggttgtagtcgagcctgtagtggtcgaggctgtcgccggtctcgtccatcatcacgtcggcgaggatctcccgcacgccgcgtgagcgcgtgtaggaggcgatctgcacgctttgcccggcctcgaagctgttgatgagcttggcccaccggtcgatgatctccatctgatgggattccgggctcagctggtagttgatgtcctggaagaggatggtggcgctccaccgcccgtcgcccaggctggcggtcccgttgcgcagcatcgcgtcgtagccgatgagctgcttgacgcccttcggcagacgcgtcgccttctttctccgcgccttcgccctggcttcggcaccgccttcggccggcgcggccaccggggctttcttctttccgaacattcctcacctttccttgatcgttggtttcgcgccggtgcggtatggtctgcccggaccgtcgagcaggtagacctcgcgctgcgtgtagtggcgcaggatgtatttcaggtatttctcgggcatgaggccctttggcctcacccatccccatatggccacgggcaggccgggcgggaagatcaggtacatggcgaggttggggtccatgcccaacccgagccacaggccgatgtaccctcccccgcacacgacggcgaggatgacggcggcgaggcactgccgccagctcattcccatgaacaccttcgattcgatggtggtcaattccctgtagacgggcatctgcaacgccatgatgattgcttcctttcgtggattgcgttgtgtttcattcgccgccgaagagcttcttggcgacggagttggccgccatgacgacgccgatgagcatgacgctcgccaggagcaggccggtgaagttgcccatcacccagccggagaggctgtcgccgtccttgaacttgctcgggttgagcgtgccgcccacgagcgtgcggtacatgaggatcgccagatacagggtcgcgcactggaacaccagcgacgcgtactgcttgaagtagttgatgccccactggcgggtctcctcctgggcgatgaacgcgatcggcagcgggttgaacgcggtgagcatgtatatctgcacgaaacgcaggaggatgacgacggtgacgacgatggtcgcgcccttggagacgaggaacgggatgagcagcaggatcaggcacggtatctggcccatccagccggcggagtcgatggcgtcgcgcatgctgtcgccaaggccgaggcccgacgacgcgccgctggtgtccaccgacgactggatgccgccgagcacgctgtcgccaatctcgtcgatggcctggagcatgagctcgctgtgctgggccgcggtgaacacgagcgtgagcttgaacatcgccatggcgacgagcttgacgcccagctctcggtcgccgtccgcccgggtgctgaccctggcgagttccaggacgcacatgatcgccagtatcgtgctggctataggtttgaccgccgagagggcgacggtcaggctcagctggtacatgtccgcgttgtattcggcgggggtcttcagcaggtcggccacgaggtcgtcgccgacgccggaccctatcgagttgaggatgccgacgatgaaatcgaccatgcgtggcctcccgtctacagggcgatgttggagaacagggccgcggccgcgatgatcaggccgccgccgacgacctgccagacgcccgactgggtggcggggccgttctggtccttcaggccgcccgccagggtgaccacgccccacacggcccacaggcctccgccgatgatggcgaactggctgaagagctgcaacgcgctggtgacgacgctgccgctgtctgccgcgatggtgattccgtacatgatgttttcctttcgacttgttttgaatgacatgaccacggtatggccgtcgagaaggctccggtttggacgttcccgacgaacccgaagaggctcggacgatggtatggaaaaggccccgccgaccgttcgccggtggggccttggacgcgtccgggaagggaagggatccgggcgcgcccgtgggcccgtgcggcggatcatggcgaacggtccgccgcgggcccggggtcaggttcgtcggatcactcctccgagccctcggtgtcggccggggccttcgccgcgcgtcggcgggacgcgatcagcaggcccgcgccgccgccgaccgcgacgagcacggccaggacgatcgggacgatgcccgcgccggtgatggcgagcggcttgggacggtagccgttccagtcgtccgggttggagtccaccgtggtgtcctcgcacagggtgcggccggagacggtgacctgcttgaggccttccgccttgccggcgtcgccgtcgacggcctggtcgccctcggtcctgccggactggtcgccgagctggtcggtgacggggcattcgacgagcggggtgccggtgaccttggcgcggtcggtgtggtggccgccctcggtcacgcccttgagggtgccggtcacggtcacggattcgccgggcttgaggaccagggtgtcccagttggccggggtcctgatgtcctcgaccttgcccagtccggcgatggtgccgtcggtgagcttcaggtccttggcctggaaccacgctccctcgccggtcgtcggatcgaccttgctggtgttggtgatcttgaacgcgatctccaacgagtcgccgtccatcttgagcgcctgcttgacgtcgtcgcggtcgccgagcttctcgccggactccgcgtcgtacttctccaggtgcaggctcggggtcatgtcgggcgtgcgggtccacacgacgttggattcgaggtccttgccgttgaagtgctcggtgaaccggttctcgacgcggtcggcggtcttgatgcgcttgcactggatgtacgcgcgccagccgttctcgtgggcggtgtcggccgagacgagcttgcggtaggcctcggtggcctcgacggtcacgacgccctggtcgtccgcggacgcggtgaacaggtcgccgccgaacttcgagccgtcgaagccgctgccggcgagcttcgcgcccttggcggcgatgatctcgccgtcgcggtgcaggtcgcgggtcgcgtacacggcccactggccggtgtactggtcgtgctcgacgtcgagttggtcggtgatggaccaccggtcgacctgcgggtaggcgcggtcggcggggatcacgctggaatcgagcctgtagaggaacgtgcggccctcgtacacgctcttgccgttgacggaatcgccgccgaccttgacggtcacgtccttggccgggttgaccggcttgagcgggttggacacctcgttggtctcggccttcgtgtcgttggtgacctggacggccttgttcctgacggtgtagccgtccgtgaccttgacgaccttgtacggcatgacgacctggtattcctggccgagcagcgtctggtcgatggccggctcgttgagcgggtcgtgcccgctcgcggaggcgtaggcggcgaggtcctcgggctgcgggtcgcccgggatggtcctgccggtcttcggcacgaacgtgtccacggtcttcgcgtacacgtaggcgacgccgtcgcggacctggacgttgaacctgccggtcacgtcctcgccggactggtcgagcacctcgatgtcggacgggaggatgctcacgtactgctcgtcgtagtcgtcggtgatgccggcgcgccacacgcggtacgcgttgtccttctgcttcaggtcgagcgtgaccgtgtagttgccggtgtcgccgagcagcatggtcttgccgtcgatggtgacggtcgggtcgccctgcgcggaggactgggtgtccttcttgctcgggtcgtgcttgggcgggttgttctccacgatgttggacggggtgacgctgccgttcagggtcagcgcccactggttgccgaccttcacggtcgtgggcgcgtcctcgctcacggtgccctcgaagcggacctggacctgcgggtgcgagcccttcgtccagtgttcctgcacgtacttgtcggagtaggcgatggtgagctcgtggctcgcgtcgtcccatacggccgtgtagtcgccctcgacgcccatctgggggtcggcggtgacgagcggggtgccggtggcgaggtcggtgatctcgagggtctgcttgtccgggatcaggtactggtcgtacgtgtcggtgtcacgaacgtgcacgacgtcgtaggccaggtcggccggcagctgcggcttcgtggtcaggcggtattcgaccctttggcccgggtacacgaccttgtcgttcgcgtcctggttcgcgccgccctggctgccttcggctatgaccttcttcttgaccggcggcacgtagccgcagatgtacggctcgttggtcggctgggtctcgtcgttgaccttctcgctgcccgagttggccagcttggagccgtcggggttctcgcagaacgtgagctcgtcgcccgcggccttgttgaagtccttgcggacctgggccgcgcccttgccgtccgcgaagtccacggtgccgggcaggaacagggtgatctgcttcgggttcttcaggccgacctgctccgcgaggtagtcggcgtgcgccttggcggtgaccctggtgccgttgacggtgatgtcgaagcggtcggtcacgtcgcggccggtgttgatgatgtccgcgacgctggacttcgcgtcggtggccgcgtcggcctcgtacacgcggatccggctcctgtcgccggtcaggtcgaacaggtagtcggccttggcgtaatcgtcggtcagggtgatgtcgttgaccttggcgaggtcgttggcgatggtgccgttgacgacgctgccgacctggtcgccgtcgaggaacttcatggtgtccgcgccggtcttgttggattcggacgggtcgatgacggcctcccatttgccgttctcgaggcggatccagctcttgtccgggttcgggctccattccttgacgggcggctcgttggacgggatctcctggtcgttccacttctcccagccgccgttggtcatggtgaccttctcgccggccttgagcacgcccttgaggtacgcgccctcgacggtcatgcgcacggcgcggtcggcggcggtgttgtaggtcgtgtcgagcagggacttcttggcgctggcccacaccttcgtgccttccttgtggatgtcgaaccggtcggtggagtccttgccgtcgatggtgacctcgacgctggccttgtccaggtcgatgtacttggccgccttggcgaagtcgtcgccgatctcgtaggaggtcatcttcctggcgagattccccgggagcttgccgttgacggtcacggcgaacgtgtcgcgctgcacgaacgtcttcgtgtcgtcggacgccttgttggtccatgcggggtcggacgactgcgcggccttggcggcgtcgacgctccacaccttgtcgggcttggggttgcgcacccagacgggcggttcgttcgtgccggtggtctcgttgttccacgtctcggacgccttgttggtcagtttcctctggtcggccgcccagtcggcgttcggggccttcctgacgatgccgccgatgtacagcttgaccttgcggccggcggtgcccagcgcggtcctggtgaggaagacgctcttcgcggtcgcggtggtcgtgtgcttcgcggtgtcgatggcgatgtcgaagttcgcggtctcgtcctcgccgtccacgtacacgcgcacctggtccttgtggccccagtcgatccactggctgctggcggtccagtcgtcctggatgctgtagctggtgaacgggttcaggagatgggcggggatgcgtccgttgacgacggcgccgatcgcgtcgccggtcacgaacgtgcggttgtcgctgcccttgtcgttggtgtgctgcgggtcgtcggccttcagcgccccgtcggggtcgagcacccacaccttgtcgggcttcggggtgaccttgccgacctgttcgctgttgccggtctggcagtccttgccgtcgccctgccagcatgccctcgaatcgtcggggatgtcgtagtcgacgccggtgggcttggccgcctggggcacgttgagcgtgtaccagccggacgcgggcctgacgacgtgcgccttgacgatgcgcttgcccgtctggccgtcatcgatcgagatctcggcctggacggtcttgccgtcctcgtcggtcacggtgatcttggacgggtcgtccgtttcggtgccgccgatcacgacctgctgcgagctcacgtcgatggtgtcgtacagccagaaatgctcggaggcggagctgtgcgccttgacgtgcgcggtgtagaggctgccggacgcgatctgaccgttcggggccgtgacctgcccgccggccgcgtcggtcagcgtcttggagggcggcgggagctgcggcgcggaccactgctcgttcgcgtccttgtcgccgttcagggccacggcgttcttcatcctgccctgcttggcgaagctcacgtcgaacgcgaacctgccggccggccagctcttccaggaggcgtccatgtccttgtaggagaaggacacgtcctggctcgcctggttgcctatggtgaactgcttgctggccttgcggatggtgccgtcgacgcctgtccagcgcagggtgctggtgccggtcaggttctcgctgatcgggctgccgttgcggctggtggtgatcgtgtcggccacattgcgcgtgtcgccggccttggtggtggtgccgttcgccttggtggacacgcccaggtcgtagttcacgggcggttcggcctggttgagcacgatcgcgatgaccgcgaccggcgccttgttcatctcacgggacgccaatgcattaatggtcgtcgtaccgtcagcgaacgggctggaggtcttgtatccgacgccctggtaggtgtaggtgttgttcgggatgccggacgcgacgtaggcgttgcgccatacgtcggcgttgaaggtgccgttggcgccggtgtagtagtcgccagcgctgccgggcgtgtggacgaagccgaggccgacgagacggcactgggcgttggacaggccgtcggccttggagcggtccgcgcattccgtgttcgcctggttcagcgcctggtcgatcgcctggttggactgcgcgacgccgaggttcctcacgccgatgctggccatcgcggcgacggcgttctcgcgggtgggcgcgccccaggagtccttgtagacccagctgaccttgccggtgccgatgccggtgccgccgccggagccggacccggatcccgcgccgccctcgccggcgtacgccacgcacggggagagcagcgtcgccgcggcgacgatgccggcgaccaggggcctgagcccgcggcgcttcttgtcgttcttttcggaaaccaatgttccctctcctttcagggattcctgtcttgcgggtcgccccggcggtgccgccggggcgggacgtggggaacgcgtgttcccccggtccgccgtggggcgggcccgtccggatgttccacgcgggcgggcgccgataacatgcgatatcgggcgcgtccggtgcacgcacaccatggaaccaccgtccggggggcgtcggtttggacatccgccggggatgggaagggccccgcgacggatgccgcggggccctgaaagaggagaggggatgggagggaatctaggcgagagggcagaatttgccgggctcacacacggagggtccgacataatcccagtcgaatccgtccgctgctccggcgttggggtcggtccatgccgatccgcccgatgacgaggagccgggcgagccgccactcggtgtggacgtgttgccggaataaccgttgccggtgtagccggtgtggcctgaaccggacgagggccatgactgccgcgcctgcgccttctgcgcggcggcagccgcggcctcctgttcggccctggccttcgcctccgcgtcggccttctccttcgccgccttcgattcgttgacctcgtcgtgcggatgcgactcgcgcaggccggcgtcggtgatgcggatgaagcggcccttctcctgcagctcggcgatgttgtgcgcgcccacatagaacatggactggtgcaggccgccgatcagctggtacagcacggcgttcagcggtccgcggtacggcacttcgccctcgacgccttccggaacgaccttgtcgttggaggtgacgtcggcctggaagtaacggtccttggagtaggacttcttgccgcgcggggccatggcacccagcgagcccatgccgcggtacagcttgtactgcttgccgtgcagcaggaccttctcgcccggagcctcctcgcagccggccagcgtgccgccgagcatgacggtgttggcaccggcgacgagcgccttggcgatgtctccggagtagtggatgccaccgtcggcgatgcacggcacgccggcggccttacatgcctgggcggcgtcatagacggcggtgagctgcgggacgccgacaccggcgaccacgcgggtggtgcagatggagccggggccgacaccgatcttgacggcgtcgacgcccgcgtcgatcatggcctgggcgccggaacgggtggcgatgttgccgccgatgacctgcacgccgcggaaggcggggtcgcgcttgatgcggctgatcatgtcgagcgccagacgggcctcgccgttggcggtgtcgacgacgagcacatcgacgccggcctccatcagagcggaggcgcgctgccaggcgtcgccgaggaagccgatgccggcggccacgcgcagacgtccctgctcgtccttggtggcgtccgggtactgctcggtcttgacgaagtccttgacggtgatcaggccggcgagcttgccgttgtcgtcgatcagcggcagcttctcgaccttgtgctgggcgagcagacggtgggcgtcatccttggagatgttcgccggaccagtgatgaggttctccttggtcatcacgtccttgaccttgaggtggtcgtagtcttcggacgggatgaagcgcatgtcgcggttggtgatgatgccgacgaggcggttctcctcgtcaacgaccggcaggccggagatgtggaacttgccgcacagcttgtcgaggtcggcgagcgtgacgtccgggttgacggtcagcgggtcggtgatcataccggactcggagcgcttgaccacatcgacctgggccgcctggtcgtcgatcgacaggttgcggtgcagcacaccgataccgccgttacgggccatggcgatggccatctcggattcggtgacggtatccatcgccgcggagatcgccggaaccttcatggtgatctcacgggtcagatgagtggtggtgtcgacttcggagggaatcacgtccgtctcgttcggcagcagcagcacatcgtcatacgcgaggcccagcttggagaaaatcggggggacgggagcataggattgcatattcgcttcagaatttgtagccatgcattcactatatgagcgtaatgcgacgaatgcgacacgaacatggtctcgaccatcatcatcggcaggtcacgggcgccgttttttcccgtcaccgctttcgtcaaacgaatgacgtgcccgtcgccgcgcggatgcatacgactggttctccgcggcgatctccggcaggcgacgcttcagatacgggtacatcgtcgccaccgtcagcaacaccacggcgatgacgaagccgatgagcacataatggaccttgaagaacaacgtcatgatcgagccgaccgcgatcagagccgcccacccccacagaatcagcaccgctccctgcacggtgtggccgatgcgcagcatgcggtggtgcagatgcatacggtccgggtgcatcggcgactgcccgtggctgagtcggcgcacgatcgccagacacatgtccagcactggcaggaacagcaccaggatcggcagcaggatcggcatgaacactggcaggtacacgctggcatgaatcgacgccggatccagacggccggtcatcacgattgacgcgcaggtgatgagatacccgagcagcatcgagccggagtcgcccatgaacagcttggccggatgccagttgtgcaggatgaacccgacgcagatgccgaccatcgccacgtcgatcagcgtcgccatcgaggcgtaggacggcgaattgcgcgcgatgatgtaggagtacgcggcgaacgcgacgccgccgatggcgacgatgcccgccgcgaggccgtccaggccgtcgacgaaattgaccgcgttgatcgacgcgacgatcagtatcgcggtgatcgtcaccgagatactggggctggcggtgatcagggagccgagcggcagcgatatgatctgcaggccgccccacgccacgaacaccgagatcagcagctgcccggccatcttcagcatccagtccagatcccacaggtcgtcggccatgcccagcaggcatatcagcaccgcgccggcgaggatcacccactcctggttgttgttctcgaacagtccggtcgtgaatgcgatgcgactggagtagatcattgcaaacgcgaatccgatcagcatgcccagtccgcccatgcgcggcgtcgggatggtgtgcacgtcgcgcgcacgaacctctccgaccgcgccgatatggatggcgacatggcgaatcagcggcgtgaccagccaggtgacgccgcctgcgatggcggcgatcagcagatatatcctcatgcgcccagaccaccaccgttcatgtgcacggccttgcgcacgacgggctgagggatgacaccctctcgcaggatgacgatgccgtcgcgctcatgagggtcggcggcgaccaccgtgctggcgacatggccttgcgtcggcccgccgtcaagatacagctgcacatcgtcgccgaacgcctgcacggcctcttcgaccgtctgcgcgctttcgtcgccggaacggttcgcgctcgacgcggcaagaggaccgagctcattcaatacgcgcagggtcagggccgaattcggcacgcggatgccctgcgtacgcctgccctgcggggtggcactgaccgtggcgagcgtgcagtcctcgcgggccaccgcgatcggcgagaacgcaccaggcaggaactgcgcggccagccggttcagcggcgacggcaagtcgagcccgagcccgtccaactggtcgacggatgccagcagcacctgcagcgctttgaagcgcgggcggctcttgacctgatagatgcggtcgattgcggcctcgttgcgcgggtcgcaggccacgccatacaccgtgtcggtgggaatgaccaccaagcctccgcctgcgatgaccgacgccgcctcggcgagggattcctcattcaccttgcgaaccgcactcatcagacctcccgtatcgcgtatcacgcccatcgcggcggtcacatgccgccgcgcgtatccgaataccgctatccaagtattatggcacgtcctgccacaccgatggtaggccggtgcatggcccgacgccacgggttcgctctcccccgcgtcgcgcgggccggcctggacacggcttcccattgcaccattgcgccacgacttggcgctggccggcgccggcgacgacgggcctcatgtgacggtacgtcggagagacacgaccgtatccgcccgaaatcccgccgatcccgagctctccgctatgcgagagcgcgcaggcgacttgtgcacccggttcaacgcgctgcctcggggagaccatgccggccgagccgcggtactggacgagctgctgccgccgatgcatccgatccggttccaggaccgcaacgtgcggcgtgcggctgacgggtcgtattacgactacgagtatggcaagccgatcgtgatcgggtcgaactgctggttcggcggcaatgtgacggtggtcggcggcgtgacgatcggcgagggctgcgtgatcggcgccggctcggcccggccacggcatcagatcctgggtcaggatctgaccgcgaacaggtaccggggccggccggtccagtcgtcgccggtatgagcctggccgaacccgttggcctgtgcgaaggagaccagccgcggcccctgagagatgtcatgctccatcaccagcacgccgccggggcgcagcaatcccgccgctcgcatcacgatccgctccggtatcagcgtgccgtcggcggagccgccatacagcgccgccttcggatcatggtcgcgcacttcgggctgttcggggatctgcgcttcggggatgtacggcggattcgtgaccaccatgtcgatggtgccgtcaaactgggccagcgtcgtgccgctggtggcgtcgccgagctcgagatgataattatcggcggccagcgggtcgagacgtgatatcctccgccagttgcgcatcgtccagtcataggtgcgcggcaccttctcgaccgcccacacctgcgcgccgcgcacctcggtgaccagggacagtccgatggcgccgctgcccgcgcacaaatccacgatacgcggggtggacagccgttcgcgcgtgagccagtcgatgccggcctgcaccacggtctcggtttccgggcgcgggatgaacacgcccggaccgacttccagatcgaggtagcggaacggggcatggcctgtgatgtactgcaacggttcacgtgcggcccgccgagcgatcatggcgtggaatcgggcgagcgccgtggtgacggcatcgcccgcagtggcggagctgtcggagctcgcggcgccggcatccggggcatcaaaactcgcatgctcgtgtggcaggccgtccagaggctcccccatcaacatcgccttgtctatgtcgcgcaggtcgcggccgcacgcctcggcgagcaacaacttggcatcatgctcgggcgtgtcgatgtcggcgtcatgcagcgttcgcgccgcggagcgtatcacgtctgtcacgtcatggatggattcggatgtcatggtgtccttccgctcgttggtggctcatcgtctcagggcgttcatatcacggcgtttcgcgccggggcgtctgccggcatattcgccattgcgtcgctatgtgcgcgccgaaacgaagtacgcgcgcacatagcgacgcaaaccacggattttccgttcctaagtgcgcgcacttgtcgtttcggcgcgcacttagcgacgcagagacatcaacgggggtgcgattccccggggaaccatcactctgaccccgccgatggcccggtcactgctggttggcgagccgctcggcctcgtcagcttggatgtcggagtcgatcacggcctgcaggtcgccgtcgagcacggcgtcgaggttgtacgccttgtagttggtgcggtggtcgacgatgcggttctccgggaagttgtaggtgcggatgcgctcggaacggtcgagcgaacgcacctgcgagtggcgcatatcggcagcctcggcggcctcctgctcgtgcttcatggcgagcaggcgcgatttcaggacccgcaacgcggcggcgcggttctggatctgcgacttctcatcctgcatgctcaccacgatgccagtggggatgtgcgtcatgcgcacggcggagtacgtggtgttcacggactgtccgccgggaccggagctcatgaagatgtcgattttcatgtccttcggatcgatctcgatctcgtcgtcgtcctcgtcggcctcggggaacacgattacaccggccgcggaggtctggatgcggccctgcgattcggtgacggggatgcgctgcacgcggtgcacgccgccctcgtatttcaggctcgcccacacaccgtcctccggcgcgggcgtgcccttggcgcgaatggcgatctgcacgtccttgacgccgccgagctcggtggtgttctcggactgcacggtgacggcccagccgcgcttctcagcgtatcgcagatacatgcgcagcaggtcgccggcgaacagcgccgcctcctcgccgcccgtaccggccttgatctccatgatgacgtcccgggcgtcatcggggtcgcgcgggatcagcgcgttccgcagcttctcctcggccgccggcagctcggcttcgagccgcttggcctcatcggcgaattcggggtcctcccccgccatctcgcgcgcggcctcaaggtcgtcgcgcacggccgtgtatgactgatacgcggatacaatcgcgccgagttcggcatgacgacgacccagcttgcgcatcttatcggggttcgtcaccacctcggggctcgccatctgctgttcgatggattggtattcctccaacgcggtctgtgccgcggggaactgctcgactgccatgtctggcttgtccttccggatagtaacaacggtcggcaccgcgtcatcatcgctgtcgcgacgccattacagatacaaaaacgccagtcccccgagcgggtgcgccgaagcgcgcccaacccgtgcgggactggcgtcagatacgctacttggtcttcttgccgtaacgcttctcgaagcgagcgacacggccaccggtgtccagaatcttctgcttgccggtgtagaaggggtggcacttcgagcacacgtcgaccgtcatgtggtcgcccttgtaggtggaacgagtgacgaaggtgttgccgcatgagcacaggacttcaacggcatgataatcaggatggataccctgctgcatggttttgtctcctaggggattcgggggacccgggtcgccgcgccccgatggctggcgtgaaccggaacctacggaagtatacgccgaggcatggatttcagtggggccgcaggggcttgaaccctggaccggcggattatgagtccgatgctctaaccgactgagctacagccccacgttggcgaataggccaactatattattgtatagcagaccatcggacttgcgacaccctcccaaccgcccatcgtctgccacggctatcatgtcggcagggccggcaatcgggccgggacacgcggaaaggaacgcacatgcgcattgcggtaccgctgcccggcacgatgtgggcgttcgacgtcatctccatcatccagatcttcgacgacgattccgtcatgtacggctcgtccgaccgtccggtcatcgacttcatcgcgaatgcaagctccaaggcactcgaccacggtatgtccatcgccaccaccgcgctgcgcgactaccacgagaaacctgatctgatcatcatccccggtttcgccaacccgcttgagatcgccaccgacaggcgcaccggggacgccaaggcatggctgttcacagccgatcccgccgacgcgctcgccatccgcgactggctggtcgcgtcccaccgcgagggcgtggagatcgcggccatgtgcacgggcgtgttcgcgctggcatggaccggtctgctcgacggcgtggaatgcaccacgcacctgccgttcctcgacgatttggccgcgcagtttcccaaggcgctggtgcagaaggaccgtctgctgacgcacaacgcgaagcagcgcatctggacgtccgccggcggcagcatctgtctcgacctgtgcatcgcgctactcgccgaacatgccgggcagtccctggcgacggcggaggcgaacatgctgatgatgcattacccccgttcggtggccacccggcgcagcgacggcgctccatccgtcttgccgcgaccgtcccggcagagtgacgagatcatcgcgctgacccgcagggtccgcgagcatctcagttatgactggacgctgacgacgcttgcacagacctcccactcctccacgcgctcgttccagcgccggttcagcgaggtcatgggggtgccgccgagcacctggctgctgacggagcgtctgaacgccgccaaggaactgctggagctcaccgatctgccgatgcagcagatcgcactgagaacgggactgcgcaacgcggattcgctgcgcaagcatttctccgccgcgttcggcgtcagtccgagtcggtatcgtcaggattttctgcgcaccgaattgcgtccgacggaaaacgtgtgagcccgctggccggcgaaacgaacatgaggagtcggatatcggccacatgacgcggatctctctgtgttcgttttgttcggtactgtgcgcattcctcacacttttcttattgagaatgattcgctgaaccatcggcggggcaaagtggcgcgttcttaccgatatttggcgcgaaccgaccgcatcggcacccggttttcccgcgaccgacgcttagactcggacttgaaacaatgttgttaacgccatcatgacagacgcggatgtgtgtcatgccggcgcgatgaaaggatacgaacatgtggcctatcctcttggccctggtccccgcattcggctggggttttcagggcattgtcatgcagaaggtcggcggcaccaccgccaacaagcagatgggcatggtgctcaccacgctgctgttcggtatcgtggtgctgatcttccacccgatcaactggtcgtggacgctgatcgcggccgcggccatcaacggcatcccgtggagcatcgcgcagatactgcagatcaagtccttcgactatctgggcgtggcccgcgccatgccgctgtccactggcatgcagctggtgttcaccaccctgctcggcgcgctgttcttccatgaatggacgcacggctggcagttcggcttcggcatctgcgcgctcgtcgtcatcatcgtcggcgtcgcctgcaccgccttccaggagaagagcgaggacaagggtccgtcgaacctgaagcgcggcctgctcatcaccctgatctcctcactgctgtataccagctacgccgccgccggcaagttcttctcggtctccagctgggacatgctgttcccgcaggccgtgttcatggtgctcggcacgacaatcatctccttctgcatgagcggcaaggacgcgatggaccccgaaatcggcgtgttcggcaagaagagctggatgaacatgagcaccggcgccctgttcgccaccgcgaacctcaccgtgatgctgtccaatgagatgaacggtctggcggtcggctggacgctgtcgcagatgaacgtcatcgtcgccacgctgggcggcctgttcattctcaaggagaagaagaccaagaaggagatggcgttcgtcatcgccggcatgattctcatcgcgctcggcggcatcctgatcggcatcacgaagaacgcatgaccgccgcccgcgcatcatcaaccatcaaccatcaaccatcaaccatcaacaagtcaacaagggagtatcaaccatgatcaatgtcggtttcatcggatgcggcgccatgggccgcgaccacgtgcgtcggatcacggacaagtgcggcaacgcgcaggtcgtcggcgtatacgacaccgtgctcggcaacgcgaagcaggccatcgaagacaaccgcctcgacgcgacgatctacgattcggccgatgcactgatcgacgacccgaacgtcgacgccgtcgtcatcgccagccgcaacgacgtgcatctcgacccgctgctgcacactatcgcgatcggcaagccgacgttcaccgaaaagccgatgaccatcaacggctccgacagctggaaggtcgtcgaagccgaggtggccaatggccgcaagaccattcaggtcggtttcaactggcgcttcgaccccggctacgacgcgatgaagaccttcgtcggcgacggacagatcggcgccctgctgatggccggcatgcgtcactacaacgcgcaggcatccacgagctactacggcaccgacaacgtcatcaacgacacgctcatccacaacttcgacatgctgcattacatgttcgacggcgacatcaccagcgtcgagatgaagttcgcccggatgaacacgctcaacccgaacggggagtccctgcgcgaaccgcagctggccatcgtcgagttctccgacggagccctcgccacagccgaggcgaacgtcaactgccagtacggctacgacatccaatgccgcctggtcggcgagtccggcatcatctcgctgccggatgtcgccacgccggaggtgcgcaaggccggtcagatcagccacgcgatctcgtccgcctggttcgaccgattcatcgaggcatacgaccgcgagttcgaccggttcttcgcgaatatcgaggccgaccggcagccgggcggcaaggaggcgaccgcgtgggacggctatgtggcgaacgtggttgccgacgccgcgctggacagcctgcaccacggcgggcgcatccccgtgacgctcaacgagcagccggcgctgtaccggtaatccgccgtttgttcaacggctcaggccgcccaccacggacgcagcgggtaccagttgcccttcggcagcccctccttgtcgggcttgacggcgaggaactgatgcacctggatgccgttgagctcgaagttcaactcgcacgcggccagatacaggccgtacaccttcgcccgctcgtagccgacctgcttgacggcgtcggcccagttggccttgagattggcgttccaatgatgcagcgtcagcgcgtaatgctgccgcaggttctcctggttgacgacctcgaagccggcgtcgtgcagcgccgactcgatgaacccgggcgaggcgaggtcgccgtcggggaagatgtatcggtcgaggaactcgtccgttccgggccggttgttcggcttgtccttggagatcgtgatctggtggttgagcaggcggccggccggcttgagcagcttgaacatctcatcgaagtagtggcggtagttcttcgcgcccacatgttccatcatgcccaccgaggtgatgccgtcgaagtctcgttccggcacttcgcggtagtccatcacgcgcagctcggccagatcctccagcccttcgcgcctgatccactcctgaccgtactcgatctgctcgtgcgacagcgatacgcccagtgccttgatgccgcgcttggctgcggcgatgaccagagcgccccagccgcatccgatgtcgagcatgcggtcgccgggcttgaggtccagcttgtcgagcaccaggtcgattttgttgcgctgcgcgtcatccaggctcatgtcgggcgtgtcgaacaccgcgcacgtgtacgtcatcgacggtccgatgaagtcggcgtagaactcgttcgacaggtcataatggaagctgacggtctcggagtcggccttttcggtgtgcgggaacagaccggacttgatgcgttcgaatttcgaggggccttcggactgcggcacctccaccttgtggtagccgtggctgagaacggccgcccccatgcgcgccagttcgagcggagatggctttcggatgtacgatgccagttcgacgagcttgcgcagctgcggatacgggtcggccacgtccagtccttcgatgtcgaagtagcccaggatgtatgcgcgggccaaaccgatctcgttcaggttgctcgccaactgatagatggccttaggactggtgacccggacctgcaggtcggcgtcttccggcccgaacgtcgatccgtcgaaggcttcgatgcacaccggcgcgtcctctttgaggaccgcctgcgccatttcacttaccaacatggtttttccactgcccatgtttcgcctcttttcccaacgactgtgccttgccggatatggcaatcaccgtgtcactgtagtcccgcgtcgtcatttttcgcgctgcgaggaaacagaaatcgctcactatgcatgcatcgggcaaccactatgtgaccggtcactctgaaagcgagcatttggcggatatatatggacagcgcggccgcgccagtcgcattccgcatgtgaatcggaatgcggccagcggggccgcggttttcaggatgatcccggaccagccgtcatgagacggcgttcatgtactccttcagggattcgccgatgccgccggactcgccagacgacttcaacgcggtgacgtgcccgtcggtatcgacgccaagcactccggagattgggttgatggcattgtagacgacgtcatattcgttgagtagcagcaggaactcggcggtgccactcgccttcgcctcgttcagcagcgtggttgacgtctcgcgtcgaacgatgccgctcttgtcgacgccgcccacctgcgcgacctcaatgatgtcgccgactttcgcgtcgcccttgatgactttggtgacacgcacccgggtgacggtctccggcacgcccagcgcgtccatgtcgatgtcgtcctccgtcagcccgtattgcgggttcgtttcaggcgttccggacgtgaaatcgatctcgggatacaggatgcgctcgcgcgagtcgagcgggacaccggtgaccaccagaccggcggccttgacgccctcttcggcggaagagtagccgggatagtcggcggtgatggactcggcggtcttcgccgtggtctccgtcgcggtcttcgccgtattctgcgtcgagtggccagcggtcggagagccgacggaatgcatatgcacggcgacacctaccaccagcgccgcaacgagcgccacgacggcgagcgtgcccttgatgacgtttgactgcttcatcagtaacagctcctcacgtaactcatgtcatatgcctgaggcatacggatatatctttcaatcacagttcagcaacggtattcatcagcggccagaccggtcggctgattgatccgtcgattatttttttcatatcagtctccgatgtccagcatgcagtgaatccgcgccaacttcgccgttgacagagcattgagtaaagaacagccgtttttaaaagaaaaaataagagaaacgctgtaaattcaacgtttctctcacttttcatcaatgccgcagaccggaatcgaaccgttttacttaatctcaaatactgatagaaaggggctttgaagacttcatcacggttacggtgttcaaaaagtgttcaaacgtttgttgcatacaaactgaaatttgtcatatccctatttctgagtagattctttcgacaaacggtgacttatgttcgatatacttctcaatatcaaatggatagagcgcagcgccttcttctttaattctactgtattcacgcacagcttccggatgagaacgcaaatattcacggaaagcaatatgccttttcagttcctcagaatctcgcgggcatacatatagatgatgcttccgcaaatgggttttgccttcatatttaaatgcttcccgtccggcaataccaaggtttccttcatggtgatagtcgattctttctaaggcagagattacagcgtcaagcatggagtaatctttaatgacgacatcaatatcaataatcggtttcgctgataaaccatgcactgaagtgctgccaacatgttctatcgcaagagccagttgatcaagagcttcctgaatttcactcttgatttcacaaaaatcccgcgcccagtgtttatcataaggtagcacaacaacatgctttgtaatcattctctttacctccacaaatcccgatttgtctgtttcacaatgtcaataagaggaagaataacaggcttgcttttcagaatctcggtatttcatcataaagtgttcaaaggtgttcaaacattttatataaaaaacagctatgaccaaggtaagtattttcaaaggccggcatcgacatatactgtgatctatgattactacgtttactattcgcaacgtcgccaatgaagacggtgccgcgcagatcagcgatttcggcgctcacgtgctctcctggacgcccgcgggcggccatcccgccgtatggcagcccaaggccgtctatctgggtaagccgatccgcggaggcgtgcccgtggtactgccatggttcgcgctcggtttcgagcatggcgaaatcgccggtaagaagccgaagcacggattcgcccgcacctctgtctggcatgtggacgaggacgcgaccgacgaccgacgcatccgatacacgctgtccgacgccgacgcgacgcccgaactgctcgcccagctgcattccggggcctccccgcggttccatgcggtctacgacatcgaagtcggcaaggagctgaccatgacgctgaccgtcaccaacgacggtaccgagccgctgcgctatgagaccgcgctgcacacgcacttccatgtcggcgacctgacccaggtgagcctacacggattggagggctccgactatctcgacgccacggtcgccgagtaccctccccgcgtgcagcccgatgagccggtgaccttcgacggtaccacggtcgaccgcatctactactccaccgacacgttgcgtctggatgacccggcatgggatcgcgtcatcgtcatcgagacccatggcacgaagcagaccgtcacatggaacccgggaaccgcggccgacaccgaaatcggcgacatgcagcccggcgaatggcgcgatttcgtagccatcgaggcagccgcctgccgcgagtatgccatcgagctcgctcccggcgaatcgcacgcgctcacgcagcgcatcagcgtcgagaaccgctgaaaaaccgattcattcatacggccgccgcatctgccggcggccgtcaccatctccgacggcaactgttcacagcagctgatacagcgcagcgctggcgttggctatcgccgtccacgacgagccggaagtcatgatgacgaacgcatagtcgcccttgccggaatatacgatgcccgcatcatgcaggtacgagtcgcggaatccgaccttgtcggcaacggttccgttgccgccgatgccggccggtatgccgctgcggtactgctgccgtttcatcaggccgatcaccatgtcccggtcgtcgtcgttccagatctcgccccgatacagtttggtcaggatcagcgccagatcggccgatgtcgtgcgcacatccagataatgcaatgtcgtgttcttcgcgccgagcgcgttcgcctgctgcgttactttgtcgtagccggtgccgttatcgcgcatcagccatgccttgggacattcgttgtcggaatcaacgatcatcgtggtcaggcactgctgcagcgtcatgccgttgagcggcgaatcccatgtcatctcgcctaattccacggccgtcaccatcgaatgcgccacgaacagcttgtacgtgctcgccgatgcgaacacctgggaggagtcgatgtcgacgagtgtgccggcattgctcagatcgaccacggagacggaatatctcgcgccggaaaacacaccggccagcgcggcggatgcctgggcagtcaggtcgcgttcgggctgggccggagccggcacggccgccttgaacatgctccgagacgccgattgggaacgaaccctgccggaccccgacttgtcggagaaactttcgtcggaggagccgtcatcggcgacactgccgtcggtggggtcgaccgtggcaccggaccgggccgcaccggctgatgaaacgctgccggacgagccatcgccatcgttcgagcacccgcgcacggacaatagcaccaccatcgtcaccacggagaacatcgcgatcagcaccgtcagacggcggcgcacatacgtcagctcacgggtggatattattcggccgccaggcgggttcgcccgccgacgagggccgacacgaccgccggcatgcgtcacgatgccgcgcaggatacgtcccatcctgcgccgcggcgggcgcatatgctttgccatcgcgcacctccccgactgctcacatcgacgcccccattgtaacccccccccgaacgcagctagtcaggggcgagcatccacaccttggtcacccgtcatggcacggctaagacaggtcatatatacgacaggtcatatatgacagccgggcgtcggcagtatcgacaggtacgtcgatgccgccgacgcccggccggtcaatgattgctcagcgaccgcggcggaacggcgccgcgttgcgcttgccgtgcgacttgcggaatcccgcggccttgcgcgtggcacggttcggcccgctctggctcctgcggttccgcccgtcacgacggttgtcaccgtcgttgttgtgcgagccgcccttgcggtcctcgaacgacgtgtcgtggaaacgcccgttgcgacggttactgcggcgatcggcctcgcgaccgtcaaacggcgtgttgaaatcgtcgccgaagtcgttgccacggcgcttcttgtcgcccttgcgaccctcagcgtcacggtactgacgccggtcgtcaaaacggccgtcatcgaagccggagcgcccgtatccgtcgaaacggtcccgcttggtggtgtgcttgcgcttgccgtgcggcttgccctcgccgatgatcgacatctgcgattcgtcccgatggtcgaaccggtattgggcgctctcgcggccctccatttcggcgccgtcatgacgatggccgtcacggcgtgcggacggacgggagaaatcatgctcgccgccacgggcgcgggacttgcggccggaacgtccccgcccgccgcgcgcctcaccaccgcgaccgcccttgcgatcggagcggccggcgcgctcggaacggcgcaaagcctcaagcgccttgtccagcgaccagccctcgacgaccggcgcgtgctcgccgaccaactcggtcagatcttcggacgccggcgtgattgccaccgacttgactcggatgccggcgcgcttcatcatctggcgagtgctgcgggcctgattcggcagaacgagcgtcaccacgtcaccctgttcgccggcgcgcgcagtgcggccggaacgatgcaggaacgatttggggtcggccggcggatcggtctgcacgaccagcgtcacatcatggacgtcgatgccgcgagcggccacgtcggtggcaaccaatacgcgtaccaggcccttctcgaacgccaacaggttgcggtcacgctgcttctggctgagattgccctgcaggtcgaccgcgggaatgccctcgtcgatcagtttcttcgtcatcttcttggcctggaacttggtgcgcgtgaacaggatgcgcttgccggtgccgctggccagcagacgaatcacctcatgcttgttgccctgcgacacttcgaacacgtgatgggtcatcgtgtcgacctgcgagacgacagaactgaccgcatgcactttcgcatccggcaggaaccgcttgaccagcgcgtccactccgtggtcgagcgtcgccgagaacagcatacgctgaccgcgtgaatcggtctgctccagcagacgcgtgacgggcggcaggaatcccatgtcggccatctcgtcggcctcgtcgagaatcgtgatctccacggcgtccagagacagcttgccctgacgcagcagatcctcaagacgtcccgggcaagcgacgacgatatcggcgcccgcgcgaagccccgcgacctgacgggcgtagctcacgccgccatacacggtgacggtgctcatgccgtacgcctcggcgagcggctgaatcacctcgtcgatctggttgacgagctcacgggtcggcgcgagcaccaatccgcgcggacgcggcagggacgcctgctcccgcgcggccttctcgtcggacgccttgcgaatctgctcgaattccttcatggccacttcggtgacgctgtgctcgctcaggcgggcgaccagcggaatggcgaatgcgagcgtcttgccggagccggtctgcccgcgaccgagcagatcgacgccgttcagcgaatcggcgagcgtgtccgcctgaatcgggaacgcggtgaccttgccgtccatggcgagcacgtgcaccagcggcttgggcacgccgagctcggcgaacgtcggagcggcatcctgctccttgtcatctgcggaagcatcaagggcggcatcgatatcatctatatcaacagtgtccgtatcggtatgcataacggaacgcgcagcggaaccagccgcgaaatcatggtgacgtttcggcacaatagcctttcaacaacgaagccgatcacttacgcggcttctgacggagtgtccaccatatcagcaccccctccccaggatgccgggccggacgcggcgcggcgcggcggtttcgctattaccatgttatcgggccgccgatgacgtgccaatgcgcgccaatgccatatcgactcattgagagaggttcaacgatgaagaaaggactgtccccgacgacggggcgggtcatgctgctgtgctgcgcgatgctgtggggaggcagctatcccatagccaaggtcgcgatgggtgtcgtcacgccgcaatggctgatgggattgcggctggtcggcgcgtcgacgatcatgctgatcctgtttcgcaagcgaatcgtaccgtatctgaacaaatccatcatcatcccggggctggtgaccgggctcacgtattggggcacgatgatcagccagacggtcggcctgacgatgatcgaacccggccgcagcgcattcctgacctcggcgtattgcgtgctggtgccgttcgtctcatggctgctgatgcggcagcgccctgcggcgcgcaacatcgtcgcggccgccctgtgcctgaccggcgtcggcttcgtgtcgctcgggtccgggctgggcgggctcacgattggcaccggcgacctgttgacgctgctgtgcgcggtgatcttttcgttcaatctggtgtgtctgggcaagtggagccgcgtcatcgacccggtggcgctgacgttcgcgcagttcgtgacggccggcgtgtgcttcatagtcggcgcgtcgttcagcgaaccggcgccgaacgcctcatggcttgcgccgggcgtcctcgcatgcctggtctacctgtttctcggcgcgacgatgctggctcagatcatgcagaacgtcgggctcaaggtgaccccgccttcgcaggcgtcgatcatcatgtgcctggagaccgtgttcagcatggtgttttcggtgctgttctatggagagactgtcagtggtgctgcggcgactggattcgcgctgattttcctggcgatactggtgtcgcagatccggctcaacgggcgtctgctggagcgggtcggccgcaaggcgcggtagtggtgccaccacacggcaccacaccaccacacgacaccacaccaccgtgcgacaccacaccaccgtgcgacaccacaccaccgtgcgacacgcccggagtgtgtagcacaatcatcgaatcgtcactggccatgcattgccattgcgccgttcttcgattcgcaccttgcgattgtgctacgcattccgggcgtgtcgcatgcaatcgtgcggtcagcggcgacgcagcttggcgagctgatagacctcgtcgaaggccgcggcgacttctggactggtcacgcacttgccctcctcatgggcgagcgccatgatgtcgtcctgcgtggccatgtcgagattgccggtcggctcgtcggcgaggacaatcgacggaccatagctcagcgcccgcgcgatggcgacgcgttgccggagtcgccgctcgtaccagtcgaaccggaaccacccgaatcagagctgctgccgggagcgccgcccatgtcggcgccgcgaccgaactgctcctcctggctggcggtctgggtctcctgcgaggagacgcagctggttcgacacgggcaccgacgccacggccccgccggccacgccaagcgcgataccgcacatcgtcacgatcagcagctcgattgcgaactgcgccgccaccttgaccttcttcacgccgatggcggtgagtacgccgacctcgtatttgcgttcgcagatgttgaacagattgagcacgaccgcaccgaccgccagtacgacgatgagcagcgtgagggcgaacttggcgaggttgtcgagcggcacgaggctcgattcgtggttctccacgtcggcggactgcacggtgcaggtgtcgtccagtccggccttccggacgtcggagcgaaggtctcgtagtcgtcggcgctgccgagcacgtaggtgtagctcagctgggtcgtggtgttgttgtcatcgtcgttcgcggtggtgtcggcgtccaagccaagcgatttaagcgtggagacggatgtgtatatcgcgttgtcggcgtcctgcgaggtgccgcccatcgggcccatcgcgctggtgttgctggacgtgctgttcttgtagatgccgctgatggtgaacgtgtaggtcgtcgacgtgtcggacgggttggtgacggtgatctcgtcgccgaccttcaggccgttgaagtcggcgagcgccttggagatgatgaccttgccgttgtccgactcgccatagccgaacacttcgccggacgacatcgtgaacgtgccgttcgccgcgttggcgatggcggtgtccgacgagaagccggtgagcgtgaagtcgccggaggtcatcatcatgacgctaagagagaacgccacgaccgtcgaatcttgtctggctcttttctgaaaactctctgaacggagaaatgcgatattatgccggataccgtcgcattcgacggcttccgattcgtcacaggtaggttttcatcgccagatcaacggtgagtacgatgccggcgagcacagccgcgatgcgcatgatccgggccgggatcctgcgagtgacgggcgacgctatgtatccgccgatgaagcagccgatgcacagcaggatggccacaggccagtccacgacgccgcgcacgatgaagatgaccgacgcgctgatgttcgcaccggtgccgatcagcgtcttgagcgcattgatctgatggaacggaccgatcttgcctgcgtcgagcaccgcgagcgcgcacgtgccggcaccggcaccgaaatatccgctgtataccgccacgaacgcgacgccgagccatatccaccatgggtccttggacatgggttgcgtcgatgcgggagccgacgcgggcgcgccgtcgctcccctgcccttgcggcgtcgtcagggatctggcctgggccatgacgtccgccgcggcctgccgcgcctgcatgcggccgcgcggattgaccgctatgatcagcgagctgaacaggatcagcggcggaacggcgaattcgaagatcttcgggtcgaggctgagcagcagcgcagcgccggcgacgcctcccaccgcgccgatgcttacgtaggtgatggaacgcagccgctgcccgcgcagctccttgcgggcgcccagcacgccgccgacgccggtgccgatcacgccgacggtattgctcgcgttggcgaggaccggcggaatacccagcgccagcagggccggatacgataccagcgaagacgcgccgaccgcatatcccacgaatccggcaccgatgccggccagcaggatcagcagcatcgtcatcagcgaaaaaccggcaatcaccaccgcatcaactccccgcatatatggacatcccgactcagggagaatacgtcaaagcggcacggcccgcagccgctcgtcaacatagcggacatgaatcacgatgcgcgacacggtcgcacgatggcccgcgctacagcgatccgagtgctcaggcctccctgtcgccgccgcgcgggcgaccgccgtcacggcggcggtcattgcttcgtcgcgatcaccgacgtcgcggctgtcgcggcgaaccccttgagtacgtctgccatcacgtcacggtcctcggcgtcaatgccgcggacggcggcgagcatgaccggcaacgactgcgtccaatgcgaggtgagttcgccgaacgtgtcatacccgccggcctcgaggacggcgaacaggttctcgatgaaccggcggcgatgctcgtcatcgaacttcgccatccacccgttgatcgtacgcgccagataccgggagctcgcggacaggccgccggcgtgcacgaactcgccgcgctcgacctgccagttcaacgcgaaatgctgcatgatgctggcgccgtcgctggagacgatcgtatagccgtcctccacatgctcgcgcatctcgaacagcatgccgacgatcgacgattccggcaccgacttgtcgacgagcggcgcgacccgcgcataaccgggagtatcgaagaagtcggcgtcgaagcccggcccgtcatggcagaacacggcgataaggcgctcctgcaccgcggcaggcgcgtttgcggccgcatacaccgccagattgccgcctttggaatggcctccgaccatgagcgagccgtcccggtgccccgcgatgtcggccagataccgcgcggcggactcctgcgcggcgaccggacgacggaacgccatcgcgaaatcctccttccagccgacgatcgtgctgtcggtgccgcggaacgcgacgtacgatgagccgtcgccgacgtcgaacacgcaggcggagaactgcttggtggtctcggggtcgaactcgtccacgtagccgccgacgcgcagatcccgccagcgcgggctttcgcacatcgctcgcaacaggtcgacattcatcgacggcgaccacaccttgccgaacatgtcgtcatagcattccgcgcgtagcaggtccctgacgcccaccatggcgaggtcgacgtccgtcgcctccgcatcgagtctcggcacgttgacgggcatccgcgcgtatgacagctgcgcgagcgccagactgtcgacctcgttgaacggacggtcggcgaacgtgtcctcgttcgcgcggatgtcatcgatgatgttccccatggcggcctcccgtgatgccatcgattctacgcgctccccttcacacgcgacgccccggccgcctggcacgcgccgacacgcactacaatggtctggtcacgtcaacatcacgcatgcatcccatgcacgccaagcggtttcaagcgcgaaggagagcactatgacgcacatcgacaccacctgtgtccagggcggataccagccgggcaacggggagtcccgcactcccccgatcatccaggccacgacgttcaagtacacgtcgagcgagcagatgagccgactgttcgacctgtccgaatccggctacttctacacccgtctgcagaacccgaccaacgacacggtcgccgccaagatctgcgagctcgaaggcggcgcggccgcgatgctcaccagctccggccaggcggcgaacttcttcgccctgttcaacatctgcaacgcgggcgaccatatcgtggcctcgtccgcgatctacggcggcacgttcaacctcatcaacgtgacgatgcgcaagatgggcatcgaatgcacgttcgtgagccccgactgcacgcccgaggagctggacgccgcgttccggccgaacaccaaggccgtgttcggcgaatccatctccaacccggcgctcatcgtgctggacttcgacaagttcaccgccgccgcgcacgaccacggcgtgccgatcatcgtcgacaacacgttccccacgccggtcaactgccgcccgttcgactacggcgtcgacatcgtcacgcacgcgaccaccaagtacatggacggccacggctcctgcgtgggcggcgcgatcgtcgactccggccgcttcgactggatggcccacgccgacaagttcccgggactgaccacgcccgacgactcgtaccacggcgtcacctacgccaccgacttcggcccggccgcctacatcatcaaggccaccgcgcagctcatgcgcgacttcggttccacgccggcgccgatcaactcgtggatcatgggcatgcacctggagtcgctggccgtgcgcatggaacgccattgcgccaacgcactcgccgtggcgaggttcctcgaagccgacccgcgcatctcatgggtgagctacccggggctggaaggcgaccgcaaccatgcgctggccgccaagtacatgccgaacggcacgtgcggcgtgatctccttcggcgtgcccggcgggcgcgacacggtttcctcgctgctcgaccatttccggatgatctcgatcgccacgcacgtggcggacgcgcgcagctgcacgctctatccggcaggcaccacccaccgccagctcaccgaggagcagcttgaggaggctggcgtcggcatcgacctggtacgcctgagctgcggcatcgaaaacgccgatgacattatcgccgacctcaggcaggccatggacgccgtgctctgatcaatcatcgatttcgctcagccggctcgcaaaatcattctcggacacgctctcccggatccgcttcgcgagccggcaccagccagcggggaagcccaatcacttcagccgacgtggcgctcgaagcggtggaagccggtgatgcggtcgatctcggccatggcgtcgacggggatctggaagccggatgccttgaggttgttctccagctggccgggcttgctcgccccggcgatcacgcagctgatttcaggatgctgcaggatccatgccatcgacaggaccggcaggttcgtgccaagctcgtcggcgacgccgcgcagccgctccaccatgtccaggttctcatcggtgagcaggtcgttgatctggtgatccgcctgccatgtggcacgcgacccggccggcagcggctgaaccacagtgatcgggtacagaatgacgcttcagcatgccgccgaccaccgtggccgacacggcgccgagcaccgcgccgggcaacagggcgagcgctcccagcaccgtgccggcggtgaagatcgcgatcgccatgatgaacagggtcttcgtggcgaacttgcgcaccatgaacggcgagctggggatcgacaccgacagcaacagcaggtagccggcggtcagccattgcacgaccgatgcgctgatcgagaattcctccatcagtgtggagtaggcgatgttcagcgacgcttccgacaggatgccgaggaacgtcaggatggccaaagacaccacgacgatgacgagtttcgtggcgaccggctctttgccgccgtggggcaggcgtgcggttgatgtgctcattgtgtcctttccttgatttccggtacccggatgcggccggatgcgtggcggatgagctgcggccgcgggaccgggacggccgtcgtctcggcgagcacgtcgcccagatgcgcgtggtactcctcgacgtaggttcggcgcaggtcgagttcccgcgccgtgagcgtgagtgtgacggcacggcggtcggaggggtcggcgtgcttgtcgagcagtccgatggaagtcatgtcgttgaccagtttggtgacgctcggcgtggtgacgccgaggaacgcgcttacatcgcattcccgtgcggtgccggccgactgcccgttgggttcgttgagtagatgacaccgttctcagcacaggagcggcaggtgatgcacgatccggcacgtcaccccgtaaagcccggcatacagggtacatacaccaggtaaaacacgcccggcagaatggtcataccggctcgataccatatctgccatacttacccaccatcaaacatcacaggagatctcatgaccacgctagccattgatatcggaggaaccaaaatcgccgcagccgtatgcgatgaaaacgatgccatcacacatcgctggcgcgttcccacaccgatggacgccgacgccatcaaccaccacatcgccaacatctaccatgaggccgtcgccgccggccacgacgacatccaggccatcggcatctccgcggccggcaacgtcggcgcggaccgccgcaccctcaccttcgccgcgaacatccccgcgtggatcaactacgacctgtccgagcacatcggcgcgctcatcgaccatgccgtgccggtcgtcgtcgagaacgacgccaactgcgccggctggggcgaatacgtgcacggtgcgggccagggcagctcgaacatggtcgcgctgaccgtaggtaccggactgggcggagcaatcgtcatcgacgggcggctgtaccgcggatcgttcggcatggccgcggaactcggacacctgccgatggtgccggacggcgacacctgcggatgcgggcttcgcggctgcgcggaacgctacacgtctggaagcgcgctggaacggttcgccaagtccgccgtgcgccgacgcccgcaggacgccgaacgcctgatggagttgtgcggcggcgacgtcgacaagctcgaaggcccgatggtctcgcaggccgcacaggagggcgacgtgctcggcctgtacgccttcggcaaaatcggcgaatggctcggccgcgcgatggccgccaccgccgcggtgctcgacccggacgtcttcgtgatcggcggtggcgtagtggcggtcggcgacatcctgctggagccggcgcgatacaactaccagcggttcctggagggcagcgcataccgtggccacgcgagcatcgtcgccgccaccgccgggcaggatgccggcctgatcggcgccgccaacctggcactgcgctaagatgcgcgatgagagatgacgatcagacgcaatcgcgacgcgtgcaacatcccaacatggaccgcacgcgggcttacgggttctgatacgtgcacaactcccgcgaaacggcataatgcacgcgttgtccaacgccagacgtgtacaacagtgcatgacaacgatttcatccactgttgtacaccgaccgcaattccagaaacgttgaaattccaacaagacacacatctacatgcataggtctcccaaggcgcctcgtgcacaactgccgcattcgcccgatatgcgcacgttgtacacgaggtccccttcgaaaagacctccggaccgaatcacgtccctttcatccccacctctcacatgaagccgaacgcgatgcctgccgttatgcgagatttgcaccggacacggatcacagatcccgtttaccttgatcgacaacggccgacaccctaagacaatgcgcgttcgcggtgggaaatgccacgaaatgtcgaaaacgtgggttcttgccggttcgtggcatgaaatatccgacttgtctcattgcttgaaacaaaggataccgaatactagacaagtcagtaattgggcctcccatgcagttctattcgcgtcccggaaaaatcttgcacgatacaacgagaaaattgccgaatcaccagcagcgttcgagcatcgccgtatcctccctcgccacaccctccggcccagccgcatcacagcatgtggtagtcttgctgtcgttcatattgggcggcattccgatatgccaggaaagccgcgttgcaaaggtagtatcgttttgatttctcgatgagcgtcgccgagtggcttcatgagcgaagccgtgcctcggcgtacacgatcgcaactcacaccaatcacagatccgcaaaccgcatcggcaagattgcgccgatccggtttctgcatccgcgctttatgtgaattttcccccccccatttcatcgagaacaaggaacccaatgatacctgcactgaccctgacgaacatcgttttcacttatcctggcacatcggagccgctgcttgacggcatcgacgtcactttcgcacgcggatggaccgccgtgctcggcgacaacggcatcggcaagacgacgctggccaagctcgcgatcggccggctctcgccagatgtcgggcgcatatcgccgaatccgaaccgcctgcataccggttactgcccgcagaacaccgacgaaacaccggagaatctggaggacttcgcctgcgactggtcaccgcaagccatggagatacgccgtgaactgggcatcggcgacgactggccttggcggcccggcaccctgtcggacggcgaggcgaaacgcctgcagatcgcatgtgcgttggcgaccgatcccgacgtgctggtgctggacgagccgacgaaccacgtagaccggccgacccgcgagcgcatcatcgcggcattgcgctcgtatgacggcatcggcatcctcgtctcgcacgacgtggccttgattgacgcggcggcgagcagctgcgcgttgttcgaacgagatcatgtgcgcggtcgtaacatcaccgtggtgcgcgtgcggccgggaaactactccgcggcatccatggatgcgcaacgggagcgggcagcggcggcaggcatggcgcgcgacgcccggcgcgaatccacgcgcatcgacgcggtcaaggagcagcgccgacgggcggcgacgagcgagatagccggcgcgcccaaagcgcatcggctcgtgaatccgaaagaccatgacgcgcgcagtcgcatcaagaaaagccataaccccagccggctcggccccgcgagcgcccgcatcgacgcacaggcggccgccgcccgggaacgggccgcagccgtcgtcaccgccacgaagcgctatgacggagacatctggatggatgccgaatcaagcaaccgacgggagcttgtgcggctggagccccagatcatcccgtacgcgccgcaatcgccggatggagtcggcgcggcagcgatatcggagacagcgggcctgaagataccgatgctgaccgtcggaccgcatgaccggatcggcatcagcgggccgaacggcaccggcaagaccacgctggttcgcacgctgctgcgcacgatcgcgatgcgggaacagtattccggcgtcccgctcccccggctgacgatcacgcagaacacgacggatcaggatgccagggaggcgatgcgccggctcacggcgttgacgcccatcgaccgcggtgacgtattgtcggcattcgcgcagctcaacgtcgacccaagccgcctcctcgccggcggcaacccgtcgccgggcgaattgcgcaagctgctgctgtgcttgggattgcgaggtcacccgcatctgatcgtgatggacgagccgaccaaccatctggatctgcattcgattcaggcgctggcccacgcgctggccggataccccggcgcactgctgctcgtctctcacgacgagggattcctggagtgcgccgcatccatccgctggacgctgcattcggacggcctcggcggcgcgcaactaacggtcagttgacgccgccatgaccagcgtcttggccttgacccatctgagcaggaagccgacgtatggcagcgccacgccgatggccagcatatagccgacgaccatccattgggcggtgccggatgacacggagaactcgtccaccagatcgggcagcgcgatgttcatcgacgtttccgacagcatgcccaggaacgcgccgatgtacagtcccagcatcaccttgtgcggatgcctgaatttcggggattcagcgggaatatcatgtgcggagccgtgttctgcggccgcgtgttcttgcagggttgtttctttcgaagttgtctggatcgcggacaacatgacctctcttgtactcttcccgtcaccgtcgagcgagcggcgcgcacggccgggccctgcgtacacgtcgagaagtccctaacgtccggacctgcgacggcaacgaaaaaccgcatgactggcatcgggcgagccgattcgacgaatgccatgcggttttgaaacagccgtcaccgtagcacgatttgcaaatccgcataagtcgcatccgcgtatcgtgcgcgtatcatgctggtagaggacgcggcgaatcctcgctcgcgccagaccgagcggcgacaggaaagggagaccatgcagcatttcacccaggtcatcgacggcatcgacggctcgcgggccgaactcgtcggctatgtgatcgacaacagcccggagatggacccggaccggcgccggccggcgatcctgatcattcccggcggcgggtacgctatcgggtccgaccgtgaatccgaaccggtcgcgctgcaattcctcgcggccggctatcaggcgttcgtactgaaatactcctgcgtgccaagccggtacccggtggcgttgctggagatggccgaggcgatgtcgatgattcgcgggcatgccgacgaatggcatgtggatgccgggcgcgtggcggccatcgggttttcggccggtggtcatctcgccgcgaacctgacgacggtttccagcgatgccgagctgcgcgacgccggatatgatccggctgccgtgcgcccggacgcgctgctgttgtgctatccggtaatcacgtctggccggttcgcgcaccgcggcagtttcgacaacctgctgggtgacggcaaagacgatgcgtcgctgctggagctgctgtcgatcgagaagcatgtcgacgcgaccatgccgccggtgttcatctggcacaccatcaccgatcaggccgttcctgtggagaattcactgttgatgatccaggcgtgccgtgacgccggggtcagtatcgaggcgcacctgttcccgcagggcgggcatggactgtcgctcgccaccgtggacaccgcgcgtgccggctcgccgggcgagggtgacctcaacaacgtcgtgccggcagtgcagatctggccgcggctcgccttcgactggctccgccgcacgttcgacgtgaggtaaaggctgctgtcggaggttcacaggcccattcgcgcatatcccgcgcctgtgccttggctgtgcgccgtcaccgtgcgtgggttattgcgtcactgtgcgagggtaccgtcaccgtgcgcgccctcacgcacagtgacacatcaagaaaatccctgttttccaatgctttccgggtaccgtcacgctgcgtgtgccctcgcagcgtgacggtacccgcgcacagtgacgccgcggaacagcccattggcagcaaccacggccggcaacttggcagtgtcactcaccggcagcttgacgccgcgcgttccgcggctcaggcttggcgtggatcttcgcggtgagatggcgcacttcgatcttccataccgtgacgctgcgcacctgctgatcggtgaactctatatccggcatgcccgcctgctgccccatcagcagccgcagccctttgcggcactcgtccaggtcgtcgatcatgctggccacgccgttgccgatcaccgacttgaacgcctcgccccagttgcacggggtgcggccggcgatgacctcacaatcggtctccatcgagaacgccacatccaacgcgtttcccgcagcccggatcgcgtcgagtttgcggccgatcgacgccgagtggatgtacagggtcaatccggccagttcgtcgccggtgccggcgtccccatcctgctgccattcgtatccgaaattcagcggcacgatcgtaagtccctcggcatccgcatagcccacatgcacgatacggcatgcggcgacgattccctcgatctgttcgcaatcggtcacctcgcgatcggcgcggcgcatcatgcgatgccgccctgcgaccgtgcgctcgttattgcgtcgcgtcggatgcgcttcatccagtcccgtcatcgccatcactccttgtgctgacccgagtttgatttgatgatactcccgttccatgacccgtaattgaagatggaatcagccgcagtgcggagaaaaaactgagcagaaaaagaaaaagcgaccccggccggacttgaaccggtgacctccgccgtgacagggcggcgctctaaccaactgagctacggggccgttcgtgccgtcatcgggcacaagagaatataatacaggactactcgaccacgggcgtgtcgcggccaagcgcccgataaagaccggtcgcacacggcaaccggtcaatgcccggccgggcgagcgcacagtacggccacaaatgcgccttggtaacggctatgaactcccggatgaacgccgtgggccagtagtagccacgcgtatggctgccgcaccccatccgccttcagccctgatgcgcgtattcgctggctcggaacacatggtaatcgctggtgaccagcgcgcaacggtaggcgaggccacggcgcccggggaccgattgcacgccgctgcgcgcatccatgatctccttcgaaaaacgaagattctccatggtcgtggtggaacggtcctccatgagcaccgcgtcggcgggaacatgacggctttccgtcaggtaccgccgcatcgactcggcttcggacaccacttcatcgttcccctgtccgccggcggcgacgaacacgcccgtcttgccctgcttctcccacaatggccgccgccagcagcgccgccaacgacgccaacgtcatgccgaaattcattccggtcttccccaccagtcatcgtcttctcgacgatgcgctgagacccgtcactataccgcggaacctgcggccgtaccacttacgccggcagccatccaccaccgtctcttcccccggcatgtgcgatgccctataatcgtagatttgccctattcacacgcctcgggcacaccgccgcgacctcatgcgtgtacagtacaggaaggatttccatatggaaccgaattatctcgtgttgctgggaatcgtcatcgtgatcatagagttcgccctcaagctcgatgcgatcctgatcatcatcgtgtccgccgtggcgactgcgctcgtcggcggcatcattcccaagggcaacgtcacgatcggcatcatcgtgttcggcgtgggcatgatgctgttcacgatgatcatgggcaacgcgttcgccgcgatcaccgtgatgaccgtgggcatcggcgcgccattcgtgctcgcctatggcggccaacttcaacatcgtgcccgttgcgatgctcgacatgaaggaccgcatgggcgtgatcaagaagcaggtgctgccggcgatggtgatgatcgtcgtgcagatcgtgtacatgctcatcgcccagtgacaccgtattccatccgtatatttcaagcaaaggagccattatgagcaagatcctggtcaccggattcgatccgttcggcggcgagccggtcaatcccgcattcgaagcggtcaagctgctgcccgagtccatcgcgggcgtgagcgtcgtcaaattggagattccgaccgtgttcacgcgcagcgccatggtggtcgaggaggccatcgaacgcgagaagcccgattacgtgctgtgcatcggtcaggccggaggccgttcggccgtgaccgtggagaaggtcgcgatcaatctggccgaagcccgcatccccgacaacgacggcgagcagccattcgacaccccgctgcgcgaggacggcgacaccgcgtatttcgccacgctgccggtcaagaccatggtcaagcgcatcaacgcgagcggcatcccggcgctcatgtcgtacacggctggcacctacgtgtgcaacagcatcatgtacaacgtgctgtacctgctcgaccgcaggttccccggagtcaagggcggcttcatccacgtgccgtacgcgaccgcgcagggcgtgggcaagccgaacggcacgcccaccatggaaatcgcgacaatggccaaggccatcgaggccgcgatcgaagccgcagtgagcgtcgatgaggatgccaccgacatcatgggcgaaacccactaatcacgcccacccgtcgaaaaccactgacatatcagcccgccgacgagcccgctcatgggttcgtcggcacactgcagacggaccgaatcacttatcgggaagccggccgtcgggatcgcacacgatccattcgccgctgggatccacggcgaccgtcgggtgaggaaacacctggtcgaacaggtccgcgtcctcgatgacccgttccgaggtcttgtacgggacaggcctggcaccggccagacgtatgcgcgcattatcgacctcaaatcgttccacggccatatggtcgccttctcgcgatggccactcgaacgagccgtgaaatcacgatgcgcaatatccaaataccggcgctctctccggggatgaacgtgcaaacgatgaacgggcagatgatgaacgtggcgaccccgccgcactcccatgagatttctcgcgcagccatactgattccgcggggccgcgcttgcgttccaaccactccgattccatacgaccattacctatcctgacggccattatttcccctgattggggcgccacgccccactccagcccttccgataccatggtatgcggtggtttggcatgcccgcgaccgacatgcggacgggcaccgcatggaacggccggcatgcgcggaccaaaagcacagaccagaaaacggcggaatcccaacccctttaaggagtaactgcataccatggcagagtttattgttcagatgggtcagccttcgtgatcgttgctatttcaacgtttccttggcgtgtccgctgacacaaaacgctcgggaaccaacccggtggttcccgagcgttttgtgtcaagactgtgtcacctattgtgtcatcaatcagtcggattccattcagatgatcatgcaattcactgcgttcggaacggatgacactagacacatgtcctggcccgcagctccgctgattcacgtcaacacagtaagcatcaatgcatacctatcccattcagccacgggcacagcctactcaacagaccaatccccgaaccaacggcgaaaccgaaacaagcttcaatcaaaatcagaaacctcatcgtttcaccccagaccagaaaccatcgttggcccacccgtgaccatcaccgcctcccttgaatccagagaacggattgacatcatcacacaagaccagtaaactaggcttgctttctcttagcaataaggaaggctccaagccgccgggggtattcccccggcacttctttttcatccggggaggccggcgatgcgcgagttgagcatcatggtcgacgagtccggcgaatggggcaaactctccaagtactatctcatcacgctcgtgttccatgaccagtcagaaccggtcatgccccacatcgaacgctatgagcaacacctcgcggatgcctcactgccagacattcccttccacgcaggaccattgctcaacgggcacgccgactacgagaccctcagcatggccgaccgcaagcgcctgttcgtcgcgttcttcaccctcgcacggaatctgcccttcacctacgtgacgttcgcacaccgcaaaagcgagttcgacaacgacaaacgtcgtttcgaggctcagctgcggcgagacctggcgaactatctgctgacacacctcgacagattccagtcgtacgacaccatcaagatctattacgacaacggacagcaggtcgttaccaacgcgttgaaggcatccatcggctatgcactctccaaggaagcggtcatctaccgcaaagccgaccctaaagactaccgcctcgaacaagcagccgatctcatgtgcaccatcgaattgaccgcgctgaaattcaaagccggagaaaacaccgaaaccgatcacaaaatgttcggagactggcgctcattcaaacagaactacctcaaagcgttacgccgcaaacaagcaaaataaccgccatatcccgcatcgtttccaacagacgcttgcataaaaacactcagcccgcatacgacgaaagggtgggcatgccatgaaaggacatgcccacccctgatgtcagtggttcggcaaaccggctacgtgtttagcagcggatcctcctcaccgctgtaaaaccggcacccagcacggccagggcgaccagcgcaccggccacgaccgcacgtcaacgccggtcttggccaacccctgcttcttgccatcgttcttggaatcggccttcttgtcacttgcagacggcctggttgcagccggtctgttgctatcggacggcttgcccttcgcctcatccttcaggttatcgatgtacacgcgggcggttttgcccggctcgaccttgccaccggcaaccgcagccttcacgtcagtcttatcaggcaacgtctcagcaggcttcgcagccgcgacggacttcgtcgtgaaatcagggacgaacttcaacgcgttctcgttgtcctccacccaatggctcaccttggtattggaatccttgtagatgggctgcgcgtacagcgcgacttgccggatatccaccggggtcttcacatgcacgccattacgcagcaattcgttcgacgtgtcctgaacgacttcctgataggggtacgaaggaaaatcagagccctttgcgttgttcgtatacgcggtgttgggagtcaagccaatcaatgggaaatcaaaactgccggaagccttgccattccaggagttcttgttgaaatacctggcgaaccattggccagaggccttgaaagccaccttgctcccatcagtcgataggtcattgtcgttaaagacgcccttgtactccttatcgccatggaagccatagatgctgtcgtacgagcctgcggtcagctcatcatcggaaacgcccgtgctgcatatgggaatccagtacccccgatggtattcgcacttgagtgcgccttctctatcggggtgatgtcggtgatacgctgcacctcgatagagaagcacacgtccttgatctcgtccacctgcgcagggtcgatcttgtagtcgaacgacacgttcgccgtctgcgctcccacatccgacaccctcacgttggacgacgtgatcggattgtccttattcgttacatccgccgcgttcgcagtggcgacgcccccgaacaatgtgcatgcggccacggccaacgccgccatggcctttccgaaacgcctcatgacattccctccccccccgtggactcattctggcggcgtcgggacacgccgcatgcacgcgttcgcgctgttgcgccatgacgatggcgtatgggataatccacaaggtgcttttgcgtggaccggaacggccgtggcgacacggaaacggccgggcggatgacacgaatgactgccgttcgggacacccccgaaaccggttgtgtcattaccggatcagggtcccgcaaaacgttggaacttcaacgtttagtgaatggttaggtattatatggctgaattcgtatatcagatgatcaaggctcgcaaggcgtacggcgaccgtgtgatcctcgacgacgtgaccctgagcttcctgccgggcgcgaagatcggcgtggtcggcccgaacggcatgggcaagtcgacgctgctgaagatcatggccggactggagaccgtcagcaacggcgaagcctacatcacaccgggcttcacggtcggcatccttcagcaggagccgccgctggacgacaccaagaccgtgggcgagaacatcaagatggcgttcggcccgatcgccgagaaggtcgcgcgtttcaacgccatcggcgaggagatggccaatccggacgccgatttcgacgcgctgatggacgagatgggcaagctgcagaccgagatcgacgcggccaacggctgggatctcgactcacagctcgaacaggccatggacgcgctgcagtgccccgacatggacaccccggtctccgtgtgctccggtggcgagcgtcgccgtgtggcgttgtgcaagctgctgctcgaagcccccgacctgctgctgctcgacgagcccaccaaccacctcgacgctgagtcgattctgtggctggagcagttcctgcaccagtacaagggcgccgtcatcgccgtcacccacgaccgttacttcatggacaacgtggccgaatggatctgcgaggtcgaccgcggccacctgtacccgtacaagggcaactactccacgtacctggagacgaaggcgaagcgtctggagatccagggcgccaaggacgccaagctcgccaagcgcctcaagaacgagctcgaatgggtgcgcagctcgcccaaggcccgtcaggccaagaacaaggcgcgtctggagcgttacgaccagatggagaacgaggcgcgcaacaacaagaagctcgacttctccgagatccagattccggccggcccgcgtctgggctccgtggtgctggaagccgagcacctgcacaaggctttcggcgaccgcgtgctcatcgacgacctgtccttcacgctgccgcgcaacggcatcgtcggcgtgatcggtccgaacggcgtcggcaagtccacgctgttcaagaccatcgtcggcctggagccgctgacatccggcaagctgaagatcggcgacaccgtgaagatcagctatgtcgaccagaaccgtgaaggcctcgacccgaacaagaacctgtgggaggctgtctccggcggactcgacttcatcgaggtggccggcgtcgaagtgccgacccgcgcctatgtggcgagcttcggattcaagggctccgaccagcagaagctgaccggcgtactctccggcggtgagcgcaaccgactgaacctggccctgaccctgaagcagggcggtaacctgctgctgctcgacgagcccaccaacgatctggacgtcgagacgctggaatcccttgaaaacgcactgctcggcttccccggctgcgccgtggtcatctcccacgatcgttggttcctcgaccgcatcgccacgcacatcctggcgtgggagggcgatgacgagaacccggccaagtggtactggttcgaaggcaacttccaggcctaccaggagaatcgtgtcgcccgcctcggcgaggacgcggcacgcccgcaccgcctgcacaagaagctgacccgcgtgtgacacttgatcaagtcatgaagaagcccccgcaagggggcttctcgcgttttcggccccctcgccaaatatcctcccgctggcgggaggtggcgcgcagcgccgggggggggcgagaccatggcgcataacatatacgaggaggcccctcacggttggtgaggggcctcctgtggctattgatcggtcagaaccgatcagcgtcagcggacgctgcggcgacgaaccgcgacgaccgcaccgccggccagcgcgaacagagccgcgatggtggcgagcaccgccgtgtcggcgccggtggcgctgagcttaccgtcgttcggcttcgtggtcggcttcgtggtcggcttctccgtacccggttcggtcggctcggtcgggccagtcgggccgggcacctcagagtcctcggtgacggtgacggtcacggtggcggacttgccgttcgccgtggtcgcggtcaccttcgccacgcccttcgcgacggcggtcaccttgccggtcttgtcgaccgtcacgaccttgtcatcgctggaggcccacgtcaccgcctggtccgcgtcatccggcgcgaccttcgcagtcagctgcgcggtggcgcccttcttcagcgacagcgcgccatcagccacgccatcaccggagatggtcacacccgtagcctccggagtctccgccacctcggggttgtccttcggctgctcgggctcggtgagctcgaccggagtgaccttggccgtcgcagccagctcggcgacagccgcccaggtgacgcctgcgctggtttcggagacgccccatgcgtcgttgatctggaacttgacgtacacgtcaccggccggaatggtatccggcagcttgatggtctgcagttccttggtgtacgggaacactgccgtggcgacgggttcgccccaatcggtgacatcagcgacgctgttggcggtgctggccgtcaccacgtacactgcgacgttcttggccgggccgttcagcttgtcctgcggcttgtcctgacggtacaggtgggtgatggtcgcgatcttgttgccctcgccgggcgacgccttgaacgccagccagtgcggaggattggcgccggttccggagtacttgctgtgccagaacgtattcgtgttcttgtcgaaggcgttggacacaggagcctgttcggatgtggtttcttgcgagctcgccgcgtagtcgcttgcttccacgtctgcggtcagacttccggtcagcgccacgctggtggtgccgagctcttcaccggtctcggtgttggtgagcttgaactgcacggtggcgtcgcccgtcccagtggtgttgaccacgttgaagtaggcgatggcggccttgccggccggaatcgacttgaggctgacgcttccgggcttgatctcccagccttccggcacgaccggggtgacggtgacgtcaccggtgttcgcgttggatgcggccctcaccttgacggtgatcttggacggggaggccgggttcacggtcttggagtccacggtggcggacatgcccatgtggccggtgagcgtgaacagcgcgttgtcgctgaccaggtcagccgggaactgagcgacggtgccagcggcgggacgagctgcaattggacaatgccgatgacgtcgcgcaggggcagctggacttgagcggcgacgtcgatccggccgaccagcgcaaggatctgcttcatatggccatggttcgcgccctcgccgacatgctggccgcgaagatcgacgaacgcgagcagttcaggctgctgcagtccatcgagctgccggtgtcccacgtgctgttcggcatggagcaggtcggtgccagcgtggacttcatgcgcctgaccgagatgcgcgaccggttcgccgtcgacgctcgcgacgcgcaggagaccgcctggcagttcgccgggagccgcgtcaacctgcaaagccccaagcagttgcaggccgtgctgttcgacgacatgggcctcaagccgaccaagaaaacaaaatcgggttcgtacacgaccaatgcgtccgcgctgcaggatctcgcggtccgatccgtcggcaacgagcgcgccaacggattcctgaccgcgctgttgcgacatcgcgagacgaacaagctcaagcagatcgtccaaagcctgatcgatgcggtgaaccccgatgacgggagaatccacaccacgttcgagcagaccgtggccgccaccggacggctcagttccgtcgacccgaacctgcagaacatccccaaccgcaatgccgagggccgcgagattcgctccgcgttcgtgcccggagagggctacgagtcgctgttgagctccgactactcgcaggtcgagctgcgcatcatggccgacctgtcgggcgatgacgcgctgatcgaggcgttccgctccggagctgacttccacaagtacgtggcgagcctcgtgtacggcatccccgttgacgacatcacccccgaccagcgcacccacgtaaaggcgatgagctacgggctggcgtacggattgagcacctacggtctcgcccagcagctcaaaatcagccccggcgaggctgaccggctgaaatcgcagtatttcgcgacgttcggcaaggtccacgagtatctggaatccctggtcgccggcgcccgcgagaagggctacaccgagacgatgttcggcaggcgtcggtacttccccggactgcagtcgccgaaccgcaacatacgcgacgccgccgagcggggagcactcaacgcgcccatccagggctcggccgcggacatcatgaagatcgccatgatccacgcgtccgacgcgctcgccaaggccaaggtccgtagccgtatcatcctgcagatccatgacgaactcgtggtggagatagcccccggcgaagccgagcaggtgacgggcctggtgcgcgacgccatggagcacgcggtcgatctcgccgtgccgttggacgtgtccaccggcatcggctccgactggcagctcgccgcccactgacggcgacggcacggcggcgagaacaacgacggcaagaaaagaaaaagaggacaagccatgaccacgcttcgacaggtcgtcaacgtagtggaaaccctgtatccgctgcgctatgcggaatcctgggacgcgcccggcctgatcgtcggtgagcccggtgccgacgtcggactggtcgcattcgccgcggaccccaccatggcggtgatcgacgaggccatcgaacgcggcgccgacctgctgatatgccatcacccgctgctgttccgttccgtgcacgccgtctccggacaggacgtgcacggcgccatcgtcggcaaactgtacagccatcactgcgctctgtgggtgggtcacaccaacgccgattccgcgtggcgcggtgtagggcaggctgcggccgacgcgttcggcctggtcgatcagcggcctctggtgcccatcgacgacccggggtctgcgcacgccgtgggcctgggtcgtgtcggcctgctggaggagccgatgaccttggatcgtttcgcgcatcgcgtggcgcaggcgctgccggccacgaatcttggtgttcaggtcgccggcgacctccagtcgctcgtgcggcgcgtcgcggtgctgccgggatcaggggactcgctgttcgacgaggtgcgggccagcggagccgatgtgtatgtgaccagcgacctgcgccatcatccggcgacggacgccttggaacaggcgcggtacgaggcgtcgctgctctcgcgcggactggccgccccctcggccggaaatacgggaacggcagggagcgccgtcgcgcgtccggcgctgatcaacacgccgcactccgccatcgagtcgctgtggttccgatacgccccggacgacatcgccgcggcggtcgggcgggcgacgggggagaccatacgcaccacccatatcacgatgaacaccgatccgtggacgctgaacatcccctgccggggctagccggctgccgctgcacatcgctgacaacttctttcgaaaaaggaccattcatcatgcctgaccgttcaaccgctgacaccgctggcactgccgaaaccgcgggtaccgccgccgcaagcgacatcacccggcaggtcgacgcgctgctcgaccgctccaccgacggcatcgtcatggacagccgggatcgcagggccgtcgtgctgtcacgacagaccgtgtaccaaggggcggtgttcgacgtggaggacatgcgcatcgcgctgccggccggtggcggggactgcgtcaccgtgcgtcgccaggtgtgccgtcacgcgccatgcgtcgtcatgctcgtccatgacgaggcccgggacctgtacctgctggagcgcgagtaccgcgtaggctccgacctgttcgcctacggtctgccggcgggactgatggacgacggagaggacgtggagcaggcggcgctgcgcgagctcgccgaggagaccggcgtggtgccggtcggagaggacggcgtcatattcgaccatgtgggggcgttctactcgtcggaaggcatgagcgacgagctcgccaacatcatggtcatgcacctgcgacgctgggaaagccgaccgtgccggttcgatcccgacgaacacgtggaatctgcgtgggtgacctggcgccaactcgccggagtgccggtcaccgcgtcgaactccatcatcgccatacagcatgagacgattcagcgaattttgaaaaacaataagtattcatggtaaaacaaacatagttcgctgagaatttttctttatatcggtttgaagttaactatgttcacgttggcgtgcgataatatgaccatgcagcaaatacgacccggctccatgtacccgttgggtgcgaactacgacggttctggcgtgaatttcgccttgttctcgcaggtggcggacaaggtcgagttatgtctgttcgacgaggacgacaaagagacgcgcatcgagatgaccgagcagaactcgtacgtctggcataactatatttccggaatccaacccgggcaacgctacggttaccgcgtgtacggcccgtacgatcccgccaagggcatgcggtgcaacccgaacaagctgctgctcgacccctacgccaaagccatcgaaggcaacatcgacggcgacgaaagcctgttctcctaccgtttcgccgacccggacggcccaatgaacgacctcgactcagccgatcacaccatgaagtccgcagtcgtcaacccctattttgactggggcaacgaccagcatccgaacacgccataccatgattcggtcatctacgaagcccacgtgcgcggcatgaccaacctcaacaaggacgtgccgccacagattcgcggaacctacgccggcctcgcgcacccctcggtgatcgaatacctgaaaaagctcggcatcaccgcactggagctcatgcccatccaccagttcgtcaacgactcgttcctgcaggaaaagggactgagcaactactggggatacaacaccatcgggttcttcgcgccgcacaacgcctacgcatgctcaggccagcgcggcgagcaggtcaacgagttcaaggcgatggtcaaggcataccaccgcgctggcatcgagatcatcctcgacgtggtttacaaccacaccgccgaaggcaacgacatgggcccgaccctgagcttcaggggcatcgacaaccagtcgtactatcgtctggtagatggcgatccgcggcattacttcgacaccaccggcaccggcaactcgctgctcatgcgctctccccacgcgctgcagctcatcaccgactcgctgcgttattgggtcaccgaaatgcacgtcgacggcttccgctttgatctggccgccacgctggcgcgccagttccaggaggtcgacaagctgtccgcattcttcgacatcgtcgaacaggatccggtcatctcacgtgtcaaactcatcgccgaaccgtgggatctcggctccggcggctaccaggtgggcgggttcccgtcgagctggtccgaatggaacggccgttaccgcgactgcgtgcgcgacttctggcgctcgcagccgtccacgcttcccgagttcgccagccgtctgctcggcagctccgacctgtatcaggtcaacggccgcaggccggtcgcttcggtgaacttcatcaccgcgcacgacggcttcaccatgaacgatctggtcacgtacaacaacaagcacaacatggccaacggcgaagacaaccgcgacggcgaaagcaacaatcgttcatggaactgcggcgtggaaggccccacaaccattagcgatgtcaacaacctgcgccagcggcagctgcgcaacctgttctccacgctgctggtcagccagggcatcccgatgatctgcggcggcgacgaggtggaacgcacccagcagggcaacaacaatgcctactgccaggacaacgagatatcgtggcgcagctgggactccacgcccgagcaggaggacctgctgcagttcgtgtccaagctgatccatctgcggctggagcatcccgtgctgcacaggcgccgcttcttctccggacgtgagccgggcgaggacgtctcgacgatcccgcagatcgaatggttcgaccacaccggatcaatcatggacatggatgactggtcgaacacgcacgcgttctcgatgatggtgttcctcaacggctcgcgcatccccgagactgactggtacggttcgccgatgatcgacaacgatttcatcctgatcttcaacgcgcattacgagccgatcatgttcactctgcccagtgagcggtatggcaagaagtggcagctgctcatcgacacatacaaccccaaggggccggagctgagctatgaggcgggattcgccatcaccgcccaggcgcgcagcttcctgctgctcaagagttctgattgcccggcggtacgtcgcgaggacagctgagatctcgtggcaggtgcttcgcacctgcgcactgtgtgcgctacgctaggcaggcgccgaccggtgacttgcgtgttaccggtcgttcgacaggcgggattgcagttccgcgacctgctcgttggtgccggagccgtccgcgtctcgggctggattgccggggccggcaccggtgctgtcaccagtgccggtctgcagcatcatcagctgatcctgcagacgatcggcctcgattgcggcgatttgccttgagaagacgatgaaccatcccagaaacagcagtccggcgagcgcttcgagattggtgagcgtttcctggcccatcagcatcctgatgccgatggcagagcagatcagaatcgccaaggcggaaatcaccgacatcaccttcggtatccgcggggcgagccacggcagggagagcatcaatacgcccatgatgaccgtcagtcccttggcgcacacgttgtgcatgatcgggtgcggcgtatagcggaacgcgccgatgcctatgaacatgagcccggatatggtcagcagcagcgacaggatggcgatacgcaacgtgaaatgcgcgatgtcgcggtcatcggcggcggtgccggtgcttttgttcatctgatggcgtgctcgatgtatgcgttcggtggtgatcagctccgagatggcgaagtagctgacgatgatgatgcacgttccggcgagcatcagcgtcgagttgaacatgcgggccgcgaacgtggtgcggtcgccgagctgcgagaaattgttgtggtaccagtacgggtcgtcggtggtcaggccggcggtgcacacgccggaaatcacgaagaacggcagcagcgaggccaacgtcttcgcgttcatcatctccgcctgcacgaacgtcatataaccgacgacgcccgcgaagccggcgcagatgggggtgaggtatccgctgaacgtcgccgaccccatcatgccgttgattgcgccgagtagggcgaatgacgagaggaacacggtcgccgcgtacacgatcgacaatgcgaggatttcgaacacgcgacgaatcggggcgaaccatccgcgctgcaggttgagcaaatgggagtggctggcgtaaccgacgcagaatgacagggcggcgcaaccggccagaatgcccgcgcacaccatgaaacgtcgttgggtgatctgccagatcgccggggcgaactgcatgtacagcgacatcattatcgcgccgaccatcgcgcagatcaggaatgagatcaggccaagggtctccgctcgctgatgacgtcccatgacacccctttcgccgtccggatatccattgtactcgtgcggtttcgcggctgtgttgcgttggtggccggggggggcggtgcgggacgagattgtgacgcgacggtacggggttatgacggggcggcgtgggacgatgaccggcatgcggcgtggtgcctgttcgtgcgtgggatgtgtcgtccggatttgcgttcctaagtgcgcgccgaaacgacgaccgtgcgcacataggtacgcaaacagggccatttgcgtacctatgttcgcgcactcgtcgtttcggcgcgcacttaggaacgcaatgggaggggcctacattgcgccgattatttggaccatcggcggggtggaagatgcgggtcgagtccaatggccccggattcggttgccaaggtctacggaacccggtgataattgaaaaacgggctcagtctcggcctatggtatactcaacatttgtgctttgccttgggctgggcacatcgggctgtagcgcagtttggtagcgcgcctgctttgggagcaggatgtcgcaggttcaaatcctgtcagcccgaccggagccctactcccgcttggggagtgggagtagagcttgaaatcgtgttgacggacgttgtcgctgcagtggccttcggtgcggtggcggaggccgcctacatcgtctaaggagcatcatgcggatatcggcaccgtgatcacgctcgggtccgggttcgtggcgttgatcgtgcccgcgttcgttcgggtattcaagaagtatattccccagcggatacgtcggatccgtgttcctcgccgcatccatccggttcggcgtcatcgccatcgccgccaccggcggattcgacggtacttatatatggggcatcgtgctcgcgggcgtagtgggcgtcgctcagaccgtgtacgcactcgtcaaccaagcctttgacggaagactgtctaaagcgtagaacagtgccgggtaaggcccgaaatcctgcgcactttgtgatttgagtttcctggaagaggatatggcccgtgccgggtacgattttcagtcgctaacactagaaaaccgcgattggaaagaggcagaggccatgtccaaggaaatcatacagttcgatgacgccatgttcgagacaaagctcgacgccatggtgcgtgacaaggtagaacaaatagtcaacgcgatgcccgacgcttcaggccgacgagatcgccaacgccgcgagatacgaacgaaccggcgaacgcaaggcgtaccgtgccggccactacgaacgcagcctgaccgccaaggccggcaggccggagccgaaggtgcccaagctcaaaggtgccctgttcgagtcggcggtggtcgaacgctgccggcggcgcgagtccggcgtcggggaggcgcggaaaccgcactgcatgaagaacagccgcgcggtgatgctggcatggacggtgagccgatcgatgccggctgcgtcggcgaaccgctcgacttgtccgagcaatagcgaggccacgccctgccgggagcatgaggaatccacgaacagcatgtcgatatacccggctttgtcgacgtcaatgaatccgaccggaacgttctaggtttcggaagattcccgtatggggtcttcgagcggatatttcgcggtttcggcgacccatgtgtgcaccgttatccggcgttcgttccattgcccaggtgtgccggtatgcccggcccatgcgcgaatctgttcgctgttgtaatcccgggaggcgatgccggtcgcgggccgacggaacaccgccatcgtggcctccgcggcatcgggccgatacctgcgaatcatgaaacgcatacctgaaagtgtaagggaaatcaggcatacggcgcggagaacgatgtcgtcgcaatccctcgcagtctgtgagccaactcgtgagccaaccgaccaacacgacattcaggtcacgataattctgatgcgcccggtcgcatctcactgccacatcacattgtcgagatccgcaccgaatcttgtcgcgttggcttcaatcaaccaaccagttctggcgcaaacgcgattcaatggttctcctgcttgccgcgcaggaacacgatcgggatgatgatcagcggcgccgcgcatgcgcccatggccagtgaataaccgctggtgagccactggccggtctgcatgctgacgcccaaatccttggtgatgggcggcagagccgtggtgagcgccgtggccatgacggtggtggcgatgcacgagagcatgatgttgatgaagatcaacgtgcgacggtggttgctaagaggtgctgttcggtggtggttgttgtgacgtgtgtagtggtgtttggcatgattccgtttcgatttttggctctctgcggaggctcaagttccaactaaaggttttgcttatcgagctcttggtagtgctctttgatcacggtgaggatttcggcgaattgttcgcgctgctgagcggtgagcacttcgagcagtttaccggtggctccgttatcggccgcacgtcggcgcatcgcctcggccttgccctcctcggtgagcgcgaccagataggtgcgcccgtcttcgggatggggagtgcgcgcgacccatccgcgcgcctccattttgccgagcaattcgctcagcgatgccgaccgtataccgaggatcgcggcgagccggcgctggctgaccggcccgagaccactgacggtcagcaggcagcgcgactggccgctgccgtatatcagcgaatggtcgcgtcgtgtttcgcgttgatggctgatacgcgccgcatcatagaacagctccgccagcgctttgtcgttcattgtcgtgttcgtccgcctccatcgtttttgcaaggtacctaatgagtaatacaaggtaccttgacaaatgagttcaggttacggcgcattcgggcgaggctattcgtcctcgcctagcgcggcggatggggggtgagcacgctggtataggggatgtcgccggacaggacgccgtcgtagaagcgctgtttggcgtcgatgaagtcgatggaatcccgaatctccgcgagctgctcgaccagccgcgcccgcttgtcggcgagcatctgcttgcgctcggggatgctcggctcgccttcaaagcacagttcagtgtatcggcgcatttcttcgatgctcagaccgcaacggtgtaggcacagcagacctttgatccatgtgatgttgcggtcgtcgaagacgcggcggttgttggcatcccgtttgaggttcggcaccagaccggcgttgcagtagaacttcaacgtctcgtaggcgagaccggtcgcttcgcaggtctgcttcatcgtgtacatggtgcccctccttacgttcttttattatccggcagtgcttaccggtagtttctaccggtgtgtcgtgatttgaccggtagctactaccggaaaatatagtggcagtcataacacggctcccgttagagggaacaccaaccctgacatcaacgaaaggcaatacccatggagatcatcaccctgcgcaatggcgtcgacatgcccaagctcggctacggcgtcttccagatcgccaaggacgacaccgcgtgctgcgtcgccgacgccatcgaaaccggctaccgccacatcgacaccgcacagtcctacttcaacgaatccgaggtgggcgacggcatcaaggccagcggcatcgaccgaaaggagttgttcgtcaccaccaaggtctggctggaacactacggctacgagcagacgctcaaatcggtcgaggtctcgctcaggaagctcaagaccgactacatcgacctgctgctgctccaccagccgttctccgacgtgtacggctcatggcacgcgctcgagaagctctacaaggacggcgtggtgcgcgccatcggcgtgagcaacttcttcccgtaccgtctcgcggacctcatcgcgttcaacgagatcgcgccgatggtcaaccagatcgagaccaatccgttcaaccagcaggttgacgcgcacgcctacatggcagaacacggtgtggtgcaggaggcgtgggcgccgttcggcgaaggcaagtccggcatgttcaccaatccgacgctcgtcgccatcggcgagcggcacggcaagtcacccgcccaggtgattctgcgctggctcatgcagcgcgacatcgtcgcattgccgaagtcgacgcacaaggaacgcatggcgcagaacatcgatatcttcgacttcacgctgacggacgacgacatggcgtcgatcgccgcgctcgacacccgcaccagcctgttcttcgaccacgccacgcccgcggctgtcgaacgaatggccacgctggtcaaagagcgcgccggacgggaatgacctgccggaggcggtgcatatagctcttcgccgacggcctgaaacgtagcgacggacaggcaagcgggcatgatggaagcgatatttcgccgcatcgcggaaacgcaaacaaacaaggaggagccatggctgtcgagaacgccaaggtactgatcatcgtgaacaattggggcatcgaggaaaccgagctgacccgcccgttgcgtgacctcaaggccgcaggagccgcagtgacgctcgccgccgcgacgctcgacccgtgcgaaacagtcagccacgaccggtacgagggcgagacgctcaccccggacgcgctgctgtcagacgtcaacgccggtgattacgacctgctggtggtgcccggcggcacctgcaacgtcgaccgcatccgcgtgaacgaggacgccatcgcaatcgcgcaggaattcgcccacgaaggcaagccgatcgccgcgatctgccacggcgcatggctgctggtcaatgccggactcatcgcagggaagaccgccgccccctgccgctacattcgtgccgatatcgagaacgcgggcggccattacgtggacgagcagctgcacatcgatgacgccaacggctggcgcctcatcacttcccgcaagcccgccgacctcgactacttcgtcgacgccatcaaaaagaccctggcctgactcatccgactcgggacgggcggcggcgaagtcggatgggccatcgttccagccggcctcgccgcgcggccaggcgagcgacagcctaagccgctcaggcgatgaaacgcagatatgtgagatcgtcgaaagtcgcgcgaccctgaaaccccttggtcgaccgataccggtcaatcagatccggatcttcgctgcgaagccgctgcagctcgcgttccgattcgtcgagcgtgggccgcagcagcggatagccatcagacgcgagcaccacctcatcgccgggagagacgggcacagtgcggatggggtacgtcatgtcggtgaacccgtcgaacacgaagtagccgaacggccctcgtttgttcgcgaactgcgattgcaaccgcaggaacggcagtatcatcgcgcgcgacgggtccttcggcgccgcatcggaagccggtgcgccgaacgagccggatatcgggacgtcgggcgtgccgtcctgcatctctcgcagcgcaagcaccgtgaacgcgcgcagatcaccgagcaacacatcgacatccttggtcgtcggcgtctgcacgccattgaccatgatctggcagtccccgaacagccacgcctcatgccgccgggcgctgtataccactgcgttgacctgcagacgttccactggctcatccgcgaacacccgaattccggcctcatgcgagcggtagcgggcctggaaacattcgtcaaccgcccgctgcatctgtcgcatcgatgcatccgcaggcatgccaccgatgacgccgagcatcagatccttcgccacgacgccgccacagatgccgcacgcttttgcttgtcaccccatccacgacggccgcgaagtcatccgtgaccagcatcccgtcctcgttgagcgactggtcgttccgcttgccccggcaataccgctctatgatacgcatcatcaggcccgtgcgcattgggcgaacgcgcggtagaggatgttccgcgtcgcgtcgccgaccgacccgtccaccagtatgatgtggtggttgccgtcgtcgcgctccgtgacatcgcgttcgccggtcgatgccacggcctggcgcaaggcggccatgtccgcatcccattgcggtacgggcgtgccgaacgagcacatgtcgaacacgaatgcgcaaggggtcgggttgaaggatgacgtcgtgcgctcgctgtatcgatatgtgtacgcgctcggtgttccatacggtcggcctacgcgcatgtaatcgtcgatggcgcggttgacgcagaagtcgaattgccggaagcctgacggcaagtacacgttgtagttgttcgccgcacggtcgagtttgtctcgccattggccgtcgaacatctctcggcgactgtcctcatgagcgccggggccgagcgtgtatgatccgagtcgagacaggtattccgcctgcaccgaggcggcgagctcctgcaacgaccctgcgcccaagccgcccgccgtcgtggtgctggtgctactgtcgtccggcatcgtgcgggtcaccgtcgtcgtgccgtccttcagcgtgaccacggtggtggcgatgccggtgtccccgtcgcgcgaactggtgcgggacacgaccttgccgtcggcatcgcgccgcgacggtgaagttgcggatgccgatgcgtcgggcgccgcgccggcaccgccctgatgcgaggtggcggcccatatcgcgatggcgaccgccgcgatgatgatgacggctccgatgacgaattccatgctggttcctttaatggcgccggtggtgattgcggtgctggccgctgttgaccatcctatcgtcgccagtgggccgccgcctgaataattccgaatggaaacgcggtcccgggctgcgctaatcgccgtttgaggtgtgaaatcgggattagtgtgggcgaaattggtggtatctacatttcgaggggttgatctgatggatcaggaacatctatctgcatttcagggggttgcccaaacgcgatatccgaagtattaagcgctttttgctgctgggattgcacggttttgggagcgttcatacttggctggcaccccctcgaaacgtagatagatgtccggcgagaccgaaatcaacccctcgaaacgtagatacggttcaatgacgatgtgattccgggcttttcgcccatgaccggggggagagaagatggcgaatcgcgccggaaaggggtcgtgcccgaaccgtgatgccccgtcatgactgcaacatggtggtgccgccgtccctgacgagcagtgattgacggtcagtgagcgcgcgtaggtcgagctccgtggaataccgttcgacgatgagccgtgccgcctgacccatcgtgggattgcccagatgcggcaccacatggaaatccgtcagaccgagtcctttgtagtcgcgcagacccggggcgcgatccgtgcggtccatgatggagcagtagccgatgtccggcgacatgatgaccgaaccggctgattcgccgatatacgggatcccgtcggctatccgttcggcgagcagcgcatccgcgccggtccgccgcagttcctgcagcagaaagaacgaattgccgccgccgacatatatgcagtcggcgtccgagagggtgctccgcacgtcgggggcagcggccgttgaaacatccagttcagtgacgcggaatcccagttgacgcagttggcggcgggtcagcatcgtatgcgcgaacccccatggctctacagccgcggcggtcgtgatgtacgccagtcgaccgccgtgcagcccgggcagtgcatgcgggatcatccctgtggctccgcgcagcgtcgatgtgagcatcatggtcgccatcctggcctcctttcgtatcgcccagtataggaccgcgttcatgagagcgctgacagatgaaagatcgaatgcgcgcggtggcgtttggcgctcgcctggcccggttgccggaaatgacgacatgggcgcgaacgattccgccgatgcggacggaaaatgccataactcgaacgaagacgatacgattggacgcatgagcgaaacgaacaatgacaacctgtggccggccccgaccgctgacggcccgctgaacgcgaccgtgaccatccccggcagcaaatccctgtcgaatcggtacctgatcctcgccgtgcttggcgcgaagcccgtcacgcttgtcgggctgttgcgctcgcgcgacaccgaactgatgatgggagcgctgtcggcgcttggtgtgcgctgcgacatcgacccggaaaacgacaccacggtcacggtgacgccgccggaatccggccgattcagcggcaatgtgggcgtgtactgcgggctcgccggcacggtgatgcgtttcgtgccggggctggcgctgttcgcggacgccccggtgcggttcgatggagacgatcaggcatacgcgaggccgatgcagccggttctcgacgggctcgaacagcttggcgcccgcgtcgaataccacggcgagcacggccggctgccgttcaccatcacgccaccgcgtcatgatggtgaacaggccgatgacggttccgctgccgccaaggtgagcatcgactcgtccggctcttcacagttcatctccggtctgctgctgatcgggtcgcgcctgcccggtgggctggagttgcggcatacgggggagaagacgccgagcctgccgcatatccgcatgaccgtcgctgatgtgaacggcgcgggcggcaatgcgaccgctgatgaggagtctcgcgtctggcgagtcggccatgccgcgttgcagctgccggaacgcgtggtcgtcgaacctgacctgtcgaatgcggcgccgttcctcggtgcggctttgattgccggaggcacggtgcgcgtgccgcactggcctgttgagaccacccagcccggtggactgctgccgggatatctggaacgcatgggcgcgcgcgtctcgttccccgaagaggacggcgtgcggtattgcgaggtgagtggcgacggccatgtgcatggtcttggtgatttcgacctgaccgcggcaggggagatcgcgccgtcgctcgcggcgatactggcgtttgccgatgctccgacccgtatgctcggcatcggtcatctgcgtggtcatgagacaaaccgtctggaggcgctggtcacggagatcacgcgcatcgggggagaggcccgcgaactggaggatggcatcgagatcactcctgtgccggttgagcgtctgcacggtgaggtgatggaatcctacgctgatcaccgcatggcgacgttcgccgcgatgatcgggctggccgtgccgggcgtccgaatcgtcaatgtggagaccacgcgcaagacactgcccgatttcgtgggcatgtggaccggcatgttggagcggtgaccgcgacgaatatcacggatatacgatgaggggctgattcccagcggaatcagcccctcatttatgttcgtccgtttgcgttagacggactgcggcctgctaacggcagttcgtcacttggtgaacgtgttgccgtaagtgtccgcgccgttctcggcgatttcggcggacttgcgggcgatggccagctcctcgttcgtcgggatgacggcgatgatcacggaggagtccggggtggagatgatgcgcggctccttggagcgcttcgcgttcttctcctcgtccagcttgacgccgaacggggcgagcttgtcgcacaccatcttgcgcacgatgtcgtcattctcgccgacgccggcggtgaaggtgattacgtcgcagccgcccatctggtaggtgtagttgccgatgtagctgacgatgcggtgcacgtacacgtcgagggccagcttggcgtcctcgttgccctcggccaccagacggtgaacctcgcgcaggtcgccgaagccggtcatgcccatcatgccggagcgcttgttgaacagggtgtcgagctcgtccacgttcatgtgggcgttgcggatgaggtggaagaccacggccgggtcgatgtcgccggtgcggccgcccatcatcaggccttcaagcggggtcagacccatggaggtctcgaccggcttgccggaaacctcggcggaggcggaggctccgttgccgatgtgcagcacgatctgcttgaggccttcggccggcttgccgatgacgccggggaccacggaggagatgaactcgtgcgaggtgccgtgggcgccgtaacggcggatgtggtactggtcggcaatctccttgttcagcgcgtaggtgctggccgccttcggcagctggaagaagaaggaggaatcgaacacgaagatctgcggaacgtcgggcagcagtgcgcgcatgacttcggcgcccttggcctccgggccgttgtgcagcggggcgagcacggccaggtccttgacggcgttgatggtcttgtcggtcacgagggccggcttcgggaagagggatccgccctgaaccacacggtggccgacggcgacgatgcctgcttcggacaggtccgggccgtactccttgaagaagccgagcacgcgcttgaggccctgctcgtggtcgtggatcggctcttcgagctcgtgcttctcgccgttgtactcgtgcttgtagtgaccgtcgaccggttcgccgatcttctcgacgagaccggaggccagaccttcgccggactcaagatcgaccagctgatacttgatagagctggaaccggaattgatgacaaggacggttttcgccattgtgggcatcctccatgattgatacgtaccgcgaaacacggctttccatctgatagattactcgctgcttgctacaaatcagcgccgcaggtttcgccgagagccaccaaagagaaaagccccgctgacgggttgagccgtgaagtaaacagcggggctggttataggtgaagagcgaacgacagattgcacgtgcccccgccagcgggggctgtcgcgaagcgactgggggtggtcgtaaagagcggctgtatcgcgcggagaccgctaaaacacccgcgtcactgggcctcgatggcggtcagtgcgatggtgttgatgatgtcctgcaccgtcgccccgcgtgagaggtcgttgacgggcttgttgaggccctgcagcacggggccgatggcgagcgccccggaggaacgctgcacggccttgtagccgatgttgccggagcacaggtcggggaacacgaacacgttgacgtgtccggccacgtcgttgcccttggccttggtggctgccacgtcgggcgaccatgcggcgtcgaactggatggagccgacgacgggcaggtccggagccttctccttgacgattcgcgtggcctcttcgacgatgtccacgtccggccccttgccggagccgagggtggagtaggagagcataccgaccttgggctcgatgccgaacgccttggcggtcacggcggactgcagcgcgatctccgcgagctgttcggcgtccgggttgaggttgatggcgcagtcggagaacacggtcacgtggtccttgaagcacatcaggaaggcgccggagacgagcctctgcccgggcttggtcttgatgacctgcagcgccggacgcacggtgtttgcggtggagttgaccgcgccggacaccagaccatcggcgtaaccgagcacgacgagcatcgtgccgaaatagctcgcgtcggtcagctgcttgcgggcctgctcttcggtcatgcccttcttggcgcgcagctcgcacagcttggcgaccatgggcttgaggatgttctcgtcgtccatggcctggaagcgcgctttgcccagatgggtcagaccgagttccgcgccccgggcgaggatcgcgcccttgtcgcccacgatgatgaggttcgcgatctcgcgctccagcaggtagtcggccgccttgatgatgcggtcctcttcgccttcgggcagcacgatcgttttcttgttcgccttggcgcggccgagcaggctgtactggaaggcgtacgaggtgatcgggaagtcgatctcgacgttgatggcccgcaggacctcttcggtcggcacgttcgcctggaaggcggcgagcgccgcatcggcctgcgacgcctcggtgaacgggatctgggggatcgtccacaccggcagcccgaagtccgcgagcgtgtccttgaccgagacggagtggcgcggctcgcagcccgtcacgaagatgcccagcaccttgttgccggcggcctccatgccttcgatggagagacggacggtgtccttgagctcgtcaggccaacggtcgatggtgcacacggcgaggaagacgccggcctgcaggtcggcggcgatgttcgcgttgaactcgtaggcggttgggtcgttgacgtgcgacttgtcggtgccgacgatgagcgccgcgtccgcgcgggacacgttcatcgcgtcgttgaacgccgcgacgatgtcgccgcgggagccttccttgtctttgcgcacctggtgaatgtccagtccggtggacagcgcgacgccgaggccggcgttggaggcgttcagcaggatgggggtgaagtggtcgtgattggagaccgcggggcggaacacggtggtcttgaatttggtggtcagcgccttgagcacgccgtatgccacgacgttgcgtccgtttgcgccttcaggacttgcgatgtagatgttcgttgttgtcacgtttgtctcctcgtcggggatggtactgctcgtgtgaccgccttgtttcacacttactgacattgtagtacccgatcgttcgctgccgggcgttgacatggcggtaaatgcggccgggacggttcgaccgggcgcgtggtgacgatgtagtcgttgcgcccgtatccgtcgtcggagacgatgtgctcgatgtcgtggggtagcctgcgatggggtagtgcaggtagcaggtgatgccgagctggtcgaggcgccggcgataggcgtccgcgtccggctgccccgcgtgctgggtgagcacgacggagcagccgtggaatccgcgcgagcggaagatgtcgatgagtcgcagcacgtcctcgtcgtacgtgatgccgaggtcgccgcgcatcttggccttctcgatgtggttggcgttgatggcgatgacgatctccacgtcgtcggcgaggcttttgagcatgcggaatttggaatccggctcgaagccgggcagcacgcgtgacgcgtgatagtcatcgaacagcttgccgccgaactccagatagagcttgccgccgaactgcgcgatgcgctttcgaatgttggcggcctgcagctcgatatatttcttgttgtcgaatccctgtcgcatgtgcagtgagagtcccgtccgaacggagcgctgtacctgcagattataccgggttctttacgaggaccaccccctcccagtcgcgaagcggctggtgtcttacaagaatctacgagtgaaattcggcgatgtgtgcggtagcatggcgcgggaagcgaaagcgtacaagggtacgtcgagcttcccgtaacgcagctaacgcacacatcgtcgaagtccaccggtgaattggaataacgtgtgtggcctctaggcgcaccgaaggaagctgtacaaaggtaccgcgactgaggagcaacgacgaggacactccgttattccaaattcgctcccattcgccctctgaaaccgtgacctaaacgattttgtatagaccgtttagctccgattatcaggattacttagattatccaagaattacggtgtatcataattcctgttgtcattttgttgtcacgctgacaaggatattatacttaattacaccacataaatcaagtggttattgccattctgtatctgtcattgttaattcgccctcagcggtcattctgccaatcgtagcgagtgacaaactttcatcttgggtgagtgaatgcttttcggtaattttcgcttgcgtatcataatacaaacagaaacgatgagaaataacatacacaaaatcaaataagtttgcagactcgtcaagcagttcggtaatccactcagataagtgattttctgcataagaggttggaatttcgggcaaaagtatggcaagtcccatcctcttaaaatttgatcggtactgctgaatttttttcgtctttcttcgtatgctttcttgaaaaaagcgtttctctccgtcggtagttccggaggtagatatcgcaaccttttcatctttaagagggacaaagaaatatccgcttgatttgatgatatttttgcgtttttctatatccttaggtttaccctgatttaattcggaaaaggcgcgagatactttcatatcatcttcttttacagcggcggtaacctcaattcccgtactatttgcactgtcttgaagatcgggagcttcgcctgtaatcattgtatcaaactttgaaggatacaagtaacgcaaagtggcaagcaccctatattcctgagaatgtttaagagtgtttggtttaaccgcagaggaatattttttacctttaactaagtctgtatttatcttcataattattcaaccggaggaataggtggcataacaacaaacattgattttaattcatcaatagtgcctgccttaccccactcagacattccatttttccataccaaactatcagcattgaactgacctgaagtagccatttgttgcaatacatttaaatcaaaaaggtccggttgcttgcccgttcaccgcaatgtgatatgcaacaacaggaacgggtggaggtgttgctccgctcggtgtggtttgattaataccagccattgttcataattccggcaatattatgactgacagcaccgccgagagccattcccgccatcatagcggcaggattaagccctgcgctgccgtttcctaaatcaactccacctgcaccgttttcacccatatgtcccagggcctcagcaccggcaataccgacttcagcctgtttttcaacccgaaacgcaccaatattggcagattgagtttgcttatgcatagcatattgtccctcttcacgctgaatacgtaatcttcctacatagtcagcggtttcggccttaactttagttgtgcatttatgtaattctccgtcataaacggtttttctttgttcttttgcaccattttgcgatgcatctaccgcattaccacaactggcgcagaattttgctccctccgcaagttcttgcccgcagttaatgcaaaaagccatattgcacacctccacagaataatttcaaaacgcaaaaactgtcattttttcaaatgagggcattctagacaagcggatttgttttcatcccataagctacatttcttcctgatcctaccacagaatctcagcgatgcgctggtagaggcgttcaaggaccggctgaagaacgactaaatccgagaaaacaaaaagagctatctgacttttctaacagaaatcagatagctctttattcttgaataatctaaaatgttgtcattttgttgtcacggggcaattccgtaacccaaaagtccagccttttcaaggctttttggcctttcgggcattattcccactcgatcgttgccggcggcttggacgtgcagtcgaggacgacgcggttgatctggcggcactcgttggtgatgcgggtggagatggtggcgagcacgtcgtagggcacgcgcgaccagtcggcggtcatggcgtcctccgagctgaccgggcgcaggacgatgggggagccgtaggtgcgctcgtcgccttggacgcccaccgagtgaacgtcggcgagtagcacgaccgggcactgccagatgtcgcggtcgaggccggcgcgggagagctcttcgcgggcgatggcgtcggcctcgcgcagcaggtcgaggcgttccctggtgatttcgccgatgatgcggatgcccaggcccggaccggggaagggctggcgccagacgatctcgtcaggcaggccgagctcggtgccgatggcgcgcacctcgtccttgaagagggtgcgcagcggttcgatgagctggaacttgatgtccttggggagcccgccgacgttgtggtgggacttgatgttggccgcgccgtcgccgccgccggattcgacgacgtcggggtagagggtgccctgcacgaggaacttgacttccttgccgcgggcgccggcttcttcgaggacctgacgctgggctttctcgaaggtgcggatgaacttctcgccgatgatcttgcgcttgcgctcgggctcggagacgcccttgagcgcttcgaggaagtcgtcggcggcgtcgacggtgatcagtcggatgccggtggcggcgacgaagtcgtgcttgacctgctcgacctcgcctttgcgcagcaggccgtggtcgacgaacacgcaggtgagctggtcgccgatggccttgtggacgagggcggcggcgactgcggagtcgacaccgccggacaggccgcagatcacttcggcgtcgccgaccttctcgcggatcttggcgacctggtcctcgatgatggaggaggcgtcccagttgtcgggcaggccggcgcactggtggaggaacgtctcgatgagcttctggccgaagggggtgtgcttgacctcggggtgccactgcacgccgtagagcttgcgggactcgtcttgcatggcggcgacgggcgcgccctcggtgtgggcgagcacttcgaagccggcgggcgcggtcttgacggcgacgccgtggctcatccacgtgtcctgctcggccggggagccggcgagcagcccgtccgtcttgtcgatggtcgtgtcggtcttgccgtattcgccgagcgcggccttgtcgacgtcggcgccgagcgcgtacgccatggcctggaagccgtagcagatgccgagcacgggcacgccggcgtcgaacagcttggggtcgacgcgcggggcgccgggctcgaatacggatgcggggccgccggacaggatgatggcctgcgggtccttggcgagcatctcgtctaccggcatggaatgggggacaagctccgaatacacgttcgcctcgcgtacgcgacgggcgatgagctgcgcgtattgggcgccgaaatcgacgacaagcaccgggccgttagccatgggactcccttcatgcggccgcgcgcgatagcggatacatagatatgggcgatatcgttgattgcggccattggtattgtgtggacttcttacagtatgtcacatcaattgtggcgattcgagccgacattggcgtgtgcgatgggcgggtgtcgtccgggagcgacgcaccgattcacaaaaccgaacaattaacgctgttaatatgaacaacacgccgcatgttctgttgcctgcatgaacacgcggcgtaccggtagatcgctgaaatcgttggaaaataaaagtttctcactggatggcgccgtaatataacctgtgagggcgccggttattcactcataattcatacaattaatctaacattttcgaacacacatgcaaaaaagctgccaaaagtcttgctctcaacgtaccatgatgaacgattgggattgggcaaccgcgaaatcgcaaggcttcgcgagagtccatgaccgaacgataatgatcaattgcacatcactgtgcaggagtacaggagtacacatgacgagtcctgttattggcaccccttggaagaagctgaacgctccggtttccgaggaagctcttgaaggcgtggacaagtactggcgcgttgccaactacctttccatcggccagatctatctgcggagcaacccgctgatgaaggaacccttcacccgtgaagacgtgaagcaccgtctggtggggcactggggcaccacccctggcctgaacttcctcatcggccacatcaaccgcttcatcgctgaccacggccagaacaccgtgttcatcatgggcccgggccacggtggccccgccggtacctcccagtcctacctggacggcacctacaccgagacgtaccccaacattaccaaggatgaggctggcctgcagaagttcttccgccagttctcctacccgggcggcatcccctcccacttcgctccggaaaccccgggctccatccacgagggtggcgagctgggttacgccctgtcccacgcctatggcgcgatcatggacaacccgagcctgttcgttccctgcatcgtcggcgatggtgaggccgagaccggcccgctggccaccggctggcagtccaacaagctcgtgaacccgcgcaccgacggtatcgtgctgccgatcctgcaccttaacggctacaagatcgccaacccgaccatcctgtcgcgcatctccgacgaagagctccacgagttcttccacggcatgggctacgagccctacgagttcgtcgccggcttcgacgatgaggaccacatgtccatccaccgtcgcttcgccgagctgttcgagtccgtgtgggacgagatctgcgacatcaaggccgcggcgaacacggacaacatgcaccgtccgttctacccgatgatcatcttccgcaccccgaagggctggacctgcccgaagtacatcgacggcaagaagaccgagggctcctggcgcgctcaccaggtgccgctggcttccgcccgcgacaccgaggcccacttcgaggtcctcaagaactggctggagtcctacaagccggaagagctgttcgacgccaacggcgccgtcaaggacgacgtcctggccttcatgccgaagggcgagctgcgcatcggcgccaacccgaacgccaacggtggcgtgatccgcaaggatctcgtgctgccggcgctcgaggactacgaggtcaaggaagtcaaggagttcggacacggctggggccagctcgaggccacccgtcgtctgggcgtctacacccgcgacatcatcaagaacaacatgcacgacttccgcatcttcggaccggatgagaccgcttccaaccgtctgcaggcttcctacgaggtcaccaacaagcagtgggacgccggctacatctccgacgaggttgacgagcacatgcacgtctccggccaggtcgtcgagcagctgtccgagcaccagatggaaggcttcctcgaggcctacctgctgaccggccgtcacggcatctggagctcctacgagtcctttgtgcacgtgatcgactccatgctgaaccagcacgccaagtggcttgaggctaccgtccgcgagattccgtggcgcaagccgatcgcctccatgaacctgctggtctcctcgcacgtgtggcgtcaggatcacaacggtttctcgcaccaggacccgggtgtcacctccgtcctgctgaacaagtgcttccacaacgatcacgtcatcggcatctacttcgcgaccgacgcgaacatgctgctggccatcgccgagaagtgctacaagtccaccaacaagatcaacgccatcatcgccggcaagcagccggccgccacctggctgaccctggacgaggctcgtgccgagctcgccaagggtgccgccgcttgggattgggcttccaccgcgaagaccaacgatgaggctcaggtcgtgctcgccgccgccggcgacgtcccgacccaggagatcatggccgcttccgacaagttgaaggccctgggcatcaagttcaaggtcgtcaacgtggctgatctgctctccctgcagtccgccaaggagaacgacgaagcgctgaccgacgaggagttcgccgacatcttcaccgccgacaagccggtgctgttcgcgtaccactcctacgcccacgacgtgcgtggcctgatctacgatcgcccgaaccacgacaacttcaacgtccacggctacgaggaggagggctccaccaccaccccgtacgacatggttcgcgtgaacgagctggatcgctacgagctgaccgccgaagccctgcgcatgatcgacgccgacaagtacgccgacgagatccagaagctggaggacttccgtcaggaagcgttccagttcgcggtcgacaagggctacgaccacccggactacaccgactgggtgtactcgggcgtcaagaccgacaagaagggcgccgtcaccgccaccgccgccaccgctggcgacaacgagtgatgatcgcctgattcttatcaggatctgagctgaaagggcttccggagcaatccggaagcccttttttcgtcaggctccaccaagcgacaatatcgctcgtgagaatggtcatcgcctacaaaccgacaagtcgtcatgacacgacgggtaaatccacactacgtagtcatctccatatataatcaagacgtccgctgaatgcgacccaccgcatgacggtccctcgaagaagaaggtgatgactctcttggatgtatcattctcatatttcatccaacaggtatgttcgaatccggcgctggccatcaccacgttgctgacgctcggcgtcattttcgtgaacggctggaccgacgcccccaacgccatcgccacctgcgtcaccaccagatgcctacgtatccgtccggcggtgatcatggccgcggtgctcaatttcttcggtgtgttcatcatgacgcagctgaacgcctcggtggcgtccaccatcagcaacatggtcgatttcggcggcgacacgaacgccgcgctgatcgcgttgtgcgcggcgctgttctccatcgttgtctacagtgtgggcgcgtcgctgctgggcatccccacgtccgagagccacagcctaatcgccggcctttccggcgccgccatcgccatccaggatggcatcggcggcatcaacatgggggagtgggtcaaagtgctgtatggtctcgcggccagcctcctgctcggatttggcatcggctggatcgtgtgcaagctggtgacgctgatctgcgcggggcttgaccgcaggcgcgccaacgtattcttcacgtatgcgcagatcgtcggggccgcggccatgagtttcatgcacggcgcgcaggatggccagaaattcatcggcgtcctgttcctcggcatggcgttctgcagtgggcagaccggtgtcgcaggcgtgatcatcccagtgtggctgatgatcctgtgcagcacgatcatgggtgtcggcaccagcgtgggaggggagcgcatcatcaaatccgtcgggcaggacatggtccggctggagaaataccaaggcttttccgcggacctgtccagtgcgctgtgcctgctggtgatgaccgtgctcggcatccccgtttccaccacgcacaccaagaccagcgccatcatgggcgtcggagcggtgcgcaggctgtccgcgattaacttcggcgtcgtgcgcgacatgatgctcacctgggtgttcacgttccccggctgcggcatcatcagctacgtcatggcaaaactgttcatgctggtgttctgacaccgctccggcacacggcatcagtcatcgtttcaagaaaggatcagcatatggcgaggaaaaacgattcgttctatttcgacggattcaagcagagcgccgattatgcatgccaggcggcacatctgctgtcggaagtcatgcaccattacgaaccggatcgtctgctggaacgattcgacgagatgcatcgcatcgaacaggcggcggacgaggtccgtcacggcatgatggacgagctggtcaccgcattcatcactccgttcgaccgggacgacatcgcgcggctgagcagcgtgctcgatgacgtcaccgaccgcatcgaaggcgccctgcaccgcatgtattacgacaacgtgctggagatccgacccgatgcgctggacttggtcgacatggtcgagcgctcatgcgggaagatggcggagctgatcggcgagctgccccggttcaagcggtcgaagaccctgcgcgagcaggtgttcttcatcaacaagatcgagcaggacgcggaccgcctgttcgtagaggcgatgcgccgcctgcacaccacctgcaccgacccgctgcaggtgctcgcctggcacgaggtgtacgtgcatctggagctgtgcaccgacgattgcgagcatgtcgccgatgtcgtcgacaacatcgtcatggagaacagctgagagcggttcccccgtcccgtcccggccacggcgttggacgggaatgccgcctaacggtgggtgttgagccacgcgatggcgagctgggtgcggttggtcagagcaagcttgtcgagcatcgcgctgatgcggttgcgcacggtgccctcgctcagatacagtctggcggcgatgtcgcggttgtcgagtccctcggcgacgagcgccgcgatgtcacgctcccgttcgttcagcagctgatcgatgccatcagacgtacgacggccgtgcgggatgccgtcgccggccgtgtccgaggcgtcgtccggccccttgcatccggcaccggccgtcggcccggtgagtttgccgatcacgtcggcgccgagcaccacctgaccggccatcaccgcatgcagggcgggtgcgatcgccgccacatcctgcttgatgagatagccttttgtcccgagccgcatcgcctgctcgatataggcctggtcagagaacgtggtcaggaacaggatacgtgccgccggatccttcgtcaggatctcccgcgcggcgtccagcccgttcatgccgggcatctgtatgtcgatgagcaggatatccggatgattctccggcgactcgaaatacctgcgaatcgccgcgccgccgtcgttggcgctccatagcacgtcggcggtgtcggtggcggtcaggatcgtctccagcgactgacagacgatcgggtcgtcgtccacgatcgcgattctcatagcttccccctgttccctaatgtgccggcagtcgtcttcatgaatgccggctggtctgttttcgcgcaagattccggggatgcatgccaacgttgcttcggcacggacacgaacacgcgccatccgccatcatacgggccgcacagggcggttccgccgattgagcgcacgcgcgattcgatgtcggtgagtcccatgccgcgaggcggctccccgtccgtccggcaccgcccgcgggcatcacgggcgcggatcgcgggccctggatcctggacgaccaactgccacaatgtcggaaaatcacgcagcgtcacgctcgcctcatgggcctcgctatgatgcgcgacgtttgccagcgcctcgcgaatcaccgtcgcgaagcagcgtgacaccggggccggggccgtgtcgacgtcgttcgccaacgacaccgagaagtccggggagataccgtcgaatgaggcgacggcggcttcgatctgcgcggcgaaatcggtgccatcatcctcaaggtcatgtaccgagcggcgcaccatcgtcatcgcatcgtccaaggtctcgcccagcgtggtgaatccacgggccgcgacctcgtcatcggtcgcctcggccacggccctgccggcctgcgcctgcatgatcgcacgagtcagcaggtgccccacattgtcgtggatctcgcgggcgatacgcgtgcgttcgccgagcgtcgccatgcggaccgactgcgcgcgctcctcatcgatatcggcgatgcgcgagcggacggaacgggaggcttcacgggccatatcctgagcgtgcaacagcgcacgtcgattcccatccgaagcctcgcgggaccgtcccgcgacgaatccgagcaacgcggtcaacgtaagagccagcgcctgcatatggctgttggcatctgcggcttcggccgcgacaccggcatgtgacacgcggacgaaccacagcgccgcaaacggcaacacccatagccagcgcacggccgttaccagccgcgaagggcgccctgcggcagccagacgcgccatatcgtaggcgacaagcggcatgaacgagcaccatgcgggcactgccgcggcgacgatcagatacgccacgcaaggcaaccacggccatcgttcatcggcatgcagccattcgaccagtccggtgacggagacggccagcagaagccccgcgatgaacacggcatcggtgcggatcccggtcatcacggcgagcacggtgcccaacgcgagcagaacaccctcctcggccaacacgcgcatggcacctcccggatcgtcattcgtttcaataccagtctagcggtggaaggaactccacgaacatgccgatcgtggcggataatccgcgtggcggctccctgacgatgggtctgttctccaaccgaaccatcaacatcggcatcgtgaccgagatcgtgctgctcgtgctcatcaccgaagtgccggtattgcagaccgtgttccacaccgcgcccctgggctgggacgactgcgtatacctgtgctgcatcccgttcgtgatcctcggcatcgaggaactgcgcaaactcatctggcggcattctttcccaaccgagcgggtatagcgtgctccgccccccccgctggcgggggcaagtggcgccgcgagatgatgacaaatgtcacgggtgcgcggccaagtcgtgacgtttgcaggtggcgatcgccgacactctcttgggatgatgtaatcatcaaagaaaggagcggctatggcaaccgacaacacagcccccggacgcgatgtggcacccggcgcagtgccggccgtgcatgtcagtcaactggtcaaacgctacggtgacatggtggcgctcgactatttcgacctcgacgtgacgcaaggcgagatcttcggcctgctcgggccgaacggctccggcaagaccacggcgatcaactgcatcctcgcgctgctcacctacgattcgggcacgatccgcgtactcggccagccgatgacgccgacctcatacgcgctgaaacggcgcatcggcatcgtgccgcagaatgtggccgtgttcaacgaactgaccgtcaccgaaaacatcgactacttctgctcgctgtacgtgccgaagaaaactgaccgcgcgccgctggtcgaggagtccatcgaattcgtcggactccaggacttccgcaagttccggcccggcaaactgtccggcggtctgctgcgacgcctgaacatcgcctgcggcatcgcgcacaagcctgacctgatcttcttcgacgaacccacggtcgctgtcgacccgcaaagccgcaattcgattctggaaggcatccagcggctcaaccaggccggcgccacggtgatctacaccagccactacatggaggaggtcgagcagatctgcgaccgcatcctcatcatggatcacggccgtcatctggcgctcggcaccgccgacgagctcaagaacatgatcgacacgggcgagcgcatcaccatcgaaacgctcgatctggcggattcggcgatggccgaggtccgtgcgctgccgtgcgtgatcgaagccacctacgacggcaaggaactcgacgtgcgatgccggcgcggcgaacacaacctgaccgacgtgctcgacgcggtgaaacgctccggcgccaacatcggccacctgaccagtcgtccgcccaccctcaacgacgtgttcctcgaactcaccggcaaggcactgagggactgaccatcttgcccctgctggcggggctcccgcgaagcgagtgggggtggccttgcaacaaccaccctcagtcggcttcgccgacagctcccgccagcgggagcaggtaaggagacatcatgtggaccacatttttggtcgcattgaaagcgaacctgcgcaatcgtcaggcactgttctggatgattgtgtttccgatcgtgctggcaaccatgttcaacgggttcttcggcggactgtccgagggatacgagctcaaaccgataccaatggccgtcgtcgaagatagccgctggcagcaggcggacggagcgcgtacgtttgtggatgccttgtctggagagacggcctcatcgtcggagtctttggacggcacggcatacgccgatatcaatcagcaattgctgaccatcaccgcagccgacaccgtgcggaaagccgaacagctgctcgccgatggcacagtccgcggctacctggctgctgacggcaacgggcgtttggcgataaccatcagtcgggaaacggtgaccgcggccaatgacaccacaggaagcgtcggactggatatcagcctatcggcattgcgcagcgccatcgacctgtacaaccgcaccgacgccgtcacccgacaaaccatcgccgacaatccacaggctgcgctcagccgcaacttctggaatagcatcgggcaaagcgtcgatgtgactcacgaaacaacgctcacgcatttccagcccaatgccatcgccagatactattacgcgttgctggccatgtcctgcatgattgccatggggtactcaatcagcacggtctccacagcacaagccaacctgtccgcattgggcattcgccgcaccgtggcgccattgagccatgccagacagcttattgccggtttccttgcctgctggttgtgcgcatcggtcgcattgcttatcgcattggcctatattcgcttcatctgcgacatttcgtttggagggcgagaaccggtgacggtggtcgcggtaatcatcgccgcattcatgaccagttcagccggtactttgctcggcgcggtaccgaagctttcctacgacacgaaatacggtttgtcgagcggaatcgcctgcacattgtcgctgttcaccggactgtacggcggcttcgccatgcagatcagtgactggatagcacgcaacgcgcccatcctcggcaccatcaaccccgcgcaacaggtgacgaacctgttttacgacattttgtactacgacagctaccagccgttcatcaccacttgtgccattttgctggcgatgagcgcggtattcctcttggccggcatcgcaatgctgaggaggcaacgctatgaacacctgtaaagccacattgcgtgtactgttctcgcacagggcctacctgttgatttacctcgtgttcgtgggcatcatgatgctgtctatcagctggtcgatgctgtctggcacatccgattccgcagccgcggcattcgagccggccaaaatgcgtgtcgccgtcatcgatcgagactcggacaggggcggcatcgcgtcatcgatgcgcacatacctgtcggattccagcgaactggtgaacgttgacgatgctagtgaaactctgcaacaagccgtcgcctcgaactgggtggatctgatcgtcatcatccccgatggtttcgccgacgatttcattgatgccgcggcgacaggcgagaatccaccaagagtggacacggtcaccagctatacgtccggcgcaggctcgatggcccggatgaacgtcagcgggttcctttcactcacgcgtacggcactgattggctcgcatacgacggtcgatagtgcggcgctcgcagctatggccggtatcgacattggagacactgcgggtgattcgtctgaagatggcatgggcgggtttggtgaattctcgaatcaggacatgcttgatatgctgccggccggtcagattgagaaacccagcgtcggcgatctgttcgaggcatcgaaagcggctgccgcatcggcgagtgacatggacgcgaaccataaggtcgctgtgatcgacacggcaagcgcggacgcggaaagtgcttcggacatggcggccagcagatttggcaacaccatgaaaaccgcgctgtatccgctgtttttggcgatgaccgtctgcgggtcaatgattctgggcatattcaccaccggggaagttcgccgtcgtctcaccgcatccccacaacgcatgtcgtcgatgggactccagcggttgctgacgttgggcggattcgcgctcgtcgtatgcgtcggttatctggtgctggcggtcggtctgatggtcgcggcaggacttgatccgttgacattgagcgccgaaggagtgctgatgacgttctgcgcaacctgcgtatatgcgctgatgaccgtcgcctgtggattcatgctcagcgaattcgggttttcggaggcggctgccaacggattcgccaatatcttcggcctgctcatcatgttcacgtcgggcgtcgcattgccggttgacatgatgcccggcgtgatggtgaccatagccaagttcctgcccggctggtggtattgcaccgcgatcgacaacgcgctcggctccggcacggcggaggaaaccggcataagcgtcgccggctgggccggctcgctgggattggtcgcactgttcggcgtgatgttcatctgcatcggcctggccgccggccgcttccgccgatcccgtcccaccctggccgcgcccgccaccacgcagctggccgagtgagaaaatcagcctttcaaccgataccgctgtaccgagtcgtcggcgaacttgactcgggcgacccgcccttccttcatcagctcgcgcataccggatgtggcggccagcggcgtcaactgcagttcgcgcatgatctccttgacgctcatcgccgaatgccgctccagtacggtcataatcgccttgaccacgtcgcccggcgaactgttcgccatcgtgcgttgcttggtgatggtcatcgtgaacgtgttgatgtcgttgcgcgtggtcgccggctcgatgccggcctctcgcaacgcggcggcgatgcgctggtagccgtcgccgccttctgggttcacaaacccgccgcccggatacggcgtggactccagcagcgtgaacaggaactggtttcgggtggagacgaacggcgcgcccgtcaccggatgcggactcgccagcacatcatgtgtcaccatgccgtacaggccacccggattggtgatctcgatgcgatcggtgaacacgctgatatgcacctgcgtgccgcgcgcatcgggcgaataatcacggtgggtgagcgcgttcgcaatcgcctcgcgcaacacgagtggcggataatcgggcttcttcgcgccaatccaacgcatcaacgagtcgaccgcatcgtcgatcatcaccggaatcgaaccgaccaccgacttcgaggcgaccaatcgttcgtcgccccggaacacatcgtcccggctcgtccccggaaacacggctatcgaaatgccgagccgcggatagaacttctgcggatagcggcccaacgccagcagtccggccaaggtgggacgcagtattccgccgacctccgactcgtcggaatcatcatggcgcaacacctgcagatccagcagcacatcgatgccgtcccggtcggcgaacacgcgcggatgctgttcgcgcacgcgtgccaacaatccggcaacaagctgcgggtcgaggtcatcggtcgtggcgccgggcacgatatccagatcgtatgtgggctgcagatgctcctcgatgagccggtcgacctcataggaggtcatgcgccggtcgccgtcgccggtgcggatgaacgagccgccgtgcggtccgagcgcggtggtgaagcagggcttgtcgcgcggcagcatttcgtcgatgcgcgcgaacaccagattcgcgccttcgaacgggcaggtgacgatcacgggccgcaccaccggcgtcatcttctcgcacgcctggctcagcgcctcctgcatggcgcgcgcgtcgaatccctcgaccggcgtgaacccgttcttttcggacaggccaaggatgatccagccgccggagccgttggagaacgcggacagcgtatcggtgatggtcgaggagatcttgcgcttgcattccttgacctcgcactgctgcgtatcgttgccgatcatgcgcatcagctcgatcagctcggtcatcttcgcggtgtagtcgtcaaccatggcggtcctccttgacaccattgtcccgcggccggctgtctgccgaagcctcccgcgcccacgtcctccgtcaattcattgaaaattcacgcggttggggtgcgcataagactgttgttttcattggtgcagtacgaggtcccgttgtctatttgtaagtgcaacgccttcgtcagagttgtaagtctggcagctcgtcggcaaacgcctcggcgggtgtgcggtagccgagcgctcgcatgggccggttgtcggtctcgtcgacgatctcctggagctccctcgccatgcccggttcgatgatcgtgcgtttgggcaggtaacggcggatcatgccgttgcggttctcgttgccgccccgctgccagctggaataggggtcggcgaagcacgtggccatgcccggctcgtcgcgcagccgcgcgtggcgggcgaacccggtgccgttgccgtgcgtgacgctgagcctggcggccgccggcagcggggcgaacatcgccagccgcgccccgacgctccgctcggcggtcttgtcggggataacacgggccatgaggaagcgggtcctcctttcgacctcggtgtgcaggtcgcatcccatgccgatgacgctgtcggcctcccaatggccgaacccgctgcgagcgtccgcctccggcggacgaccggcgatggagacccttccggggataagggaacctcgacacccgacggcccgcatgcttgcgccgccgccggtggccgcgcggcaggcatcgggcccggcgttcgcggcgcggcttgctggaatagatccatcggtagacggtctccgggcacacgcgcatggcatcgtcgccggggaacaggacgcgcagcctgccgctgacgggcggcggcgaccagccgcagcccagcttctccgccacccacgcccacagccggtcatgcgacaggcgatgcggcttgcgcgctttggcgcacctccgggcggccttgcgccgggccggcccggcgatgtaataacggctcatccaaggcccggtcttgagccgcctgggccgatagggacggcaggattcgctctcgtcggacgggaaccacgtgttgcgtttgatctcacggctgacggtggacgggctgcgcccgatcatcgcgccgatcgcccgtatgccggtcccgttgccgatctcgatctggatgacctggcgttcctcttccgacaggtgcgaatacacttcccccataggtgcaacatcccttccggactggttttctagacaatctccaatctaacggggtgttgcactttcaattagacaacggggcgtttgtcaagcaaccggtagggggagatacaattatcttgtagcgttgatcgattccaaggagggaattatgagctatatgaaaaagattgcttcaacgctcgcggcggcagtcgcgtccgttgcttttgcccttgttcccagcgttgcactggccaacggcaccgatagcgttccctatgaggcgaacgccaccgttgtcgttgcccccaacgctcctgaagggtcagagttgatctttgaccttgagacgaagacgttcactgacattgttctcccgaacggacgcacgcttaagccaagccgtggttgcaccaacaatacttccgcttgctgggcaggcggcggagcgctcggcgacatggagtttacgggtactggcgcggttaatggcaattggcccagccggagcagcttctactccaataacaagtcagcggacatcggtttcacctggaaaggagaacgggtgtacgtaagccagattgctgcaaaccgcaaattcacgccaaacggttctgtcgacggcttctacgtcacccgttactaaaacctatgggagagcacatcctttccctacaacacctttagacggagggccggtgtcttcgggcaccggccctccgcgttcctagcggctgtgccggtgatgtggctgcggaatcggttcgtgtgttgtctttgctttttcgatgttctcagccagtctttgtttgattcgttcgttgaagcggctgcggttgagtctgcgcacgcgatcctcgtagggtttacgcatgtggtcgagcgtggccttggatgcgttggtgcggaaggcgttggcctcggcgtaggtagccgggatggtcgtgttctcaagccacggcgccgtttgcttcagaagctgggattgctcggcggcggtcctctcggccgcgtgtcggagccatccgcgcgtgaacgggttcgcgtgctcggccttttcgctggcctcgcgcgccacgtcgatgatccgttgcacgtccctgacttcccgtggaggctcggtcttccaccattcggtgaggtcggcgagctcacgcctggcctcgtccagttcgtccaccggttccggctcgggacgccgcggttcgcgtccgatctcccgcggcacgggatcaggcttggattccaagctcctgccggacgtgctcctgggggggcgtgggcgcttcgaccagttgccggccacgcgacgctatgggctggcgatcgaacacagtgattcccggaaccggctcatcgccgtgtcgagttccttcctggcctgctccttgaattgtccgagcaggccggtcgggtcgcccatctgtttgcggatggccgtcaggtaccggttggccgtggcgatgcgccggttgatcgcattgaggatgctgtgcccacctcgtttggtgatctcgcggctggcgtggccctcgtggatggtggggatacgttcgatgccctgcgcctcaaggctgcggtggtcgatgcgcacgccctcgggcagcatgaggttgcactgtttggcccagtcggcgcgcagccgttcgaggaattccgtggagtccaaggggttgttcgacacgtccacgcgcttccagaccttacggttcttggccccggtcttctgctcgccggtggcggggtctatgaccggtatccgctcgccgttctggtgatatgaactgatttttgttccgcatttcctctaactcgatgggggatgatggaaccatggcaaagggcactcgatatacgccggagttcaaggcgaaggcggtcaggctgctggcggaatcgcgttcctcgtattcgtcggagacgaacgcgatctccgcggtggcgaaggatctggggatagcgccggaatcactgcggcgttggcgcaaccagtcggacgcgacggtcgcggaggagacgaggcagtcggccgaggacgcgatggcggagctgaagaagctgcgggccgagaacgcgcaattgcgtcgggcgaacgagatcttgacgacggcgtcggcttttttcgcggccaggctcgacccgacacggcgttgatggccgcgtacatcgacgagcacagaagccgtttcagggtcgggccgatctgcagggtcctttccgaatcgttggactgcgggtttctcacgccgcgcggctgccgcatgttcagaacacgtcccgtcagccgcatgcgggcggggcgtgaggcgctggcccgcgccgtcctccagatccgctcggatttcttcatggccgtgtacggctgcgggaagatgcacgcgcagctggtcgcccagggctgggatccggccggggtcggccgcgaccgggtgatgaacatcatgcgcgggcttggcatccggggcgtgcgccgcggcttgctcagctcatcgcggtcgatgaggttggcgacggcctggcgcacggccttggccttgttggcgtcggcgtcggactgggactcgccgtagggctggatcttgaagttgaaggtcaggaagcgttcctcaccgcccggccccttgacgaccttgaccttggagtccttggacaggtcctcgatatcggtcggggtcagcgagcggaaggccacgtcgatctggccctgctggacgttgagcttgaggttggacgcgtcggcgaagtacttgacctggatggcgtcgttcttggccggggtcaggcccttgtagctgtcgttcttctcgtaggacgcggtctcgttcatcttgaacgcggtgagcttgtacgggccggcgaacgcgttccccttgacgatggtgtcggcgtcggtcagcttgtcggcgtcgaagacctcttcgtcgacgatggggccggccgggctggacatgacctgcttgagcgtcacatcgaacggcacggagtccttgaacacgacggtggtatcgtccggagcctcgacggattcgacgttggcgagcagcgagctcgggccgttcgcgtcgttgatcgtcttgatgcggtcatacgagaacttgacatcggatgcggtcaggtcatgaccgttcgcgaacttcagcccttccttgatctttacggtgaattcggtgccgtcatcattccatgtaccgtcatcggcggcgatatccgggctcaattcggacgtattgtaatcctgtgcatacaggaacgggaaaatctgaatctgcacggcatacgaaccattgtcgtaagagcccgcgggatccacactggtgatcttatcggtggtgccgatggtgatcgcggatccgctcgccgtattgttgtcgtccttcacgccgccgcatgcggtcagcgatgcgattgccgcgatggatgcgacagtcgccaaaatcttgcgatgattcttcaagggaaatacctcttctttaactactctccgcgccgtcttcattggcacggttaccaagactatggggttactgtgttagccatgtgtttccatacgaatcggctgtgatgtgcaagggcgcggcttgtggccgaatgacccttggaattgcaactattccggtattttgcgacattcgccacacaatgcccacattatgagaccggaagaggtgggggcgacaaggctgtacatgagatgagggccgcctgcatatgcagacggccctcatcgcgacctatcacagtttcccgtgacgaatgcaatcaacgccttgcggctgcgccttacttcagcttgcggccggcgcaccacacctggttgaccgtccagctggacggatcggtgagcaacaggtcggcggcgtacccgggcgcgagcagacccagcggggcgccggtgaccgcgttcggcttgtcgtagccgaacgcgcgcgcgggcgccagcgtggcagcctcgacggcgtcgaccggggagatgcccagctcattgacggcgcgctgcacggcgacctcaagcagcagcgtggagccggcgatggcaccgttcgacaccagacgggcgtggccgtcgacgacgttcacgtccagcgcacccagcttgtacgggccgtcagggcagtcggtggccgccatcgcgtcggtgacgaacgccgtgcggtggggtgcgaactcgaagcccagcttgaccatcgggtcctgcacgtggaagccgtcgttgatcagctcgatagtgacgcgcggatcctccacggccgccgggatcgggcccggcttgcggtggtgcagtccattcatcgcgttgaacatgtgggtcatgatgcccgcgccggcgtcgaaaccggccttggcggtctcgtaatcggcgtcgcagtggccgacggccggcacgacgcccgccttcgtgaactgcttgatggcgctgatgccgtgaggcagctcgggcgcgatggtgatctggcggatgcagccgtcggcagcgcccagcagctcgtcgacgagctcgggaaccgggtccttgaggcactcgggatcatgagcgcccttgcgggcgagcgccaggaacggaccttcgagatgggcgccgagcacgtcggggcgctcgtccatcttggcgcgaacgttcttcaggttcgcgcagatcacgtcgatgggattggtgatcagcgacagcacctgcctggtcgtgccgtgcacggcgtggccggcacgcgcgatgtcgatgccttccggaccgtcatcgaaggaatgctcccatgcgccatgcgcgtgaatgtccacatagcccggggtgatcagctgcccggccgcatcgatgatggccgtctcgtcggccggatcaaggccgatggaacgacacgccgactcgaacgcctcgtcgtcggtgccggtggcgacgatgacaccgtccgccgcggtcagccagaaatgatcctggacgccgcacgcatccaccttgcgggcaccgcgaacggcgacgcgacccgcctcgcccttcagcgcatcagtcacccgcgcgacgatctgttctcgtgattgagtcatattgtcctacctctttgtatgtgattcggggcgcgatgatgaccgccccatgcgaggatgggtcccccagacggggaacccatccgtcatgcgccccggttcgggagcgcatatcgatatgcctgtcagggcgctgatcagatgccctgccaagccggcttgtgctcgaaggcgtacttgtagtagtccttgtggcgcaggcgggaggcggcggcctcgtcgacgatgatcgtcgcgtgcgggtgcagctgcagagcggaagccgggcagaaggcgctcacgccgccctcgcaggtctcctcgaccgcttcggccttgccctcgccgaaggccagcagcaccaggtgacgggccttgaggatcgtgccgatgccctgcgtgatgcagtgggtcggcacctggttgatgtcgtcgtcgaagaagcgggcgttgtcgacgcgggtctgctcggccagcgtcttgacgcgcgtgccggaggccagcgacgagccgggctcgttgaagccgacgtggccgtcggtgccgatgccgaggatctgcacgtcgatgccgccggcggcctcgatggccgcatcgtactcggggccggcgtgggcgatacgctcgccgtcctccagcggggcgccgtcgagcacgtcaccgggcacgtgcaccttctccgggtcgaggccgagcggctcgacgacggtgcggtggatggtgctgtggtaggactccggatgggtcagcggcagaccgatgtactcgtcaagcgcgaaaccgcgcaccttcgacacgtcgatgtcctcggccttcaccatggcggcgaggtgacggtaggcggccagcgggctcgaaccggtcgccagacccagcaccgcgtccggcttgcccttgatcagatcggcgacgcagcgggcgtacagctcgccggcctcatcctgatccttcacgataatcacttcaggcatgtgcaacctccttgtgttgttcattcttcagcggttcggccaccccgttgtcatcagcgaccagccgtgccgtcacgcgattcttgcgtttcccgtgacatgcgcatccgctatttgttaatgatactaactaatgtgtatatccgcatcttcggcgacacaacggacattgaacatgagcgaccgtagaatgaacattgcgtgaccggaaatggtctcgcggagagccacggaaaggatccagggacttatgaccgcttaccagcaatccgggatatggggcccccacaacccgggacagagcggcaaggcaagtcccgccgatgcaagacgcacgaaccggtcattgatcttcagcctgctgttccccgacgtccaactttcacgcgccgaattggggcggcgcacgggactgtcccgcgtggcggtctccgatgtggtcaacagcatgctcagctgtcacctgctgcgcgagaacggccgcgagtccaacggcggcaagggcaagcgaggcacgctgctgagcgtcgaccccgacacgctgcatatcatcagcatcgacctgtcacagccgcatctcatccagggcgaggccacgaacctgctcggcgagccggtcatgcacgtggaacacgcgctgcgggcggtgaaccatgtggatttcgacaccatcaacgaggtcatcactcccctgcacgccgccacgcagaacgtcatcggcatcgggctcgccatgcccggcgtggtcgacggcaacggcctggtgaagcgctccacgctgctcggctggcgcaacgtcgacgtccgcacgcccatcgaacggcgtttctcacttcccgtcaccgtgaacaacgacgcgaccgccgccatgttcaccgagcgactgttcggcaagggcggccccaatatgatgttcgtccgcctgcgccgtggcgtcggaggcgccgtgctgctgggcgacgtgccggtgttcggcgagaaccacgccggcggcgagatcggccacatctccctcgacccgcagggccctccgtgcgcctgcggcaagcgagggtgcctcgaacgcctggtctcggcgacctcgctgcacgcacggctgcagcgcagcgacgaacggatgcgcgcgagcatcctgcgcgaggccggcacctatctgggcacggcgctgtccatgcccgtgggactgctggaccttgccgacgtgtgcgtgtacgggcagagcgacatcgtcaacgacaccctgctgtcggccgcgcaggcgcagctcgacctgctgaccggctcgtcgttccacacgcggaccatcatccgccgatgcgagtgcgagggcgaaatcaccctgcgtggcgaagccctatcagtcctccacgattacctggaaaaccgctgatcaggctgcgcgccgcctcccgccagcgggaggatttggattttcagcgcgcggcggcgactgcggcacgcacgacatcccgatcggtgcggcataccatgacgccatcgcctccgcctccggggcccccatccgatgtcatcgtgcgtttcgccgacaaatgaatcgccgacacgcccgtctccttcaaggcgggaatgagatcgacggtcacaccgccgccggcctgtatctggatgcgccccgcggcgtattcggacagctcccgcaggcggcccagaccatccgggacgcatgcggcgccacccgaggtgagcacgcgggtgaagccaagttcgatcagggtatccagcgcggcgaactgatcgtcgagcatgtcgaacgcacgatgatacgtgacctgcaccttgcgattgcagcgcacggcctcgttgcgggcggcctcggccagcgcgcgggtgaacggcacgtcaatgcgcccgtcctcggtcatgcctccgacgacgacgccggacgccccggcgaggatggccgaacggacgtcggcgatctgcacgtttttctcttcatcggtgaacgcgaacgaaccgcctctcggacggatcagcacctggacgccttggggtacgccgacatgggagcatgcctggatcatgccgaagcttggggtcagcccgcccgtgcccatcagagcggcgcacagttcgacgcgatccgccccctcctcatgtgcgatgcgggcgccctccacgtcctgcaccgcgatttcaaccgtcattgtcatctccttcgatgcgtcacataccttgtctatcaccgtaccatcccgcacgagggcacccgaaccatcccacgccccgacacgcgcaaaccgtggtacaaagcgcgacacgccgaacaacggcgcgcctccctttttttgattaacagtgttaatatataaacatcgttcatattcaatgacgagcatgacaacaacacgcaacgaccgcgcacacggcacgacagcgaaggagcagtgatgaccaacaccatcgccaacgcaaccctggcatcagtgtccgaaaccaaccgttcgcggatcatgcagcacctgtaccagcacggcatcagctctcgcgcgcagatcgccaaagccctcgacctcacccccgccgccatcaccaagatcaccgccaagctcatagaagtcggcgccatcaaggagaccggcgatttcgaggggcgcaagaaccgccgctccatcgggctcactctcgacaccgcagaattccacgtcatcgccgtgaaattcgcgcgaagcctggtacagctcggcgtgttcgacctcgccggcaaaccgctgaccgtgcaggaactgccccaagtcaccgaagacaccatcgactcggcgatcatgcagctccacgacaccatcggttcgctgatcgaagccgaccgacgcatcatcgccatcggcatggccgtccccggcccctacctgcgcaacgtgggacgcaccgccgtcgtgtcctcgatgcgcggatggcagaaagtcaacttcatccacgaattcagcaacgcgttcaccgtccccgtgttcgtggagcaagacgcccgcgccggcgcgatggcccaatacctgttcgatcccaccatcaccaccgagaacctcgcctactacctcgtcggcgaaggcgtcggcctcggcgtgatcgaccacggcaacatcatcaacggcgccctcggagcggccaccgaaatcggccatgtcagcatcgacatcaacggcaagccgtgcgactgcggcaacgtcggatgcctcgaacgctactgctccacccccgcgatccacgagatgatcctgaaggaaggcgatctgatcgccgatgccggcacgatgacccacctgcaggcatgtcgagcgctgttcgcactggcccgcggcggcgacaagcgcgcgatcgcactgatcaagcgggtcgcacggtacgtcggtttcggctgcatcacgatcttcaactccttcaacccctcgcagatcgtcatcggcgacatcgtcgccgaagccgggcagctcttactcgacgaagtgcacaaggtcatcgacaagcacgtcatccacgagctcaacgacaccaccgccatcaccctgtccgccctgcccgcggacgccgccctgaacggcgccgcggccgtagccatcaaccagttcctcgaccacccgtcacagttcttcgaactgtcgtgaccgcccgcggaacatcacggatttccgggatccccacaacggaggaccccgcagcaacacaacaacacaacaaccacggcaaccatcccggaaaggaaaccatcatgaccaagcccatcgttctgtctctcggagagctcctgtgggacatgctgcccagcggaaagcgcgcaggcggcgcccccgtcaacttcgcctaccacgcgaagatgaacggcgccgacggctggtcaatcagcgcggtcggcgaggatgcgctcggcgacgagctgctcgccgaagccgagaaggccggcatccactccatcatccagcgcaacgcatggcccacctccactgtcgaggtcagcttgaagaacggcatcccggagtacaccatcgtcaagggcgtcgcctgggaccatctgctgctcacccgccagctcatcgaggtcgtggagcaggccgacgccatctgctacggcacgctggccctgcgctcccccgagacccacgacaccatcatcgagctgctcaagcacaccaagccgggcgcaatgaagttcttcgacatcaacctgcgcggcgaccactactccaaggagctcatcgaggagctgcttgaagcggcgaccgtcttcaagatcaacgacgccgaactgctgctcctgcgcgacatgttcgacatccgcggcacctccgatgacgacgcctgccgctggttcatgagcgagtacggcctcgactacgttatcctgaccggcggttccacgttctccaccatcatctccaagaacggcgagtcctccacgctggccaccccgcacgtcgaggtcgtcgacaccgtcggcgccggcgactccttctcaggcacgttcaccgcccgtacgctgctcggcgacacgctggccgaggcgcaccgcaaggccgtgaacaccgccgcgtacgtctgcaccgccaacggcgcctggccggagtacccggacaccatgcccgactacctcgcgcaggccgcgcagtgacacgcccgcaggatgcaccgacgatcaaataatcacagctcattatcagagaaaagggaaacatcgcaatgagcaacgaaaccaccaagccagtcaacgcgggattcgccaagatcctgcctgtcatgttcgccttcttcgtcatgggcttcgtcgacctggtcggcaccgcgacgaactacgtgaaggccgagttcggtctcgccgacggaaccgccaacctgttcaccaccatggtgttcttctggttcctgatcttctccgtgcccaccggcatcctgatgaacaagatcgggcggcgcaagaccgtgctgtggtccatcctggtgacgctcgtcgccatggcactgccgatcatcgcctacctgctgtgcccgatgaagtccaccgtgcagctggtgctcatcgtcatctccttcgcgttcctcggcatcggcaacacactgatgcaggtgtcgctcaacccgctgctgaccgtgttcgtcaagggtgataagctcgcctccacgctgaccctcggccagttcgtcaaggcgttcgcctccctgttcgccccgtggatcgccatgtggggcgcgaacagcatctccgccttcacctacaccaacgctgacggcaagcaggtcggcatgtggtggatactgttcgtgatctacttcatcgtcggcatcctcggctacgtgctgctcgcgttcgacaagatcgaggagcccgcgcctgacgccggcaccactaccatcggccgctgcttcaagctgctgttctccgaccgcatcgtgctcctgtgcttcctcggcatcgtggcgcacgtgggcgtggacgtcgccatcaacgcgcaggcgccgcgcatcctgaccgagcacaccggcgacacgttcacagccatcgcgtcctccgcgacgatggtgtacttcgtcgcccgcatgatcggctgcttcaccggcggcatcgtgctccagaagatcagcaacaagctcggcgtgcgcatctgcggcgtcatcatgacgctctccgccatctgcttcgcgatcttcacgctcgtgccgaccaatccgccggtctggctgttctgggtcgcggtcgcactcgtcggcttcggcaactcgaacgtgttctcgctgttcctctcccacgcgctcatgtaccgtccggaccgtcagaacgagatctccggcctgatgctcatgggcctgatcggcggcgcgatcttcccgcccatcatgggtgccgcggccgacgtcgcgggtcagttcggcggcatcctcgtgatggccatcggctgcctctacgtactcgtcgtcggcttcgcctacagggtgctcgaaagcggcaagaaacccgtggaagcctgatagggtcaaggcacttcggcgctgactgaccgccccgcagagcccgcccgattgactgaccggttacgaccggcagccggtcgggcgggttttcgcatattcgagaaccgacacggacacggcaatactccgcgcgggttgcacgggttgcgtcacgggcaccgtcacgcgggacggtaccctcgcacggtgacggcgcagccgcggcccgaccgatcaatggcggtcggcggtgtcgatgacgatcgtgaccgggccgtcgttgaccaggccgacgcgcatatgggcgccgaaacgcccctcgcgtactgcaacgcccccggagcgcagcgcctcgttgaatttgatccacatgatgtcggcatgttccggcttgcccgcgccgacgaagctcggccggttccccttgcgcacgtcggcgaacagcgtgaactgcgacacggacaggatctcaccgccgatgtcctggatcgaccggttcatcttgccctgctcgtcctcgaacacgcgcagacgcagaatcttatgcgccagccatgcgatctcgtcatcgccgtcctcatcggtcacgccgaccagcagcaggaaccccggaccgatctgctgaaggtcgaacgtgggatccaaatcccccagctcattgacgacatcgaccgacgcctgcgacacacgctgcaataccactttcatgtatcggattctatcgcacccaccgccaccgcatccgaactgggcataccacggcatacccccccccccaaaaaaaccataagcgcgaacgaacacgcgattatgccgcgtccaccgaagccggccggcaccgtcgcctccggagaacagggaacctctccggaaaccgaggggggggtgtccggccccggtggcaagaacgaagcaaccggggacaatatccgtaaggacggcaccgacgccgacaatgccgacggcaaatccgcgcagctcgattccactgcacagcccgacaggagcggcccgaacggcggcccctccggacactgggagacccggccggtctatgagacgcaacgggtgcaggtgccgaccggacgcgccatctttgaacacgactggttcactgcgaacgtgaacgaccccgcgttcgaggagcacggtgactacctgctcaagtccggcctccccgacaactaccggtacgaaaaggtctggcaggacaagcagatccaggtcgggacccggcaggaggatcacggctcgtatcaggtgcagagcatcaagtccggcacgaaaaaggtgcggacgggaaccaagcgcgtccagaccggcaccaagcgcgtatggtgaccgactgatgaccgacttgctttttcgagcagctgggatataatgaaatgtccggtcataaaccggaatgcgaattgataattcaatatcggggctgatcggtttcgacggtgacctgttcgtcgcagggaagcgtgccgagaacgcagggtccgctcgtggatgtcccctgcaaaagaataagtgctaaatctaaccgcactgagttcgctctcgctgcctgagcttcgcgccagggttaaacagtgagcagccgctccgttcactccctctcgtctttggggggatgctgagcgtcgtttagaagactcgcctgaatcattgagccacagggtgattcggggactttaactgcggatatgcccgccatcagttgtctgcgacatcgatgggggcagaaaaaccgccatatggccagcagactacgcacgtagaagactgagggttcggtcatcggaccggggttcaattccccgcagctccactcgccaagggccgcatgattccaacgatcatgcggcctctgctttttcttttgcccacattttgcccacatttttttcgaggagcatccgattcatcgcgtcacccaccagatccaggtcgtcatcgaataggtcggcgtaggtgtccaatgtcatcgcggcgctcgcatgccccagctggttctgcaccgccttgacgttcgcgcccgacctgaccatgaggcttgcagcggtgtggcgcaggtcatgcacggtcatctctccctctatgccggcgcgccgacgcgcccagtagaaccatgacgacgtggtgttggggccatgcgtgcgacggacgtatccgcccgtccgggggtcggtgaacagcaggtcgttgtccccgcggccactgcatcggtcgcgcagcatcccgccaaggacatccgggaagaccacctgcctccattcgtcgcttttcggggtgtcctcgacgatcctgtgactgacctcggtggcgctgcgacggacccagagacgatgacgccgcagatccacgtcgccgacacgcagcccggccatctcaccccatcgtatcccgcacagtccgagcgtgagcaccatcggcctcctccacccggattcgtcggccagcctcatcagctcatccagactcagataccgatgctcctttctccttttccggggcttctccaccctctcgcatggattcgcggcgatgagacggtcatccttggcctgctccataatccccgagagtatgccgctcgcccgcaatatcacggtcgcgctcaccggcttggccacgacctcgcctctcgggtctctcctgccctcatgcaggacggtcacccattcctgcacctcgcggcgcgtgacggatgccagttcgcgactcccccacatgggctccactcggcatcgccactcgcgctccagcgactcgatgtaactcgccttgcatctgacacgtttcgcggcgacccatgccggccagagcgattccacagtggccttccccgcctgcgggtcgacatagctccccgtggccttcgccagcgtgacgtgttccgccgcccagttctccgcgtcggatttgcgtttgaagccacgtttgtcggtttgcgtgccgtcgggcttcctgtatcggacgcggtagcgcgtctcgcctctgctggtcttgtatctggtgacgttcgccatttttattacctgcttaataatggaagattcacgttttaaccggttttaatgtgatttaataggactgttgctgaattgaaccaaccgaaaggcaatcgcgcatgccgatcgtctacccatcgatgaaggcctcggacctgttccgtatccttcgtggtctgggatacgggattgaccgcgcgaatggttcgcataaaagaatgaaggcggagggccgtccaccgttgacttttgccttccatgacggacagactgttccgcctggattggtgaagaagacactggtgaaggacgtcgggttatccgaagaggagatccgtagtatcctcggacagaaatgaagaggcgcaacatggatacacgacaggtgaatgtcacctatcacagggaagacggcgtatggtgggccgaatccgatgacatgccgggattctccgccgccggtgacacgttcgccgaaacccgcaaaaacgtgtgggaaggcgtggacttctatttcaacgaccatcagccgaccagcatcaccgaatacactgacgatggggccgagattctttccgacaatatcgtgctgtttaatcccgatcccaggatgcgcgttaatatgcccgttcagaagcctttgtccacctatgttgcgtccgtcgtgacgaagacaccgaagatgatggtggcatagattatgagtaacgtatccgaacaggccgtaatcaatctgaccatcgccgattacgcgaatgtggataatggcggcaaggccaaccttgtcggcgtgggcggcggaatcataccactgactccgaccggccttaccgcccgtttttccgtattcgccgaaattcgtatacccggtagcctgtgcccgtgcgagatgaccgtggaatattcgctgcgcgacgcttccggagccgtcgttgaaatggcagggcctgttcctcagccggttcgtgtcgccaatatcgtcaccgttgaaagtgtcgccgggctgaatctcgagcagaagaaccacatcggcggacgttcgatgaatacgctcgacttcgccaacggcatgccgctttcccccggcgactaccaattcagagtcactatcgacggcgatgacgctcatgccgcatatgttaatttctgcgtacctgaacaggcacctaatcccgtactcggttaaaacaactgacgcaaatagcattttcgggtgtgcttcgccccgtgtaggatgagaggcgaagcgtcctcctttccatttctctggtggtctggcggttcttcacgccctgctgacgttgcaccgtcagtggggcgatttttcataaaatcacgatgccttcgccgcagcgtctttgactttcgctacgaatttgatggcatctttaatctgcttgcgtggcacttccattatcatcgcgaaatccggcccctccacggtgatgtatcgctcgccgccttttttctttttgaacgcccatgcgaacggcccagcgaggagtatgcgggtgacggtgacgcgggcttcgagttcagtgccggactccagatgtacggtcacaccgtccagtggatgcacctctgtcgttaacatcccctttttgtagatgatcgcacgcctgtacagctgatacgtttccttcgtttccttgctggtgaactccgcaatccgctcgttgaggggagtgagcgcacgatcggcttccgccttcgccttcgcttcggccatctgctcctgtaatcttgcttgaaactcggccttttctcgggctttttcctccggcgtctttctgctgaacaatcccactttttctccttccttatacggccacactatcgtgcagcatttccttgtaatcttccacgacctgtacggtcacgtcgagcgcttgggcgatgagatagctatccccttcgtacatgcgttcggcgatcgcgtattcggtcgggttgatgagtcggagcgcggtttcacgccgggctctcctctcggcttttgacccgttcgggtcgcagcctcgatcgtggtatctcgcatgcacgagctcatgggcgagcgtgcaacgccgggcgaagtcgggtagcgtctcgtcgatgatgatgagacgattggggtcgtagtagcagccggcgagatcgctgcctagtgaacgctcgcggacgtcgacacccagtagttcggcttcccctagcaaatcagcgtaggtcgtcgttttcattcacctccggtttttctatatggtggtgctcttcggcttcgagttttcgcacggtaggatgtgagttgaagagttccatctggcgacgtgcgatctcgttgagtttgagcatccgttcccggatggacttgccgtcccgaatcatttcggcgttaaggttttcgaggttggacagcacgaggttttgcgtgatactggcgtagtcgcgcatattgccttttgcgttcgggttggcgtctctccattgtcttgcggttcggccgaatacggcgatgttgagtacgtccccttcctgtgcgtatctgattcgttggtcgttgcgggacagatgtggaggcatcatgtccttgatcgcatcggtgtggacgcggtagttcatggcggcgaacaatcgcttttcgttccattcggcgttgaggcgactggattcgtccttcttgagtcgcttgtattcctggaatacgtagagtcggaattcgggactgatccatgcggcgaagtcgagggcgaggtccacgtgagcgaatgtgccgccattgcgcccgcggcgggattggatgccgatggcgttggttgccgttatccatcggcttggcgtcatggtgaaggcgttgcgtccggcctcacccataaacgtgtcgaattcgacacgtttaaaatccgggttgttgagcttttcccagatgcccaacagcgcgatggtgtctttcagacgcatccaattgccgattgcgaatcgcgggtcgccttccggtccgaccttttcgcgcgccagatcggtgagcgaaatgtagtcgttttcgtccccgttgccgcgtatcgcgacgtcgagcccgttgatgctcagtgtttcctgcacggttttcttgagtgaggccattggtcctgtccttattctcgaggggtgttcgcttcgtcccgcttgtgcggatcgatgcttgcggccacgtcgaaatcatcaggattggcggcgattcggtcagccacctcatcggcggtgcgttcagctcgggcccgcgcggctttagcaatcacctcgtccaaaacatttgacggcttgacattaaagcctaggcataagtcgatgaattcctgcaaggttggagtaccgttcgtcttgttgaacaggtccccgacgcgggtatgtttcatcccgagccttgccgcgagaacacgcaacgatgggttgccctcgtcggccttcttctctgcgaagaagtcaatcattgcgacatctatatcgctccatattctcgctgttcttgccatgcctcaatgttaaatgtccgaattttgcgacacgccgtaaattcatacttgacagatgtccgcaaattcgtacactgttaagcatgaccgtaaattcaaacagaatcgctgagatggcagtcgatggactgaggcgcgaggctcgcgcagccgaggtgcctcaggcggacatcgggcaggtcattggaaagtcgaggcaaaccgtgaatgtcaagttccgctctggagacatgcgcctcacggagttcgtcaacatcgcgcaatccctagggatttctccccacaaagttcttgagcgtgcggaaaaaaacgccgcgctcgccgataagaaagtggcgtgatgacacggctcaccgacaacgacggccgagagttcacggtcacgcgcaccccgcaagtggagtcggccggctacccgtgcctcttcgcggtcaccctcgacgggcacacggcggtcagggtcaccaagggcggcttgcaatccatcaagcaggagatcaaccgcgccctgcgcgagacaagggaggcgtccaatgagagccgatgaccttcacggccagcatatcaagccccgtcgggcggcggggtccggtacagcgatgggggcacccgttgccggccccggtgttcgccccgccacccgacgtttcctcgaccgttatccggtgctctgtctgctggcatcctgcacggcgggtctcgcgctcgtcatcgcggcgctcgcgtggatcctctcgcatgacgggtgctcccgcccgattggggcggtcgtggcggtgctgctgctcgccgtgggcggggtgtgcgctttcgcgccgctgctgatgctcgccgcgagcgatgccccgtggctgttcccggaggactccgagcgcgaataggtcttggccgggcgtcgtttcttcttcatcttccgacgcgcggccggcgacaaaggtcagtcgttaaaaccaaataaccataactgaagagttctcaaaccggtgtcgcgccgggacccctgcggggtcgaacctatccggcgcggcatcatggggcggcgcaggtagcccccggacgagatcacgcgggtcatgacgcggggcaaaggccgggacccggttcgattccgggccgtccacgaaaccacaaggtttcagccgaaaaaaaagacagtccccgctggcacgggaactgtccgaaaggaatacccaagagaaaggatacgccatgggcacagcggtttcaaatgcgctgccgggactggtcacggtcaggcagctcgccgagcataccggctacagccgttcgacggtctacaagtggagctccggggagcgtcccagcccctatccggagccggtccggaagaacggccgcgtcatcggctggcggcgcgaggacgtggaggacgcggacaaacgcaaccggtgcagccgcgccgaatatctttacggaggtcaacgatgaaccagaacagcaccgatgaatccaacgatttcggcgacgccgacgactggatgatggcgatgcgacgactcagcgagcagctgctgtacgggctggactcgctcacggcgaagccggacgcgcagtccctcaacaacctcctgttcatcgcgtcgctccagagcggcgtgagcatcgaacccggcgtgaagtcgctgctcgacaccgacgagatcaggctgctcgcaccccgctggctgcgcatcctgcgcgatgcggccgacgcgctcctgcaggtcgaggcgtccatggtcaggcaggggcagcagggcacgccatgcacgcagatacacgcggccgccggccacgcattgcgcgccatggagccggtgctcgcgctcgccgccacgcggacgggaggcgatcagctatgagccgcatgaccatcgacaaggcccgcgaaagcaccgacatgttctcaatcaggcgcttcggcggggcgggcaccacgaaggagagccgccatcaggcgtggctctccttccgcaccgagggcgtcggcgggtcggatatgagcaccatcctcggcttcaacacctacaagacgccctacgaattgtggttggagaagactggccgtcaggagccggaggacatcagcggcaggtgggcgatcatcaagggcaacgcgcttgaggtcgaactgcgccgccgcttccgccagctccacccggagttccaggtcatcgacggcaccgacatcagcctcgtgtctgacgcccacccggtcatgcacgcctcgctggatggcttcatctacgacgaggcgagcgattcgtggggcatcctcgagatcaagacggcgaacgcgaaccgtggccgcaccgactggcacaacgacgagggcgagctcatcgcccccgactactacatggctcaggtcacgcattacatggcggtcaccggcttccgctgggggtatttctacgcggacatcggcgaggcggagccggtcgaggtgcgcttcgagcgcgacgaggacgacattcacgctgtaatcaaagccgccgaggacttctggggtttcgtcgcccgagacgaaatgccagcgctcaccggcgtggacgtggccaaagcctacccggagccttcggagggcatcgaggacatgagcgacagcactgatctgcgcgagctcatggccgactacaggcaggtgaccagcgacctcaacgcactgaaacaacgcaaggaggagttgcaggactgcatcctcacctacatcggagaccacgagggggtgcgctgcgggaacatgcaagccacctacaagcactcgacccgcaagggctacacgcgcgtggtccagccatgggagggccgcaccttccgatttaccgaaatcaaaccgaagaaaaccaagtaaggagaaccgattatgggacaactcgcaacacaggcgcagaacgtgcagatgcaggccatgaaccccgaacgtgatatccgagacatggtgcgcagcgcatggccgcagatcgagaaggtcatcggcggtaacctcaagcccgacatgctgctgcaatactgcatcagctccatcaaccgcgaacctcaactgcgcaactgcacgccggtcagcgtgttgagctgcttcatgcagtgcgccgcgctcggcctgaaaccctcgaacgtggacggcctcggccaagccttcatcctcccctatggcaacaagaaccacaagggaggccagccggacgccacgttcgtcatcggttataaaggcatgttgaagctgctggagaacagcggcatctacgcgcagccggtggccgtgtacgaggacgacggtgtgaagctgaagatggacgcgaagggcacgccgtacatcgaatgccccgaagacatcaacctcgacgccgatcactcccccgacaagctcaagttcgtgttcctctccatcgaccttccgaacggcaacacatacgcgagctacatgagccgcaaggacttggaggcgtaccgcgaccgttacgcgccacgcagcaagtacaagggcaacgcggtaaccggcccgtgggccacgaacttcgtggagatgggcatgaagacgcttatccgccgcagcttcaagtaccttccggtcagcgtggagaccaagaccgccgcgacggtggacgagaccacgccggactattccgacgtgctggcaccagccatcgacgatgccatgacacccgccatcgacgtggaacccgcacaggaggaagaacagccgcaggctccggcaccgcagcagccggaagcgcagccggagccgtcttccgtggatgtgaagcgttctgagatgattcgccgttttcagggtctgggcgtggcttcggacgcggaggcgtgcgagaccatctcgaaggttctggaccgtgaagtgaaagccagcgacgagctgaccgaagcggagcttgacaaggtgctgggccagttgaaggccagcgtgaaggaaggcgagtgaccatggcgggcaggacgagcatcatcatccagggcacggcgtggggcgtgcaggagacgaagaatgggaaaaggtttctgcgcgtctctgtatcgccgggctatcgtgaccggaacggcaactgggtcagccagccggagcagaactattcggtgtggcctgcgggttacgcgaacctcaatcccgtgtttgaccagatagcgcagttgcgtcagaatcaggaccagttcgtggatgtgaccatcgtgggcgaggtcaacggtttcaacggctaccagaccaagcagggcgaattggccgcgtcctgcaacgtcaacgccagcgccgtcgccatcacgaacgtgcgctataagaacggcgggcagtctcagggttacggcgctcagggtggttacggccagcagccgcagggcggataccagccgtcgcagccaccagcctccgacccgtggggcaacggcggcggcgacccggagttctgaccatgttgcacctgtatcacgatgagacgccgacggacgtggaaccggtctgcccgaagcacggctgcacgctgtacccggcacggccgattccatgcccagaatgcgaagaggaagccgaagaggagtatcacattgaacgctgaaaaagaccaattgattacgctcgcacactcgatggaggtgtcctacagcgcgttggacgcggaggcgggactctcctacgacaccaccgtgcgcgtcagcgtgcaacctaaccgctattaccccgactacgtggccgtgaccctgctgtggctcgcctcgagccatatcttccgcggcatcgaggaattcaaccggttccgtgatgatttcgaggaccggccggaggaacgatatcagcagatcatggactcgtggcccttggtgttcggttccacggagaaggccatgaagaagctgttcgcgccggccaaaccggtcgtgaaacgccccccctggtcgctgtgcccgcgctgcaagaaacccgtatgggctcaggaaggcaccaccgacctgagggagacgcagcagctgctgaaacggaacccgttgccgcgctggtgccgtgtctgcggccagcgtttcgagtacacgatgggcgaccacatctcatgcagttccgagttctccatcgcggagacgatggacacgctcaaaagcatgttccccaccgagcagccgaacttcgagaccatcgccatcgaagccgcacacgaggacggtgagcagaatggttaaccccgccaagaaaaagggcacgagccttgagacgtggacggtgcgttacctcgcgtgggctttgcaggacacgcgcatcgaccgcatgccgttgcatggcaacgccgaccagggcgatctgatcggcgtccggttctgtggcgagccggtgtgcgtggaatgcaaggacacgaaacagccgaactaccgcaaacactggcgcgaactgctggtggagatggcgaacatggacactccctacggggtgctcgtccagcatcgcaagggcgtgggcgtgaagagcctcaggggcatggcaagccagatggcgattctgagcgtggacgtgctcgaacggttcctcgccgtgttttcggagctgagcgaggagaacgcgcttttcgccgtgcgcctgcgccgcgagtcgaaaccggtgcccaacaatccgacgctcgtgtggatgccgctcgaacggttcgcgctcctgctgaactgcggactcccgttggggctttccgagtgaccgccaacacacattggcggcggtacttctggatcgccgccatactcatcgcatatctaggagggaggagctgacatggccggttacgcgagactgagcaatgacttctggcaggacagggacgtgctcaaactgcgccgacgcaacccgtctgctgcgctcctgtacgtcatggccatcagctggtgctccgaccacgcctccgacggcatcatcgcggaggatgagctgctgtatgtcctcaacgcctcggacgaggacgtctccgacctcgctgcctccgggctgctgctcagaggcagcgacgagggctgttacgtgatccgcaactatctgaagtaccagaacagcgcggagcagatcgagcaggcgaaggagaaggtgaaggaacgccagcgccgcaagcgcgaacgcgacgcgaacaagaccgtgaccgactccgacaatgagtctgtcacgcccatgtcacgccgtgacaatgagtctgtcacgcccatgtcttttaaccaagaaccaagaaccaagaaccaaaagaattcttctgacgaagaattctctctcccccaaaccccctcgcaagccgagggggccgcagagagcgccgacgaggattatccgctcgggttcgagcagttctgggaaacctatccgcgcaagaacggcaaacgcaaggccttcgaggcttggcgcaaggcgcgacggaaaaccaacaacacgttcctgatctcgaaagccgcccagtacgcggcggacccgaaccgggagcccggctacacgctcaccccggccaactggctggacggcgagcattgggacgacgacccgctgccggcgaaacccgagccgaccgcacgcccctcgccatcggcgaaaccccgttcgcagcagaaccttgaagcgaacatggcgcgcacgtggcagtacatgacccccgccgagagggcggaataccagcgaacccaaggaggaaacaatgctcagcaagggtgaggcggcggcgatcctgtcgctcatcaactcgcatcacggcaacgcccaatgggacgacatccagcttgaagcgttccactcggagcttcgagcggacatgacgctgggagaggcgttggaggcggtgaagcgcttctacgcggcgaacgattcgggccgctggtgcggttcgggcgatgtgaacgcgatggtgcgccggatgcgcaacgagtcgaagccctcggaggcgcagatcggccgtgagtgcgagaggctgggcctatccgaggacgagtcgtggatgtaccgccgccagcggatgctcggcaacggcccggagcagtcgcagcagacggcgctcacccagcggagcacgctcggtctgcccgccgccaaaccgaagaagcgttccacggtcagccgtttcgcgggagcctcgcgacccggcatggcctcgctcggctcgatgctgggaggcgcgtgatggccgccatctacgactacgcacatacgcccgcgaaatgcctctacacgaccaaggatgcgggcgaccggctgcgcgaataccttgacctgacggaacgggagaacgtgaccttggacgtggaccgtatcctcaacaccccgatcaacgaacggtacgcacacgaatcccactatcacgggctcgaatacatggagccacaccggtgaaaccatcccaacggaaggaataaaaaaatgaaagcacttgacgaacaactggaacaccaactactcgaccggttccagtacgatgaccgccatgacgaagggtggtacggcccggattcgccgcgcgtcggcgacaagggttggatcacgtgggagaacccgaccggcggcgaaggcgcatcccgcccgttcgagatcatacgcgacgacgagcattatcgccccgatgggacgggactgcccctcctcatggtcggcatgatggacgacgggcgcgaggagtgcgtgatccgggacggcgaagacgtcagatatatgagcctactggaagccagccttggcgacggcgcatccctgacgctcatgagccgcgaacacggccatgcccggtagcgggggaacgtccacgacgaagacagtcccatcgacctgaccgcgccggacggcgaccgggaaggcaccgtgtacgcacgccaggatgatcccggcgactgcctcgtccacaaccaggaacgaggccgcctatgagcatcatcagcagtgaggcggaacacgtgtacaaggacaacaacccctaccggaaggaaaacgcatgaacgagattcagcttacaaaccatctgaccgcgcaattcatggcatcaaccataagccggtacgaggccgaaatccgcgaggacggcgacttccgaggccgcctgtacgccatgagcctcaaacgtctcaagcgcaaatgcgagaaatacgcgaaacgtgagcgcaaggccatcgaatatgtcgccacgctcaaggaggaatcatgaggaaaccattcaaggactggacgttggagaatttcgtcgggttagcgatgctcgctactgtgatcctgttagtggtgtccggcctgacggccatctgcttcgtctgctgggcttccgtgcagacacccgaccagccggagcagaccatcgtgcaaaaaattgagaccacgggcgacatcaaacgcctgtgcatcgaggccaagaccgatgggcgcatcgacgccatgagctgccagcttatcgacccaatggcgggaggcgtgcagtgacgagtcagacaacacgggacaaagtgctcgtatggcataagcgcggctacagcgcaacggaaacggcccgtcaattgggccttccgttggaggaagtgcgtgcgatcatccgcgagggcgacggtcgtccgaagccgccgcgcaaggtcgaattcatcgaacctccattgttcgagcaatgacccgcaataccaaataaaacgaagccctccaccaaaatggcggagggcacgctcaccaagcaccaatcatagcttaacgtggagggcttcaaacaatgatcatccaaaccgaaccatgccaacactgcggcagccagcaggtcgaggcaccgtggacgctctgccgggactgccgacgacagtacgcgaaaacactccaccagctgcgccgcaacatgcaactattgcagcgggtcgcgcggcatgagtacaagctcggcgaacccggagcgggcggcaaaccgcaaggaggcgcggcacccgcgcccatcaacctccacgcgcaggacatgctcgaccagaccgaggacggcctgcaggacatgtggaacgaaaccggcgtggaaagccgtccgagatggcagaccctgctcagggacgctccacgacgactgcccgacctatgccgcgccagccgctcgggacattggctgacatggctcacccacgcctgcgagcgcatcgaaccgctcatcgaccgcaagccgcgcacacgcaggataatcggcgtatgccccgaatgcggacgcgaggtgaccgccgcgaagggcgagacgctgagactctgcaaatgcggggccgtcatcgacgtggccgagctgcgcgagcagagccgcgacaaggccgaggcaatccatctcacgaagacacctgcgggcatgagcgaatggctgcgtgagaactacggatacgaggtcagccgcaaagtaatcatcatgtggatacgccgtggcaaactccccagcagcaagccagtggaagacggatactacgaattcagcatcagggagatagtcagcatggcaatggcatattccagccggcagtaggctgttgccaccccgtggtatactccgtatcaggataagtgcgaaagcctctgggacatacatctcaggggctttaccatacccacctatgcgcgtagctcagccggtagagcggcggtctccaaaaccgcaggtcgttggatcgaagccaaccgcgcatgccacggcttgcgtaccgcagaggaccagccggccatgccgagacagcacggcgacccgcaaacacgacaaccggtccgcgaactagaatctcgcccaagccaccaaacacacaggatgggaacatgagcaacaaggcaggctcaggccgataccaaaatggagcagcccgccgcaaatgcaaggccagacacatcgcaaccgaaggaccaataccgatctgcccgctgtgcggcaaacccatagacctcacactcaaaacaccacacccactcagctgcgaactcgatgagatcatcccatacagccgaggcggatcaccaaccagctatgacaacacacaactcacacacagaatctgcaaccaaagaaaaagcaacaaaataatcgccaacaccacaggccaccaaaacacaaaaaaacaaccacaaaacaccatcccaatcagccgccaatggtaaccgggggccataccctccccctcccatgcaaggctccccacagaacatagcgcccgcatccccccgcaacccgcgtggagtatcgtacgtttggccgctggggtgtctgcgagcgcccgtggaagccgttccggcatggttttgatgtttttgccccgttgttttccgaggctgttacgtttgattctccgcggttttgatatgtcacgaaattggtgttgcgaatcattggaatatatgctatagttatggctatggtcaatcaatgtaggaattgcggccatttcttccaatccacaccgaaccctaggcgtccgagactgttttgctcggacaggtgccgcaaggcgtggagccgcaaacatcagataccccaagcgctcagggcactgcaccgttgggtgcgcgccatcggtaagcgcccgatccggtgcgatgggtcgccggccagttcgactgactcaagtacctgggcgtcatattcggagatcatgcgctcgagggccggtgacggttatggcataatgctcggcgatgggcttgcgtgctgggatttcgaccatgttgatttgaccagtccgcccgataaggcgttggagctgttgccggatgcgatctatgcggaggtttcgaccagcggacatgggttgcatgtgttcgtccgttcgtcggagtcgagtttccggcgtgccggtgttgagttttattcgcgttcgcggtttattcgcatgacgggaaggaggtggccgaagtgaccacggttatccgcaatcagggtacgagtctggcggtgcgtgagaagctggccgctgatggcaggcccgtgttgttggcgttttcgtgcggcaaggattccatagccgcgtggctggcgatgcgggatatgggcatcgaggtcgttcccgcgtacctgtactatgtgcccggtttgaggttcgtggacgaggagcttgattatttcgagcagaagttccagaccagaatcaaaaggtatccgcacccgtcgctgtaccgttggctgaacaatgcggtgttccaggctcccgaacggctgcgatatatcgaggcggcgcgtttgcctgagccgtcgtatgagcagatgtgggatttcatccgcgccgacatcggcttggacaagaacacgtggtgtgcggatggcgtgcgtgccgcagattcgattcagcgtcgtggcgcgttcgtccagtacgggtactggcggcgcaatctcaagaaggtctctcctatcggggattggctcaagggcgaggtgctggactgcatcagcgggcatcatatcgagctgccgtgtgattatgcgtggttcgggcgttcgttcgacggcatcgataagaggttcaccaaggtgctcaaggacaaggcgccagccgattacgcgacgctgcttgaatggtttcccctgttggaggtggatcatgtcaggtgatttccgattcgacttttccaagaagcccaagggcaagaaggctgtgaagccggtgccggaaaatctggacgagaacgcgaaggagtaccgggagcgcgcccgtgcggagcgcaagcgtttcgtggatgcgaccgacaccgagttctggctgtgcctctgtttcccctcccccgttgagatggcgcggtggcgtgaacggtttggcttcggcgaaaaccaccggatctatgcgtaccgtgatatcgagaagctactcgccccgtacaggccggccaagtcgtccgccgtggcgttcggtgccggcgtcggcttcggtggtggcctcgggttcgcggagaagacgcctgacccgctcgccgatgtcaagtactccgatgatctggaaaaggattgtctcgccgagttcgccgccctgcacagggcgctggtcgaggctcgcagtcccaggaagctcgtggagccgaccgattccgaacactggttcgccatcgcgttccccttgcgagacgacaaggattctttccttgccgagtatggtcttcgcaaactcggagataaatacctcgatggtatggccgtagctcggaagctgggaggtgagttatgaggcgagtccgttacgcgagcaccaacgatatccgctatacggggtatgggcgtcgctcttccggttcatccggtggcggtgtgtccgccctgcgtgtgagtgcgtcccgttccgcgtcgcgatcgagcggatcgtgaaccggtaaacagtatttttttcgttcaagccgtccctatggggcggctttttcattaggaggttctcatgcgacgcggctcttcttcggcttcccgctcgtccagcagcgggagcggcggcaactcatcccgctcacgctcgaagggctcaacgctttccggcgtcggcttctcgaaagagcgaatatccgaataccgcaaacagggtttctccgatgaacgtatctcgaagatatggcaggataccctcaagatgcgcgcgttgatgaagaaacgcaaggaacagggagtcaacgatcttgaagccggcgtttctcagtcatggaagaacgcccaggcacgccgagaccgggcgttcgacaagcggttcaacgacgaatggaacagataccgcagtgcaggctggaaacggtagatcccgatttttcttgtccacatcgttactggagaggaggtggatcgtgcgtaacctgttccagcgtgccggcaatgcggtgcgtaatggggacggtcgtatccgcagcgctttttctcgcggcggctcgcgttcgtccggctcctgattttcccgatggaggtggttgtcatgcgtccgagatacgtgcagggcgagtttgatttctctcgtgccgccggttccgctcgcgcgagtcgctccagcggctcctagacattgattcgaggtgatccagttggccaagaccacgataacgcagccacagttgcctgacggcatcgagtggccggaggcgaccgtgcgatggtgggagcatttggcttccacccccggcgcggattcgtggacggaggccgactgggacaacctcatgaacgccgcactgatccacgcggacatctggggttccggcaatttcgccagcgtgcccatactgaacaagctgctgcaggattacggcatcacgccagccgcacgcagccagatcatgccggcgaaagcccagaagcaggagcggcatacgccgctcgatgagatagccgaacgacggaagctgagggtgattcagggtggcaaggcgaagaggcgtacaggaacctagcttcgctctggttcccaagcacgcgcagtccgagggaggcgaggcgtgcgcgctcgcagccggctacgacatgaagccggataagtggcagcgcatcgtgctcgaggggtggctcgccacggattcgaagctgcaatgggcggcgtcggattgcgggtgcgcggtgccgcgccagaacggcaagaacgcgattctcgagttcacggagctttatctctccgcgatcctcggcatgaagattctgcatacggcgcatgaggtgaagacctgccgcaagcatttcctgcgcatgaagtactacttcgagaacgcgcgaaagttccccgaactggcggaactggtcacctacattcgggccacgaacggccaggaggccatcgtgttgaagaacggtggcagtattgagttcatcgcccgttcgaagagttcgggccgtggtttcacggtggacgtgctggtgtgcgacgaggcgcaggagctgaccgacgagcagatggaggccatacagcccgccatctcgtcggcaccctcgggcaatccgttgaccatctacacgggaacgccgacaccgccgacctcgccgggcacggtgttcgcgcgcatgcgccgcaacgcgcacagggacaagccgccgaagaacctgtgctggttcgaatgggcggcggacgagataggcgacgtgcacgaccagcaacgctggtaccaatacaatccatcgctcggcacccgactgctgaagagcgtggtcgtttccgaatcggagaagatgacgccggacggtttcgcccgcgagcgtctcggctggtggaacgatcaggccggcgcgctgtccgatatcgatgttgacgagtgggccaagtgcaagaccgacaacccctgcatggatggctacaactcgtatgcggtcaagttcagcgcggacggcgcgaacgtcactctcgtggcgtgcgtgcgcccgccccgcaagtcgggtgaattgccgcacgtggaggtcatcgcctcgcgcagcatgcgcggcggcaccggttggctggccgattggctgaccgccgagaaggacggtgcggaacggtggcgcaaggccatcggcatcatcgtcgacgggcgcgtgggagcgcccactctggtcaacagcctcatagacaagggcgtgtccaaaagagtgatcgtggttccgcgcccttccgacgtggcggacgcttgttcgatgctcgaacaggccgtgaacgaccatgggctcacccatttcggccagcctctgcttgacgaggcggtgggtcatgcgaagcataggaaaatcggagacgggttcggctacgagacgtccatggagaacgtcgatgtgagtcccgtggaagcggtggctctcgcgtattggaacgtcaagacttccaagcgtcatccgggaagaagagcgaaggcggtggcattctgatgcagattcccagtcttgaaaacgtgcaggtcgataatctgcccgacgagtgccgagaaccgtgggatttgatgatacgtcaatggtcccagaagctcgaacgtaacctgttgcgcaccaaatactacgacgggcgaaacgagcttaagaatctgtccatcgctgtgccggacagcatggcggggataagcgaggtcgtgggctggccgcagaaatcggtggacgctttggccgaccgcatcgtgttcgatggtttcgtcggagtcggcgacgacagccgcgatccgttgggtttggattcgattctttcagacaacgacttcgacgtggaattgccgcaggccatccgcagcgcgctcactcactcatgctcgttcctgaatgtgcgcagcgcggaaccggaagacggtctgcgttccaaggtgtccgtgtcgttccgcagcgcgctctatgagaccggcctgtgggattacgcccgtcgcggcctgtcggcggcgttgtcgataaccgatatcgaccgctcccagtacgcgcaggcgaacaccatcgtgccttccgaactcatgctctacatgcccggctacacgattcgtatacgccgcacgcaatcaggccgctatcatgcggacgctccccggaacacgtacatggatcatgtgcccgtttacctgatcccctaccatcaggacctgaaccgtccctttggccgctcgcgcatcagccgcgaggtcatgagcatcaccgacacggcggttcgcaccatgctgcgcatggaggtaagcgccgaattctattcgagcccgcaacgctacctcatcggcgcggacgagccgcccgaggacaagaacggcaagaagctgaccggctgggaagccaccatctcgaagatgctcaacatcagcctcaacgaggacggccaggcacccgccatcggccagttcacgcagatgaccatgcagccgcacaccgacatgcttcgcgcactcgcggcacgcatgagcggcgcgaccggcgtgccgctcagccagttcggcgtcatgacggattccggcccttcctcgtccgacgcgatcatggcggcggaaagcgaacttgtcatcgaggcgaagaacgcctgccgcgccatcggagtgcaactacgcaaggccgcgagggacatcgccatactcaacggcaccagcgaggacagcgacgagctcgaccgcttgcaggtcaactggcgtgaccccgaacgcccatcgcaggccgcgctctccgatgccatcgtgaagcaggtgacggccatgccgtggctcgccaactccgacgttattctggagaagctcggctacacggattccgacatcacacgcctgttggtcgacaagcgcaaggccgagacccgcagcgtgcttgactccctcgtgaacggaggcaacaaggatgacggacaaccgacaactggaccagctgcaagccagccaagccagagcggtggaactggcgcgccgcgatctggcgaaactgtgggggacgctgcaacagctcagtcctgaatggcaacgtgacatgctactcgactacgtgccgcaactggtcgccaaatacggcgacctcgcggcacaggccgcctacgaatggtatatgcgcgtccgtggcgaatcggtgcccgaatcatgggagtacgacctatccgattctttccccggcgacggcatcgacaagacgatacgctggcaggccggccacctgtggaccgacccgcagaccatgcaggcgtatcttgtcggtgcgatgcaacgctgggtcatgtattcggggcgcgaaaccatcgcccgcctgtgcgagcacgacccgtccgaaccccggtacgcgcgcgtgccgagaggcgcgaagacgtgcgcgttctgcacgatgctctgctcgcgcggctgggtgtaccgcagcgagaaaaccgcaaaatacgccaaaggctcgttcagcctgtttcacgacgactgcgactgccagatcgtacccgaatgggacaggaaccaagcccacatcgagggctatgaccccgaccgcatgtactcggaatacacgcacgcccgcagcctcatcgagaacggcggcctggacgacgacacctatcggatgataaaggccaccacaaaaggcaaccccgacaatcccaacgacccgaacacgatcacctatgtgatgcgccgactctaccccgaccgttacaaggacggctacggggtgccacgaccgtcgcactcgaactgagattttccccaaccacccgcacgggtggttttttatgcccgaaacgggcccaacccactaggaggaaccatgaccgaagaggccaacggcaaccagcaggcggcatcgaccgagaacggagcgaagccgcccgaaatcgattacgaggccaaataccgggaggccgtcgcccattcccgcgaatgggagaaacgcgccaaggacaacaaggcagccgccgacgaactgcaacagctcaaggaggcccaactgtccgaagccgaaaagaccgccaagcacatcaaagagcttgaagccaagaacgccgcctacgaggcggaaaaacagcagaacgaatggaagacgcaggtctccaaggaaaccggcgtgcccatcgcactgctccacggctccacgctcgaagaaatgcaggccaacggcaaggcgctcgccgactacatcgccgacaaaaccaagcccacggtgcacgcctcctccgaatccaaccagccgcccgcaccatccggcacatccggcgactggatccgtgaccagttcctcaaacaaaagcagaaataacctccccactccatagaaagaaggtatgacgatggcttccaccgtgaactccatcatcaccagcggcgacctcggcggcggactcatccccaccgaatacgccacccagattatccaggacgcccccaagtcgagtgtgtccctcacccgcatgcgtcagatccgcatgagcacccgcacgcgcacgcagccggtgcttgactccaagccgatcgcctactgggttggcggcgataccggcctgaagcagaccacgaagatgaaatggtcgggcctaagcatcacggccgaggagcttgcggccatcgtgcccatcccggaggccgtcatcgcggattctggcatccccatctggccggaggtcatgccgcgtctggcttccgcgctcggctacaagctggatcaggcgacactgttcggcgtggacaagccttccagcttccctgacggcatcatcccgcaggccatcgcggcgcacaacacgctcacccagggcaaggacctcgccaaggacgttgccagcatgggccagaagctcgccgaacagggcttcgccatgaacggcttcgccagcaagccgggcctgaactgggagcttatcggcctgcgcaacgccaacggcaccccgatctacgtgccctcgctcgccgccggagcgccgtccaccctgtacggtttcggtctcaacgaggttgacaacggcgcgtgggatgccaccaaggccgtgctgctcggcgcggactggtcgaacttcgtggtcggcatccgtcaggacatcacctacaagctgctcgaccagtcggttatctcggacgataacggcaaggtgattctgaacctcgcgcagcaggactgcgtcgccatgcgcgtcgtgttccgcgtcggcttccagatcgccaaccccatcaacgacgtgcagcccgacaagtcgaagcgcttcccggcatacgtcatcgcgccgccctccgcagtggccgcatagtgatggccatgggactgaagctgctggccgtagcacgcggcttcggcatcatcgcatcctgacattaaggaggccgtcatggccgacgaaacggaagaaaacccatttgccacgcatttggaattggccaaacgctggaagcagatgccggacgacccagattatgttgaccagcgtctggccgacgcatcgcagttcatccgcgaacagtgccccgattggcggaacatatcgcgggcgacgcttgaacgcatcgcctgcgagctcgccaaggatgtgatctcgtccgacatgcagaccgagggcgccggtttcgatacgaccggtgccagcaatctcagtctcacggcgggcagtttcacccagtcgatgaccttctcgaatcctcgcggcgaattctatctgtccaagggacagaagaaggcgcttgggctcaccggccaacgcttctacagcatcgacctgtcgaacggggaggcgtcatgaggggcgagaccgtgacagtggtgcgctacacgcccaccggcgagaccgacccgggcggctcgcccgtcacgaaggacgatatcgaatcggtgggcaacgtgctcgtctcgccgggtgccatgtcgaatgcaaccgattcgctgcgccctgacggagtgaccgtggcgttcacgtgcctgttcccgcgcagctacgcataccggagcctgcgcggggcgagcatacgcatcgacgagcatgactacaaggtgatcggagacccgaggccattagacggtggcatgaaacccaccgcatggaacctcacgatcgaagtcaccgacacgaagggataggcatgaaacgagtgaaactccattattcggcgtttcagtcataccggcgtaacgagggttccaaggccgccgtcagcgaggctcggaagctcgcggcgagggcgaacgccatgggctcgcccacacacgcgggccagcccctgtacacggcgttgggccctcatgccaaccccaagggagccaccgcgctcgtgcacacggagaacaccgccgcgctcatcgataatgccgtgcataacacgctcgtcaaggctatgggaggcggtggctgatggcagtgaacgcggagaaactcgtcatggactggctcaacgcggacacgacgatcagggccgaatatccggcgatgttcgatgtgccggccgagtccagcgccacgcatccgataccgttcgtcaccgtcgaacaggtgggaggctcggacgaaccgttccgcagtctgccgcttatcgcggtgcaggtgtggggcgagtcgcgctggctggtctccgaggctgcggcgaaactcatactcccccgcctcaaacgtatcgtcgaactgcccgaggtcgccgatatcgacatcaccgggcgcacgcatttccccatgctcgacgggcggccccgttaccaaatcattctccagttgattatcaaatcagacgattagaaaggctgtaaatcatggttaattccacaaccaacgattccaccatggtgtcgttgggcaagttcaaggtcggcggctacgcctactgggcacccgccggcaccacactgcccaccgactccgccaccgcactgcccgccgagtacaagctgctcggctacctgtccgaggacggcctgaccaacacgaccgacaccgacaccgccgagatcaaggacgcgaacggtgccaccgtgatgaagatcatcaccagctacgccgagtcctaccagttcgccctgctcgaagtgctgcgagccgaggccgcgaagctccgctataactcggacgcggtcaccggcaacgacaagagcatgaccatcaaacaccagatgccctccgacgaggacttcgttttggtgttcgagatcgcgatgagcggagatgtgaaggatcgtctcgtgatcggcaacgcgacccgcgccgagttcggcgaccgtcaggtgcatgccggcgacccgcaggtgtacgacatcaccgtctccgccaacgacatgggcaacggcgtcaccgccatcgaatacatcggcatcgccgcgtcccgtagcattgccgccaccgaggccctggtcggcaaggtcattgatccggtcaacggcgacgagaccgccgaaaccggcgaagggacccaggccgccgaataacggttcttcccgcgtcatgcgttcgacgacttccccgtgacgcgggaaccctcattttttcaaccctcgaagtcgtccatggtttttttggagaagtcattatgtcacgaaaccgtcatcatcgttacggtaataccgccagcaacaacgtccccggcaaccgtccgcaggatcataggcccgcgcagggcaagccgcgcaccgtcaccgtcaagggcatctccctgaccatcgacccgaaggtgctggacgattgggagttcgtggaatctctctatgaccttcaggccgacccgaagggcaacgccttgcagatcatcccgttcctgcgccgacttctcggcgactcatacggcaaggccaagaacgaattacgaggcgctgacggtcgtatcgacggcgaaaccatgggagccttcctgaacgaactgttcgaggagatgggcaaggctttcccaaactcatgacgctcgtgctcctgctcgtccgctgcccaaaccaactggcggcggacatgagaggggagtacgggcttgccatccatgatctgccgccaatgcaggtagcgctattggccgtgaatctgccggacggttcgctggtctggcaggagttgaacacggcgcgagcgtggacgttcgaccagtatctcgccgtgctgcgcatcgaacagatgaacctgtggatgtgggccaacactgatccgaaaaaacgtggcccgcgaccatgtccgctgccacggccggggaagcccgaagtcaagcaggagactgctcccgagccgcacaacgagggcgggggcacggtgcggcgaacgcgcaccatcaaagcggtgggcatgagcgtcgaacagctcgaccgattcatgagccaacggttcacgaccgtgaaccgtgtggagaaccggccgcagaccggacaaccatagccaaacagaggaaggcgaaacaatgacatataatctcgccaccgcattcgtgcccatcgtcccctcgatggaaggcgtcggcaaggccatcgaaaaggcgttcggcgacgtatcccagaacgcgggaagcaagggcggcgtgaatgccggcaagggtttcgcatccggcctgctcgccaaaggcggcatcatcggtgcagctgctgccgtcacgaccaaggccatgagcgtcatctcaggcagcatcggaaacgcggtcagccgcgccgaccagatgaacaacttcccgaaggtcatgaagaacctcgggtacagttcgcaggacgcggccgcatccatcaagaagatttcgaacgccttggacggtctgccgaccacgagctcggccatgaccggcatggtgcagcagcttgcaccgttgacctcgaatcttgacgaggccacgaacatcgccctcgcgttcaacaatgcgatgcttgcgggcggcgcttcgaccatggagcaggagaacgcgctcacccagtacacgcagatgctgagcgccggcaaggtcgatatgcaggcatggcgttcgattcaggccgcgatgcccggccagctcaatcaggtcgccgaggccatgctgggcacagggaagaactcaaacgacctgtatgaggccatgaaaaacgggtcaatcagtttcgatgatttcaacaagaaggtcatggaactgaaccagaacggtttcggcaaatacgcctcgttcgcccagcaggccaaggacgcgactcagggcatcggcacggccatggagaacgtgcaaaaccgtgtcgccaaggccgtgcagaaggtcatcgaagcggtcggcgtggagaacatcgccggggcgatcaacggtttcagctcccagttcggcaaaatcggcgacgcggcggcgggcatggtcaccggcgtgaaaggctggttcggcaaggcggcgcaggccgcgcagccgcttgtgtcgatctggcagtccgatttcggccagctcggagtgtatctgaaaggtctggcgtcgaacgcgcaggcgttcggcgggagtctgctcgatgtcgtcacgaatggcgggggcttgcagaacttcctcacgggattgaacaacatcatctcacctctcgtcaactggtggatcacgcttacccgcaacgtgagcatcttcatcggcacgctttccgacagcggcggagtgcaggcgttcctcgcgtcgctcagcgaactctggaaggggctcacgcagctcggtcagggattggcagacgcagtaaccggtttccttgcggtcggtcagaacggtggcgtcgcagcctccatcggccagcttgtgggcgacgccttcaacgccgccgcgccgttggtcaaatccctcggctccgccttgcagtcggtcggtgattgggcgagcgaacacggcgatgcgatacgaaccgtcatcgctggcatcgcaggtggtttcgcagcgttcaagacggcgagcctcatatccgcagccgtcaccgcattgaaatcgttcgacgtggcggcgaagatcgccgcagccggacaatgggttctcaacgcggcaatgaacgcaaacccaattgttctcgttgtcaccgcgataggcgcgctcgtggccgcgctcgtctggttcttcacgcagaccgagacgggccgcaaggcgtgggcctcgttcacctcgttcctctcctccgcatggcagtcggtggtttcgttcgtcacgagtctcggccagaacatcgccaacttcttcacgcagacgtccctcgaaggacttgctcagcgtcgaaagcccgcacaggtcatcgggcgcgaggatgagcacgcggccgtcgcgctcgtactccttggccaaggcaacctcgtcgttgtaggtggcgtatcggttcagcagtcgctcagcggcggccggataggaatgccgaaggattcgcgccggcgcgatgtcgcgcttctgctcgcgcagcacgtccttcggccttgtcagcaccagcacgatgcggtcatatccgtcgtcaatggccttctgcacggggaccggatcgacgatgccaccgtcgaaatacgggacgccgtcgatcacatacggctcgcaggccacgggcacggccgacgaagccttcatgatgttgaaatcatcgtaatgcacgtcggacttgtcgaaatacttcgcggaaccgtccaacgcattgcacgcgatcaccgtgaacccggtggggttcgccgcgaacgcctcataatccaccggatattcgccgtcgtgattgctcagcgtgccgtatacgtaatccagattcgcgaaattgtggtgcttgacatagctgtcgaagctggcgtattccttgcggaaggcgtattcggtgtagaacttgtggttgcggccgtgctggccggcgaggaacgacaccatgttggcgctgcctgcggagacgccatagcagtggtcgaacgtgatgccttcctcctggcagcggtccatcacgccggctccgaatatcgcgcggaagcctccgccgacatcgatcagcgccgtcctgtgcgagggtttcgattgtgcggatacatcactgcgctgtgtgtcggtgcgttgcgattcgaccgtctcggctgcacccgcgtcccgtgcgcccgtatccgcgtgggccgtggccttgtgaccgttgtccgtcgccttcaccgtcatcgtcgtcccctttcgtagtgtcgtccaagtgtacgcccgttatgcggacaatcacggtgtctgccagggtcgcccgatctagctgtgcagcagttctcgtgacagcgcggcgatgcgttcgccgctatcagaattcgcgatctcgacgccgccgtccatctcctcgggagcaagcttccccaacgattccagaaccatgcccagatgccggaccgttccgcgattgccgtcgataatcgcggtcgtcgacggcagcagctcacggaagtagtcgcggtagaacacgaaatgcgtgcagccgagcaccaccgagtcgatggacggaaggtcatagccgtcaaaataccggtgcagggtgcgcatcaccaggtcatggtcgcaaagccttccgctttcgacgatttccaccagatcggggcacggctggggcgaaatcatgttgttcgccttgaaacggtccatcagtgcggcgaacttgtgctcgcgcagcgtcagcggcgtggccgcgacgatgacgtgctgcggcatgtgccgtgcaggcgcggtcccgtctcccgcggcggtgtcgccccgatcgcaggcgaccttcagcgcaggctccatgccgatgatcggaatgtcgtaatggtcgcgcaacgcgttcaccgccgcggacgtggcggtgttgcaggcgatgaccaccgtcttgaccccctgactcatgaacctctccatgatgtcgaagctcagccgacgcacctcctgcggggtcttcgtgccgtatggcgcgttcgcggaatccccgaaatacaggacccgctcgtgaggcatgtcctgcacgatctgtcgcaccaccgaaataccgcccaagccggaatcgaatatgccgatcggtgccgtcgaagtcatgtcccatcgcctttccaacgtctagcggccaagccttcctgccgggaggccgtgtcatcgaacgcccccatactatcgcacactgttatccggcgcatgcgtttgcggccgcagcgcacgatgtcgtcgcacggccgcaagcgcagcagtcgtgcagcaacgcatcggctgtgcagccatgcatcggacggccagcccattcgcgggctgggagtactctggcagtcatgagtatcccgaaaagcgtcaccaaggcgcatgcgaccggcaatgatttcatcgcgtatctggattccgacggccgtttcgagccgaccgccgatgaggtgcggcaattgtgcgacaggcatttcggcatcggcgccgacggcctgctcaggctcacaaaaccgcagtacgtcgccgatctgagcgaggcgcaggtcgcggcgtgcgatgacggagacgccgagtggttcatggactatcgcaacgccgacggatcgctcgcagagatgtgcggcaacggcacgagggcgatcacgctgttcgcccagcggtgcggcgtggcgtcgacgcaggtgggggagccgttccgcctgggaacgcgcgccggtgtcaagacgctgcgcccgctcggcgacgtggcgccatacggcagggatgtgttccgcgtggacatgggctcatggcggcgcggcgaccttgacgccttcacggtgaccattcccggcacgccgggagccgcccgcggcacgttcgtggatatgggcaatccgcatgtggtctgcgtgatcgaagacgcgatgtccacgctgccaagggtcgaggatctggatcttgtgaccaaaccggaggtctcaccggtgctggaatccgaccagaacgcggagttcgtgcgcgtcgacgagatcgacgctgccgcagggacgggagaggcgaccatgcgcgtcaatgagcgcggttgcggcgagacgctgtcctgcggcaccggtctgtgcgccaccgcgatcacgctgcgcgccaaaaccggcgtagatcactgggacatcaccgtgcggggaggcacggtgcgggtggacgtcaccgatgagaccgtcgcgctcaccggttcggccactctggtcgcggacgtgacgttgatctgatcgatcgaggctctcaaaactcgaagatacaaaaaaggaaccgccattttccaacaatggcggttccctatcttcgagttttgagagcttcgttttcgtatcaggcgaaaattgccggcccatccacgacgataatcagcacgatcagcgcaatgatccagaccacgtccaccatcagatcgaaattcagccggtagtacttgcgcaggccgttggatttcgccggcatccgctgcacgctcaccgtagcgtgcgacagcgccatgaactggatcgtcgtggcgaacatcaggcccaggcaccacgggcacagggcgcggatcacgaacatcgattggatgaacagccagtaggcgtacgccaaggccgcgagcccgcccagccatgtgcaaagcgcgaaccagcgcggcacgacgaccttggacaggcctatcaccgcaatcgtgacgaacacggattcggcggcgatgccgaagaaggcgttcgggaagctcaatccggcgaatttgatgaactccgcctgccatgattccgccacggtcgagcaggagaccacggcattcacgtcgcagccgagcttgacgccgggattgcgagcgagctgcagcgtctccgccgacagcatgagggagacgaacaatgccgccgcggaggcggccaacatgaccagatacgtccagaccgcgccatgacgccagccggtgagcccggcgtcgacgctgatgtcagcctgtttgactgcatcgctgttgtgagtcatacatcatccttacgttcgaggagaccgtgatgagggtggctgacaacgcggcgatatcacggtggttcttgatttttcgcggggttatgacgcgccttgtgcaataaccgacagcacacagcttacgatggatacatgactcgtttagcacttgccgccgcgccgccgaagtcgggctgggacatccactgccatacggtgtattcggacgggacgcagaccccggcgtccctggtcgaactgagccgccatatcggcctgcacggggcctcgatcagcgaccatgacacgaccagcggatgggcggatgccgaggccgcggcgcgcgaggagggcatgcgcctgctgcgcggcacggagatcacggcgtgcgatgggccggtgtcggtgcacatgctcgcgtatcagtacaatcccaacgaccgtcatacgtcggacctgttcgcgcgcacacgtcaggcgaggctgaagcgaaccaaggccatggtggcgcgactgggcgaggattatccgatcagctggcagtccgtgctggagcaggtgcacgagggggagcggaccacgatcggacgtccgcacatcgccgatgcgctggtcgccgcgggcgtgtaccgcacgcggtccgaggcgttcgccgacgcggtgagcgccacatcgaagtattacatccccacgccctccccgaccacgcacgaggtgctcgccgccgtggccgcagccggcggcgtggtgatcatcgcgcatccgggcgcggtgaatcgcaacgtgacactgctgtccgacagccagatcgagacgctgatcgaagaggggcttgacgggctggaggtatggcatcgggacaatccgccgcagcagcgggaacggctgtatgccatcgcgcaggcgcatcagctgctggtcaccggcggatcggactggcatggcgccggcaagccgaaccatctgggcgagaacctgactgatgacgagaccgtggccgagatcgtgcggcgaggggcgatttcgctggtctgacaccgaccatcgaccccggctgtagagaaaacacaaaaccgggagcggccgcagggcgttcaaaccctccggtcgctcccggtcgtcactgtatatccggccgactcccgcctacgcacaaaggcgggagaggggagccatctgagcccggcgttcggtcagagcgccccgaagcccacggcgtgcttggtctcggagccgatgagcgcgtatccgagcgcgttcgccggcacgatgatgcgacggcccttgtcgtccgtcagcttgatcggggttccggccgacagcgccgattcgatggcctcggtgacgctggccgcgtcctcctcggtgctgaaggtgacgggtcgcgccacattggcgatgcccaattcgatgtccatgtttgctcctctcgggatgatgcgctgttgaaggcgctgggtggatgatgtgtccgacgcccgtttgcgccacgggctttcagtcgcatgcacgcgtgccgatgaaagccattgtgcattgctcccatcgacgtgcgtgacggttttcgctgtaggctacttgccttgcgatgactgcagctcggactgggcgtcacgcatggcgcgttcctcacgttcgagcagcgggatgacgatggtcggggtgtcgcgcgccgccgacgcgccgtcctgtcggtccggcgttgcttgggacggggcgtcttcgatatgggcggccggcgtcgcgttcggcgtgcggtcgtcggtatcgtccgtggtgcctgttgcgtctgcatcgcccgtgtcgtcgctgtccccgcggctcagcgtcatcgttcccgatgtcgtgcccgccgttgccgtgacatgttccgtctcagcgctgtaccgaattcccatggtctgcggatcgaactccccggccgccttgatgtccgcggaaccggtgcggtcggtctcgtcggtgttgtcgttcgggtcggcgatgtcgtcgggcacacgcgctccggcctgtgtcgcggccgcggccttgcgccggtcggcgtcattgagcagcgtgccgacggtgatggtcgatggcggcttggacgactgggcacccgacgtcgtcgcgggcgcggtcttacgcgtgaatgcgccgagctggtgggccagccgctccacctgcgccttgaactggatgattttctgactatcggcccggttcaacgcatcgatgaactcgccgacctgctccatttgcagccacaggttcgcgcgcagcatgatcagatcgtccagacgagaacccatcatgcggccatacgccgcaagcaccgcattgcggtgatcttcgtcaagcttgccgaaaatccacgcgagatcgcgtgccggatcgttgacctgcatgttctgccagttcgtcaccgcggtgatggtcgcgccggaaaacagcacgtcgccatccgagaacccgccatgcaccgggcaggtgacgaacgaccacaggccctccgtctcgatgatccggccccagctcgacgtgatttccggcggcacatggcccgcctgccgcagccgcttgatccaggcggtcagctgggcgcgaatctgcccggtggagaataccggatacgattcggcctgcaggaaattcggccgcagccggtgaatggcgccgatggccgtgcccatcgccgcgcaatcatccaaagtaagcagatcgaggggtcttgcgacgccatcgttgtgcgccgccaccatcacggtcgcgccgccggtgagcgtgcttttctccttgccgtcaacgaatgcaagcaccgtatccagggcgaatccgagaccgcccggatccttggcgcgctccagcgtcctggcggcctgcacgcgcccggtcaggcgcttgcggccgtcttcggtgtcgcatgcgtatatgtcatacatcctgcctgcggcatcctgcatcacggcctgatcgatgcccgcggcgtcgtcggtgtcgttggcccgttcgctgtctcgcacgccggccatgacgatgctgggcatcgccgccgaggcgagtgccgccaacataagcttgcttcgttgagtcacactcccacactaatacaatgtcgcgcctcgcgggaggcaattggccgtatgactcgcggaaaatcacggtttgcccactatgctggcagcgcatcggccgggcatgcgccacaatggaggatatgagtgcatcgagcgagacgattcttgaggggctggacgatgcgcagatgtcggccgttaccgcgttggacggcccggtgcgcatcatcgcgggggccggagcgggcaagacccgcacggtgacccgtcgcatcgcctatgcgtgcgcgcggggggattgggatgcccgcaaggtgctcgccgtgacgttctcggtgaaggcggccgcggagatgcgcgcgcggctgcagacgctgggggtcggcgacgacgtgaccgctgcgacgttccattctgcggcattgcagcagctgaggcgtgtgtgggacgacatcttcgagacgccgctgccgcacgtgacctccgaccagcgcgagaacgtggagagggcgatcagacgggtcaccaatgccgcggacatcgatgcgcagcaggtgcgtgacgtcagggcggagatcaactggacgaaggtgtcgctggtggcgcccgacgactatccgcgcgtgtgctcggcgacgcaccgtcagccgccggcggagctcgatccacagcgtttcgccgacgtcatcacggcgtacgagggggagaagacggtccgcggacagatcgatttcgatgacattctgctgctcgtgtgccatgtcatggatgattacgaagagttggccgcctcgatccgctcgtcgattggctggctgacggtcgacgagtatcaggacgtgtcgccgttgcagcatcggctgatgacgctgtggctcggaaacaaccgcaacgtgtgcgtggtcggcgatccggcgcagacgatctactcgttcgccggggcgagcagctatgacctgctgcatttcgcggacgagttccgcccgctgaccgccgacgtcactctgaacacggattaccgctcgacgccgcaggtggtgcggtatgcgaaccgggtgctggccgccgcgccagaacgggaacagtatctggtgctgcgttcggcgcgttcgggcgggccacgcgtgggccacacatgctatgacaccgatgaggaggaggcgcggggcatcgccgcgcggatagcgcgtctggtcgccggcggtgtggatcccggcgattgcgcggtgctgacgcgcatcaacgcgcagcagcccgcgatctgcgccgcgcttcgggccgagggattgcgataccgggtgaggcgtgactccggatggcagaactcggcgctcgcggatgatgcgcagagccgtctggccctgctggaggccaagggattgagtgctgcagcctcatcggtgaccgtttcgacgattcacgcgtccaagggtctggagttcccgtacgtgttcatcgtcggttgctcggaggggctgattccctacggcgcatcgattgcgggcgaggctttggaggaggagcggagactgctgtatgtcggcgtcacccgcgccgaggacggattgcacatgtcgtacgcgcgggccaaggacgagggctcccgtcccaatcgcctccccagccgcttcctcagctgacccaaggcacatgtcgcgtgcccctgctggcgggggcacgcttgtgtgtggtgacgttacttggcggaatcgttttcgtcgttttcgccgccgtcctcgccgagcagtttgctcagttcggcgtcccagtcgatggcgccgccatcgttctgcgcctcggctccgttcgcggcgtcctttgtgccgtccttcgcgtcacctgcgacggaagctccgtcatccgttccggccctcgtaacgcctgaggccgtgtcccccgcggctccggagtcgacggtcttggcctcatcgggcaatgctggcagcagatcggggtgggaccaggcgccgtcgcgcccttcgacaccacgctccgcggtgatctgctcccagagggccgccgcctcgcgcatgcgcttggggcgcagctgcatgcccagcagcgactcgaaggtgcgttccgccgggccgcccaccgcgcgcttgcgcctcatcatctcacgaagctgctcgatatgcggaatgtgcgccatgccggcgcgccacgtcacgcaatccacccagccttcgacaagcgccatcagcgtctccagcgagaccagcgcctcacgctgctcgggcgtatcggggatgcccaccttggtcaggttcaccgcgccggagatcgactccggatccatcgcgcccgcatcgcgaagctgctcctccatcgcgtcgagatcgatggtgatgccacgcgcgtatttgccgatcagcgcttcgaaccgcggcatcagccacggcactcctgcgaacagacgggcgtgcgtgacttcgcgcagcgccaggaacgccgtcacctccgcgacggggatgtcgagcgacgtcgcgtattcctcgatgttctgcatgatcagtccgcccgcggggttcttgagcagcgcgatgccctggtcgaagctgccgttgacctcgtgcgacaggtctcccgcggcgtgccccagctgcatggcgaatgacgtgttgcccagcagcttgatgagctgcccgggatccttcatgccatcggggacgggaatcggcaccggtccggcgaacatgcccgcgatctcgccgttgaacgagttgccgagacgctcggagatcaccgaggcgagcgcgtcgttcatcgactgcgcgaccggcccggcgaatttcgcccacgattccagcgtgtcctcgacccagccggcccgtgtgagcatctgcgtctctcctgaggtcgggtcgaacgtgcaggccgtgtccagccacaggttggcctcgctgagcgcccgccgcgcgatgtcggccgactgggcgctcaccgttccctgcgagccgtcggcgttcgccttctgcaatgcgatggacttggcgagtttcacgttgatcggcccggattccacggtctgcttcatatctccgaacgtgttcagtccgccggcggtgaacgcctgcatgagcgattgcacttcctcgggcttggggagcttgccgatatcctggctcatcagctgctcgcggatctcgtcgggcagctgcgaaagctggttccatgccatttcgccctgcaccggtccgaagcaatcgatgaaccattgccgcatcgcgttctcatccatggtgtttcccgccttatgtgttaacgtcagttgattccatattatgggaggtatggcgaatatgcatgaaaacaaccatcttcacgcgcacagcgcactttcgcgcatccgcaactacctcggctcgcactcgctcaggtatttcgccggcgccatcgccgtgatactggcagtggtgacgatgatgctgccgtccgcgtatacggtagagggcccggggccgacgcaggatgtgctcggctcgtcgtcaggctccgatgtgatcagcatctccggcgctgaaacccacaaggattctggtaagctgctgctcgtcaccgtcaacgccgccggcgtgcccgggtatcccgtcaccaacgctcaggcgttggccgcatggcttgatccgaagcagaccgtgatgccgcaggaggtcgtgttcccggtcgggcagaccagcgaggagtacgccgaggaatcctcccaggagatggactcatcccagtcgtcggcgaccaatgccgcgctctcgtatcttaagggcaagggcatggacgtctccggcgtgaaggtgtcgatgcatgtcgacgacatcggcggcccgtccgcaggcatgatgtatgcgctgggcgtcatcgacaagctcaccgaagccgatgagaccggcggcaagaccatcgctggcaccggcacgatcgacgcgaagggcaaggtcggggccatcggcggcattcgactcaagatgctgggcgccctgcgtgacggcgcgacatggttcctcgctcccgagtcgaactgcaatgaggtggtagggcacgtgccgcagggcctgcgtgtcgtcaaggtgtcaacgctcgatgaggcgtatcaggctctggtggcgatcggtcaggggcacaccgacggattggccggctgcaccgcatcgtgagtcgcccatcccggcccgccggaacgcgtccggacgaggcacggaaccggcctgtccatgcggcagcgggacggccgggaatcggccatgagacggacgcgtccatcggcatgtcccgtatcaattgcgagaaaaacccaaaaaacatccggtttttcggagtgttaacgtcgctgttcccagcgttttggtaatgtgttcaccgtgaatgaaacggcatcacagaacggtgaagaatttggtttccagtccggcgacatcgtgcaggaatggttgtgggatgacgacgtcgatgactcggtgcgcgccaagattgaggatctgaccggcgaggatctggtcgacgaggactatgattccgcagtcgacggagccattgtctggtggcgggacggtgatgacgaggacgagctgtccgacaccatcgtggacgcctattcggtcgtcggcgatgatggccctttctgggtgctgacccccaagcccggcaggaccggcgcggcgagttccagcacggtccagtccgccgccaagaccgccggcatgaacgcggccacaccgctcaccgtaagccccgactggaacggcatccggcttcgggcgttcggcaagggacgctgatccggcctgtccgccggcacgataccagcggacgatatcgacggcggcatcatgcatgccgccgcatctgacgtacggcatcagaggcatcatgcatgccgccgccgtcacagccaacatgcccggggcgcgaaccgccgcacatggaatgagccgtgcacgccgtgaagcgggccccgcgaatcagcgctgcgccacggattgcttgtcaatcagcgtgcaatgaatcttcgccggtattgaggcgtccaacggcggcaggggagcggtcgtctccggttcgtcatcgtccggctcccgaccctcgatcagcgataccaatttgcgcgtcgcccaataccccatctcataatgcggcagctccacggtcgtcagctgcggctccagcgtctcggcgaacacccggtggttgtccacaccgaccacggacacgtcccggccgacgaccaggccacgtctcgccgcgttctcgtacacgtaccatgcgcgggcgtcattgaagcagaagtacccgtcgggccgcctccgctcgaacaggtcggtcacggtctgcaacgcaggcccgttgttcggcacggcgaccaccagcgactcgtcgaacggcatgcccgcctccaacagtgcacggcgatacccctccagccgtccctgctgcgcgagcatcggctccgagcagccgatataggcgatgctcgcgcagcaggcgtcgatcagccgcttggtcgcgtcgtagccgatgagcgtttcatccggttcgatgctggcataccggccggtgcgatccgtggcgtcgacgagcaccagcggataatcgtgcaacggtttcggcacgtcggtgaaacggttcgacatcttcgcgtaaaggaacccgtccaccccatagcgtttcagcgtggcgatctccctcgcctcgtcgctgttgccgtcggtgttcacggtcagcagcatataccccaacttgctggccgcgtcctgcgcgccgaggatgattccgcccgcatagggcgtggcggcgatcccctcgctgatgaaacccaggatgcgcgtcttgctggtgcgcagcgagcgtgcaagcggattaggccggtagccgagccgcttggcggtggcgcgcacctgttcggcgatggcgggtttgacccggccctcgtcgcgatcgttcaataccaaggaaacggtagagaccgacacccccgttctctcggcgacctccttcatcgtcgtcataggaagaacggtacacgcaatctgcgggtttcgcaggattgttcacgctattgacatccgcctgccggtgccatgcaatcgctcggtggcggtcatctggtggcggtcgcgggcacaggcagggcggcggttattcgtcgccggtcactcgcttttgccggagaggatggcgtcgacgatcttcggcttctcggtgagctgaccggtgaatccagggcggatgtccatgtgtagcacgaggctcgtgcggtagccctgctcggcgagcttcttggcggcctcgccggccactttgagcacctcgtccaggtcgccttccacgttggtgaacagcgcattggtctcctgcggcaggccggattcgcgaatcaccttgacggcctgcgccacatatggcgacacctcggagccgacgccgttcgcggagacctgtatagccgccacggtgttgagatacggcttgccggtttccaggtcgatcggcacttcctgcgtgacggcgttgcggtcgatggtcatatgaatgccccctgattggttggttgttgctgtgttggatggtctgtatatacggtatgttccggccggcgtcgccataagggatccgcctgccgcgtgcaggtcagcgccagtgccatgcgtggtccatcggcccggaaccgtggccgaggttcagctgcgcgccgagcgctccggtcagatagtccttggcatgacggatcgcgtcgggcagtgcctcgcctttggccagattcgaggcgatcgccgacgacagcgtgcatcctgtgccatgcgtgttcggattgtccacgcgcacgccgtgaatccatgtcgcgacgccatcggcatacagcaggtcgctcgcatcggccacgccatgcccgcccttgacgagcaccgcgcagccgtaatgctccgacacggtgcggccggcgtcctccatcgccgtatcgctcacgatacgcgtgctctcacggtcggtgtcctcagcccatttcgcagggtccagcgaggctccccggtgggcgatcaggtcaagcagcacctcggtttcggggatgttcggcgtgatcacctcggccagggggaacaggcgctcggtgagtgcagtgatggcgtcgtcatcaatgagcttggcgccggacgtggcgaccatcaccggatcgagcacgatatgacgtgcgtgatgggcctccagccggtccgctatcgtgcagatgagttccgccgacgataccatgccgatcttgaccgcggccggtggaatgtccgtgtacaccgcgtcgatctgtgcggcgaccatgtccggtgtgatattctgcacacccgtcacgcccatcgtgttctgtgcggtgatcgcggtgatcgcgctcatgccgaacaccccgttggcgagcatggtcttcagatcggcctgaatgcctgcgccgccggacgaatcactgccggcgatggtcagcaccggaggcagcgtggattgcgccgccgttgtgtcaagttgctctgtcatgccgttcattgtagccggatggtcttgaaattgcgctgtttctatggtgagatggagtcgttttgcaatcgctgaccatggatcggcgaccacggataaaggagagctgcggcgagatggcgaatgacgatatccttcggcgtgatggtgttctggcgcgtatcaccggcttcgatgaaggacgcaccgcatattatgcggtgatgccgaacggccacagcacgcagctgacgttccccagccaggagatcttcgacatcggcgacgtgctgctggtcggcaaggacttctatacgaaggtgccgccctcggtgtggccggtcaagccgcgtgtcggcgtaatccgccgtgcgctggaggattgcgtggtcatcgagacctcggatggtctggaattgctggaaggcgaatatccggtcgacatcgcgcccggaaacacggtggagttcaccgatctgttcggcatcgaacgggtgctgtggccgaccgcgattcggccgggggagtccgaccatgatgacgacatcaagcagtaccgcctcacgccgagcgccgatccgtcgctcacgttcgcggcgttcggtgggtatgagcgggtgatcgcccgcgcgaaggagctgatcgagacgcagctgggcaacagcgcccagatgcgggcgatcggcgcgaagcccatcaagggcgtgatcttcaccggcgcgccgggtaccggcaagacgcacctggcccgcatcatcgcgaacgtggctgacgcccagttctaccttgtctccggtccgacgatcgtcagcaagtacgtcggcgacagtgaggagacgctgcgcatgatcttcgccgcggcgcagtccgacaagcgcgcgatcatcttcttcgacgagatcgattcgatcgcctcctcgcgcgagaccgacacgaacggcgtcggcaagcgcctggtggcgcagctgctcacattgatggacggtttcgagtccaagggcaatgtggtggtggtcgccgcgacgaaccgcatagaggacgtggatccggccctgctgcgcccggggcgtttcgattggcagattccgttcccgatgccgagcgagcatgaccgtctgcgtatcctgcaggtgcaggccgcatcgctgtcatgcgagggcgagctgccgttgaccgacgtcgccgagcgcaccgagggctggagcggcgccgaagtgtgcgccatctggaccgaagccgcactggtggccgccaaggacaagcgtgccgcgatccgcgccggcgacctcatgaccgcattcgagcgcgtcgagcatcggcccgagttccgcgcacgccggcactaggtgcgagctcgattctcggctcctgcttgcggtaagggatggttcttgccctcgctggcggccgcaggccgtccttgattgcagggcccggagggctcccgcgtagcgggcgatggtgtggtcttgtgtttcgtcggttttgcatccgttctgccgtttgtccaccctccggtgctgcgtgccacctcccgccagcgggaggggatgggtcttgtctgctggtctgattgggatgtggagtcttttgttccaaagtgtgagacaagtcgaggattttgtgccacaccacgtcgaaaacgccggttttgcgcgtggtgtggcacaggaccttgctgcggaatcggttttaaccggttacatacgctgccgtggtacaagaggaatatcggcaatccttgaaaaatggccgattccgctgtccggtgcgaatcctcccgtatcgggcgtgtaccacaccacggtcaaaaacgtgtttttcgtcctggtgtggcagcgacttcgccgtcatggctgcacccgcacagcctcatccgcacagccgcacccgcataaccgtcaccgaccggcgggagagcgacgacctgatgcgctaccgatgcgcccgcaggaagtgcttgatgagtcgcaccaaggcgaatcccacgaatgagaatacggtgaataccagcatgaagtatccgatttgctccatgcagccccatgaaagctgccatccgccaatcgaggtgcagacgtcggccttcgcgcaaggaccgccttcgaacccgtggatcagagcgaacagcagcgggagtgagaccgctacgcatccgagagggaatttccaagtgcttttcctgaagcaggcagccgcgatattgatgataagcaatactggaggaacaaggaagttgatcatcagtgcagcggccatgaagccctcataatcgggctgaactatacaggccagaagcaggccgtaaaggacggctacgatcagcatgcaggcgaatcgtccgggattgccgcgtatccacgaaccggatttcgacagtatggaaaggctgttgttcgtcgtactcatggaatccctttctcgacattgagcaacgtatatccatgatacgggatggcgcccgtcagaggaagagccgcaaatacgaatgccccccgctagcggggggcattaccgatgaaggctggagcttactcgctggccttggagtagagcttgccgccctgggcgcggtacttttcacccatggcgtccataccggcaaggatctcctcggggctcaggacgttggcggacacgacggtgtcgtcggtgaccgggttcgccggggtctcgacgccctccgggatcttgccggcgacggcgtccgcgacgatctgctgctgggcggcctcgccgccgaacgccttgcggatgttctgcgagatggccatcgagcagaacttcgggccgcacatcgagcagaagtgcgccatcttggccggctcggcgggcagcgtgtcgtcgtggaaggcgatggcggtatccggatcgtagctcaggttgaactggtcgagccagcggaactcgaagcgggccttcgagatcgcgttgtcgcggtccatcgcgtgcgggtggtgcttggcgatgtcggcggcatggcaggcgatcttgtaggcgatcacgccctgcttgacgtcatccttgttcggcaggcccaggtgctccttgggcgtcacgtagcacagcatggcggtgccgtaacggccgatttcggtggcgccgatggcggaggtgatgtggtcgtagcccggcgcggtgtcggtcgtcagcggtcccagcgtgtagaacggggcgccgtggcacacggccttctccagctcgatgttcatgcgcaccgtgtcgaagggcacgtggcccggtccctcgatcatgacctgaacgtccttggcccaggcgcgctcggtgagctcgcccagggtcatcagctcgctcagctgggccgcgtcgttcgcgtcggccagcgagccggggcgcagaccatcgccgagcgagaatgccacatcgtacttggcgaagatgtcgcacagttcgtcgaagtgcgtgtacaggaagctctcctgatggtgacgcaggcaccagtcggccatgatggaaccaccacgggagacgatgccggtgacgcggttggcggtcagcggcacgtagcgcagcagcacgccggcgtggatggtcatgtagtccacgccctgctcgcactgctcgatcacggtgtcgcggaacagctcccaagacagcttggaggcgtcatcctcgaccttttcgagcgcctggtacatcggcacggtgccgatcggcacgggggagttgcgcaggatccactcgcgggtggtgtggatgtcgttgccggtcgacagatccatcacggtgtcggcgccccacttggtggcccaggtgagcttctccacttcttcatcgatggaggaggtgacggccgaattgcccatgttggcgttgagcttggtgaggaaggcggatccgatgatcatcggctcggcttcggggtggttgatgttgcagggcatcacggcgcggccggcggccagctcggagcgcacgagctccacgtcgcagttctcgcgggtggcgacgtactgcatctccggggtgatgatgccgtgacgggcgtaccacatctgggtcaccgggtggtccttggcgcgcatcggctggtgcgtgcgtccacgccattccttggtggcgcggccgcgcttgatggcgcgcttgccgtcgtcctgcaggttgcggcggcggccctcgtagtcctcgatgtcgccgcggtcgcggatccagtcgaggcgcaggggcttcaggccctccttcgggtcgcacttggggccttcggtgttgtagtcgtggaacggggtgttcgggcccaccccgggggtgtcggagagcttgatctcggtgtagggtacctcaaggtcgtaggagccgtactcgtaggagaacggcacagacttggtcttgcggatgtgcgccttgtcgcgctgcttggacccacgggcggcgatgtcgacgcgctgctgcttggcgagcttctgcgcgtccttggcgtccttggcgttggtgaacttcttttcggtggcctcggccccggcggcggcgctgccttcctgcgcggcctgcgtgtcggtggcgggggtgtgggtcacgatgcgcggggcgtatccgtggcgctcatctgcgcgcacggccttccagccggagaccatctcgcgggtggcggcctcggggtcttcggcgcccgcgatggcggagaccgcgaaccagccggcggccttcgtgccggccagcatggccatgtcagccgcggtcacgccgccgccgacgacgaccgggaactcgctggcggagcagatcgtgttgatctgcgcggcatccagggtcttgccggagccgtcgttgccgcccaccgaggcttccggcttggtggaggagacgtgcagaggtccggcgccgatgtagtcgatgcagccgtcgggcagctcattgatgagtcggaccagggactcggtctcagccgacagtcccacgatcgcttcgtcgcccagcagggcgcgggcctcgcgcggctccatatcgctctggccgatgtgcacgccgtcgaccttgatgcccttgcggcgggcctgccacaccacgtcggcgcggtcgtcgatcacgaaggccacggagtcggacttctcgttgtcctcgatgatctgcgcgatgtcgcgggccatctcggtcagctcagaggcgtcggcgcccttggctcgcaattgaatgaaggtggcgccgccatgcaaggcctgatcgatcacctcggtcagcggccggtccttgcagtcctgggggccgaccacgaagtacgcgctcaggtcgaacgaatcgcgcatggacgcgaatgggtattcattgctcatctgttgttcctttaattgtgttattggaagaatatgatgccggcgccactcatcgggagcaccgggaggggcggctatcgcatgtcgatcgcgcggtctgccacctcctcggcggtaacgttccacagcgcgtccagcagcgccacctggaacgaaccggggccgttgcttcgtttctcggctatctcgccggccgtgttgtacagcgatgtggcggcgagcgcggcgatcagcggctgcgcgacggcgagatacacggcggtgacgccgccgagcgagcatccggcgccggtgattttcgtcatcatggcgctgccacccgccagccggtacacgtgttcgccgtcggtcaccatgtccgtcgcaccggagacggccaccgccgccgtgccgttggcgccgtgcctcgccatgaaccgtgcgagccgctgcgccggtgcgatggcggattccacgtcgtcgacggattccacgccggcgggcttggatgcggtagcggtcgcggattcctcgttcagcccccacatggcgtcgagcgcgatgatctccgaggcgttgcctcggatcacggtcggcggatagcgcttgaatgactgcaatatggcggttctggtctctccaatgccggcggcgacggggtcgagcacccagggatggccggtgttgtggaacgccctcgccacttgcggcagcgcgtccttgtagaacggcagcagggtgccgacgttgatgtagtcggcgccgctgatcgtggcggtgtcgatgatgtcgtccggcaggaagctcatggccgccgcgcctccggcggcgagctgcgcgttggcgacaaggttgatggtgacgaaattggtgaaggactgtgccagcggcgtagtctcgcgtaccgtgcgcaccgcgtccgctatctgctcgcgcagtgatggctgtgtttgcggcgatatccgcgtgttcggcgattcctcgctcataatcattgctccctacgatggtcttgaccaacaggttcaaagggtcaggcgtgtggcctttctcaactcgcgtactgctgcgggttcccctgcattgtgcccttcaacgctatggcccaatatggacattgtgtcttgcgtttcttggaggtacgtggtaatggcgccgtttcgttgccggcatgcgttgcgttgcgatttttccggccctgtatgggggatacaggattggcgatggcgacacgccgtttttgttaatggcatttacatgaaatacaggtaatgagatatcattctcatgatcaccgtgtggatatcgcattggtgcgtatacactaacagcaacagagcggcgcggcaggcgctcgtggattcaatgaagaaggaacgtttatggcagttcgcagacttggtggccgcatcgtggctttcgccgccacagtggccttgtcaataccgttagggttgttaacaaattcagcgtgggcggtcgaggacgccacccgatccgactccaccacgcagatgagctccacgccggaggtggtctactccagcgccgtggattccaagcagaatcgcacctcggatttcgacgccaactggaagttcatgctgtccgattccgtgcaggcgcaggatccggcgttcgacgattcggcctggcagcaggtcgacctgccgcatgactacagcatcacgcagaagtattcgcagagcaacgaggccgaaagcgcataccttcccggcggcaccggctggtaccgcaagtccttcaccatcgaccgggacctcgccggcaagcgcatcgccatcaacttcgacggcgtgtacatgaacgccaccgtctggttcaacggcgtcaagctcggcacccatccgtacggctactcgccgttctccttcgacctgaccggcaacgccaagttcggcgaggagaacaccatcgtcgtcaaggtcgagaacaggctgccgtccagccgctggtactccggctccggcatctaccgcgacgtcaccctcaccgtcaccgacggcgtgcacgtcggcaataacggcgtggccatcaagaccccgagcctcgccacccaaaacggcggcaacgtgacgatgaacctcaccaccaaggtcgccaacgacaccaaggccgcggcaaacatcaccctcaagcagaccgtgttccccaagggaggcaagaccgacgccgccatcggcaccgtcaccaccgcatccaagtccatcgcggccggtgccagcgcggacgtgacctccacgatcaccgccgcctcgcccaagctgtggagcatcaagaacccgaacctgtacaccgtgcgcaccgaagtgctcaacggcggcaaggtgctcgacacttacgacaccgaatatggcttccgctggaccggcttcgatgcgaccagcggtttctcgctcaacggcgagaaagtcaagctcaagggcgtctcaatgcatcatgaccagggatcgcttggtgcggtcgccaaccgccgcgccatcgagcgccaggtcgagattctccagaagatgggcgtcaactcgatccgcaccacgcacaaccccgcagccaaggcgctgattgacgtctgcaacgagaagggcgtcctcgtggtcgaagaggtcttcgacatgtggaaccggtcgaagaacggcaacaccgaggattacggcaagtggttcggccaggccatcgccggtgacaacgccgtcctgggtggcgacaaggacgagacctgggccaagttcgacctgaccagcaccatcaaccgtgacaggaacgccccgtccgtcatcatgtggtcgctcggcaacgagatgatggaaggcatcagcggcagcgtctcgggcttcccggctacctccgccaagctggtcgcatggacgaaggccgcggacagcacccgcccgatgacctacggcgacaacaagatcaaggccaactggaacgagtcgaacacgatgggcgacaacctgaccgccaacggcggcgtggtcggcaccaactactccgacggcgcgaactacgacaagatccgcacggaccacccctcatgggccatctacggttccgagacggcgtccgccatcaacagccgaggcatctacaaccgcaccaccggcggcgcccagtcaagcgacaagcagctgaccagctatgacaattccgcagtcggctggggtgccgtcgccagctccgcctggtacgacgtggtccagcgcgatttcgtcgccggcacatacgtgtggaccggcttcgactacctcggcgaacccaccccgtggaacggcaccgtctccggcgccgtgggctcctggccgtcgccgaagaactcgtacttcggcatcgtcgacaccgcaggattcccgaaggacacctattacttctatcagagccagtggaacgacgacgtgcacacgctgcacatcctccccgcatggaacgagaacgtcgtcgccaagggctccggcaacaacgtgccggtcgtcgtctacaccgacgcggccaaggtcaagctgtacttcacaccgaagggcagtaccgaaaagcgactgatcggagagaagtccttcaccaagaagaccaccgcggccggatacacctatcaggtctatgagggcaccgacaaggactccaccgcccacaagaacatgtacctgacctggaacgtgccgtgggccgagggcaccatctccgccgaagcatacgacgagaacaacaggctgatccccgaggggtccaccgagggcaacgcgtcggtgaccaccaccggcaaggccgcgaagcttaaagccgatgccgaccgcaagacgatcaccgcggacggcaaggacctgtcgtacatcgaggtcgacgtgaccgacgccaacggccatatcgtccccgatgccgccaaccgcgtcaccttcgacgtcaagggcgccggcaaactggtcggcgtcgacaacggcagctcgccggatcacgactcctatcaggccgacaaccgcaaggcgttcagcggcaaggtgctcgccatcgtccagtccaccaaggaggcgggcgagatcaccgtcaccgccaaggccgacggtctgcaatcatccacagtgaagatcgccaccaccgccgtccccggcaccagcaccgagaagacggtccgcagcttctactactcgcgcaactactacgtcaagaccggcaacaagccgattctgccgagtgatgtcgaggtgcgctactccgacggcacgtcggaccgtcagaacgtcacatgggacgcagtcagcgacgaccagatcgccaaggccggttcgttcagcgtggccggcacggtcgccgggcagaagatctccgtgcgcgtgacgatgatcgacgagatcggtgcgctgctcaactattcggccagcacaccggtcggcacgcccgccgtgctgcctggctcgcgtccggccgtgctgcccgacggcaccgtgaccagcgcgaacttcgctgtccactggaccaagcccgccgacaccgtgtacaacacggccggcaccgtcaaggtccccggcaccgccaccgtcttcggcaaggagttcaaggtcaccgcgacgattcgcgtgcagcggtcgcaggtcaccatcggcagcagcgtctccggcaatgcgctgcgcctgactcagaacatccccgccgacaagcagtccgacacgctggacgccatcaaggacggctccacgaccgtcgacgccaataccggcggcggcgcgaacccgtcagcatggaccaactgggcgtactcgaaggccggccacaacaccgccgagatcaccttcgagtacgcgaccgagcagcagctcggccagattgtcatgtacttcttccgcgacagcaacgcggtgaggttccccgacgccggcaagacgaagatccagatctccgcggacggcaagaactggacggatctcgctgccacggagaccatcgcggcccaggagtcgtccgaccgagtcaagccgtacacctatgacttcgctccggtgggagccacgttcgtcaaggtcacggtcaccaacgccgacaccacaacccccagcggcgtggtctgcgccggcctgaccgagatcgagctgaagaccgcgaccagcaagttcgtcacgaacacgtccgccgcgctctcgtcgctgacagtgaacggcacgaaggtctccgactccgtgctcgccgccggctcctacaacacgcccgcgatcatcgcggacgtcaaagccgagggcgaaggcaacgccagcgtcaccgtgctgcccgcgcacgacaacgtgatccgcgtgatcaccgagtccgaggaccacgtcacgcgcaagaccttcaccatcaacctgggcacggagcaggaattccccgcagactccgatgaacgcgactacccggccgccgacatgacggtcaccgtgggcagcgaacagacgtccggcaccgcgaccgaaggcccgaagaaattcgcggtcgacggcaacaccagcacgtactggcattccaactggacgcccaccaccgtgaacgacctgtggatcgccttcgagctccagaaacccaccaagctcgacgcgctgcgctacctgccgcgccccgcgggcagcaagaacggctccgtcaccgaatacaaggttcaggtcagcgatgacggcaccaactggaccgacgcgggctccggcacatggaccaccgattacggctggaagctcgccgagttcaatcagccggtgaccaccaagcacgtgcggctcaaggccgtccacacctatgcggattccggcaacgacaagttcatgtccgcctccgaaatccgcctgcgcaaggccgtcgacaccaccgacatcagcggcgcgaccgtgaccgtgcccgccaagctgaccgtcgaccgggtggacgccgaccatcccgccaccttcgccacgaaggacgtgacggtgacgttgggcgacgccacgctgcgctacggcgtggactacctgctcgactacgcgggcaacaccgccgtcggcaaggccacggtgaccgtgcgcggcatcgacaagtactccggcaccgtcgccaagacgttcaccatcgaactgaagaacgccccggcgccggaaccgacgctgacctcggtgagcgtcaagaccaagccttccaagctgacctatgtggtcggcgacgcgttcgacccggcaggactggtgctgcagctcaactatgacgacgacagcaccggcaccgtgacctggaacacgcagacggccggcgacttcacgttcaagcctgcgctcgacgcgaagctcaaggtcaccgacaagaccgtcaccgtcacctaccagggcaagtccgcggtcatcgacatcaccgtctcgcagcccgccccgaccgtcagcaagacggatctggacaaggccatcaaggcgatcgaggccaagaacccggattcgtccaagtacacggccgactcgtggaagaccttcgcggacgccatggcgcatgccaaggccgtcatcgcggatgattccgccacccagcaggacgtcgataacgcgctcaaggcgctgaccgacgcctacgccgggctgaccgagaagacgcccgaacccgcccccgtcagcaagtccgagctggacaagaagatcaaggcgatcgaggccgagaagctggacgggtcgaagtacacggccgactcgtggaaggcgttcgagaccgccctggcgcatgccaaggccgtcatcgccagcgattccgccacccagcaggatgtggacgcggcccttggcgccctgacctccgctcgcgacggactgaccgagaagggcgaagtcaagcccgacccgaagcccgaaccgggcaccgtcgacaaggcggcgctggataaggcggtcaagaaggtcgaggccgagaagctggacgggtcgaagtacacggccgactcgtggaaggcgttcgagaccgccctggcgcatgccaaggccgtcatcggcaacgccaactccacgcagttcgacatcgacaacgcgctgtcgatgctcaacgacgcccgcgccgcgctcaaggagaagcccggccgcatcatcgccatcatcgatggcagcgcactgagcaagaccggcgcatccgtcgccatcatcgcctccgtcgcggccgcgatgctggcggtcggtgccggcgtcatggcgttgcgccgcaagcgctcctgacccccacgagactctcgcgagtctccccgggtgccccgtcgacgatcatgccggcggggcacccgcatatccgcaggttggatgctgccgaacaaggcggcatgctgtcaccgtctgccgttagactcgtgcgagcatactaagtccccaaaccgttcaaaccagaaggtgcattgtggctgtttctaaactcgatgaagtcgtatccctcgccaagcggcgcggattcgtgttccccgccggcgaaatctatggcggcacccgttccgcatgggattacggccccctcggcgtcgccctgaaagacaatatcaagcgtgaatggtggcgctccatggtcgtcacccgcggcgacgtggtgggcgtggacacatccatcatcctgccgccggccgtatgggtcgcttcgggtcacgtctcagtgttcaacgatccgctgatcgaatgcctcaagtgccacaagcgccagcgttccgacaagctggaggagtcctacgccgaaaagcacggcgacaagctgcccgagaacggtctcaaggacatcgtctgccccgagtgcggcacccgcggcgagtggaccgaaccgcgtgacttcaacatgatgctgcgcacccacctcgggccggtcgaggacgagaacagcctgcactacctgcgccccgagaccgcgcagggcatcttcgtcgacttcaagaacgtgatgacctcctcgcgttccaagccgccgttcggcatcgccaacatgggcaagtccttccgcaacgagatcacgcccggcaacttcatcttccgcacccgtgagttcgagcagatggagatggagttcttcgtggtgcccggcaccgacgaggaatggcaccagtactggatcgacacccgcacccgctggtacaccgacctgggcatcaaccccgagaacctgcgtcactacgagcacccgaaggagaagctctcccactactcgaagcgcacggtcgacatcgaatacaagttcggtttccagggctccgactggggtgagctcgaaggcatcgccaaccgcaccaactacgacctgagcgcgcattccaagcactccggcgaggatctgagctacttcaaccaggccaccggcgagaagttcgtgccgtacgtcatcgagccggccgccggcctgacccgttccctgatggcgttcctcgttgacgcctacgacgtcgacgaggcgccgaacaccaagggcggcgtcgacaagcgcaccgtgctgcgtctcgacccgcgtcttgctccggtcaaggccgccgtgctgccgctgagcaagaagcccgagctgcagtccatcgcccacgatctggccgccgacctgcgtcagcacgagtggatgatcgactacgacgaggccggtgccatcggccgccgttaccgtcgtgaggacgagatcgggacgccgctgtgcatcaccgtcgatttcgacacgatcgacgaccaggccgtcaccatccgcgaacgtgacacgatgcagcaggagcgcgtcgcgctcgacaaggtcgccgactacgtggccgcccgcgtgtccgagaagcgcgtgcgctaccccgagggccccgtcagcatcaccggcgccaaggccgccgacggcggcaccgacgtcgccaaggagaccggcgtggacgagtccgccccggtcaaggtcgccgaggccggtggcctgtactgatcgatacccggcccgactacaccgggccgggtgctgaacatcattcggacagcccccttttcaccaagggggctcttgtacattcaagacatgtatggcatgagccgtgccgattcgtgggggagagccgtgacagacaccgttgaacagaccatcgccgtcgacgcgcatgagaccgacgtgctcgacccgcgcaccgacgcaccggccgggaaggaaccggtcacgatggcaccagtcgatctcgggccgatccacgtgccgacgccggtggtgctctccccgatggcgggcgtcacgaactggccgttccgcgtgctgtgtgaggaatacggcccggacggcctgtacgtggccgagatgattacggcgcgcgcgttggtcgcccgcaatccgaaggcgctgcgcctgtgccggttcgcgccgagcgagcgcatccggtcgctgcagctgtatggcgtgaacccggccatcgtcgagcaggccgcgcgcatcgtcgtcgatgaggacatggccgaccatgtggacctgaacttcggctgcccggttcccaaggtcacccgtcgtggcggcgggtccgcgctgccgtggaagaccgacctgttccgcgagatcattcagcgcgtggtgaaggtgtgctcggcggcgaacatccccgttaccgccaagatccgcgtcggcatcgatcacagccatgagacgttcatggaagccggccacatcgcgcaggaggaggggtgcgcggccgtcacgctgcacgcccgcaccacggcggaatactatggcggccattcggactggagccgcataggcgaactggtcggcgcgctggacatcccggtgttcggcaacggcgacatctggggcgccgacgacgccctggagatggtccgcgagacgggatgcgccggggtcgccatcgggcgcggatgccagggccggccgtggctgttcgccgatatcaggaacgccttcgcgggcagcgacgagcgcgtcaaccctacgctgggggccgtatgcgacgtgatcatgcgccacgcccggctgctcgtcgagttctatgacggtgacgagcgcatggccgtgcacgacctgcgcaagcacatcgcctggtatctcaagggattccccgtcggagggacgacgcgcagggcgttcatggagtgtgagaacctcgccgacgtggagcgcgagacctcgcgtctcgatcccgccatcaccttccccgaacgggtgaaggacaagccgcgcggccgtgttcgctttgcaaaaaaagtgcatctgccgtacggttggctcgactctcgggtcaccacgcacgaggagcgcgagacgctgttcggcgacgatccgatggacgccggatactgagacggcatccgggtcatgggccgaatgcggccatggcgtgtcgttttgtgcaaatgagatggaaaaacgttgatacacgccgagaaaatagctttataatcaatggttctgcgatagagttatgcgtaaccgtgagtgacaggagacaatggtgagcgagattgcccagactgacaatttcaacgacaggaccaacatcaaagtcgtcggtgtcggtggagccggcggtaatgccgtcaaccgcatgatcgccgaaggcctgcagaacgtgcagttcgtggccatcaacaccgatgccaaggatttgctgcgctccgacgccgatgtgaagatctcgttgaatgacgcttcaagccgtggattgggtgccggcgccgatcccgagcggggcagcaaggccgcgcaggatcaccagtccgacatcgaggaggcgctcaagggcgccgacatggtcttcgtgacctgtggcgagggcggcggcaccggcaccggcgcgagccccatcgtcgcccgcgcggcgcatcagcagggggcgctgaccatcgccgtggtcacccggccgttcacgttcgagggaccgcagcgttccgcctccgccgatctgggcatcgagaacctgcgcaaggaggtcgacgccctgatcgtcatccccaacgaccggctgcttgagctgtccgaccgcacgatcggcatcgtcgacgccttcaagaccgccgattcggcgctgctcgccggtgtgcagggcatcaccgacctgatcacgatgaactcgtacatccatgtcgacttctccgacgtcaccgccatccttcgcggcgccggcaccgcgctgttcggcatcggctccgcgcggggcgaggaccgcgccacgcaggccgccgagatcgccatcagctcgccgctgctggaatccagcgtcgaaggggctcacggagccctcatcaacatcgccggcccgaccgacctcaagctgcaggaggcctccgcggccaccgagctggtgcgcaaggccatccaccccgaagcccagatcatctggggtctcgcgctcgacgacgcctacggcgacgaggtccgcgtcacggtcatcgcggccggtttcgacgccgattccaagaacaccaacgtaccctcgatgaagggcgccacgaccgccgcatccatcccggcttcccacaccacggaccccgtcacgccgacgcacgcgcacgaccagcagcagccggtcgcgccgagcatccccgtgcgcacgcagccatccgcgaacacgcccatgaccaccaccaatccggcggcgcgtcaggtgccggatttcgcgctgcgcaagggcggccccgcgtcgatgccgatcgatgacgagacctccgagcacgatatcgtctcctccggtgacctgggcgacctcgatatccctgattttctgcgctgagccgaaaggaactgaacagtcatggctgggtttatgaagaacgcgatgcagtatctgggcatggcggatgttgccgaagacgacgagccgatggacatccaggatgaggatcccggattcgacgacgatcattcggtcactccggtgtcccaggctgcgccatcgtcgccgacatccgcgcccagccgtgagtcgaatccgttccagggtcgcgtgagccgcatcaccacgattcatccgaagtcctacgaggacgcgcagctggtggggcgtgctatccgcgacggcgtgcccgtcgtgctcaacctgaccggtgtctccgaggccgtggcgtaccgcatcgtggacttttccgcgggcgtcgtcttcggcgtgcgcgggtccatcgagcgtgtcactccgcgcgtgttcctgctcagcccagcccaggtgaacatcaaggtggaggagccgcaggcgccgtcctcggcgcacgacctgttcgccgactgatctgccggcggtcgtccggattggcggctgtagacgattcgtcgtcatgacagcggcggcggtaatgcccagttgacgttcagctgacggcaatgaagctgtatgccgttttgataggctggaaggcatggtgttcacaatagtgcgtctggtgattgactggattatcgacgcttatatcacggtgctgttcgtccgtatgatcctggattgggtgtcggtgcttgcgccgcgttggtatcccaagggcgtcgtcgcatcgctgatcaatgtcgtctaccagctcaccgagccgccgttgcgctggctgcgacgctacatccggcccataccgatggggcctatagcgatggacgtcagcttcatcgtgctgtacaccgcacttgtcgccttgagaatattggtgtaaatcgcgccgtaatcacgcatacggcgagagttctttcagggttcgtgctagcatcggaaggtgataccaacacagcgaggcatcgtgcccaaagcgaggtgtaagttttatggctcttttgacgcctaaagatatacgggagcataccttccagaccgtgcgtttcaaggaaggctatgatgtcgacgaggttgacgattttctcgatcaggtgacggaaaccgtcgaggcgcttggcaagcaggccgttgcaagtggccaggcgacgcagtcccttcctcccgacgtcgccaagctcaactccaagatttccgagttgactgcgcaggtacagtcactgcagagcgaaaacgagcagctcaagtccgcggcgcccgtcgccagcaaggacgatcaggcggctcaggtggctgcggcgaaactcaccgaagccgaggagagcaaccgcgcgctgtcccagcagaacgagcagctcaaggatcaggtggatcgcctcagcggccagatcgaccagctgaccgcgcaggccgcccaggcctccggcaaggccgatgtcgccgcgcagctcgccgcggtgcagaacgagcgcgaccagtaccgcgtcagcgccagggacatgagcggacgtctgcaggaagcgcagcagcaggccgcctcctaccagcagcagctcaacgatgccaagaagcacctcgatgcgttgcagcagcaggccgcgcaggcctccgatctggctcgtcagctggaggagtccaagcagcgcgagaaccagctgcgcgagcaggtcgccaaggtcgagccgagcacggagaccggcagcctgcagaagatcgctggtgccgccgccgctgccagcagcgagcccgagcgcgccaccgccatgctgacgctggccatgcagctgcacgaccagtacgtcgacaagggcaaggccaaggcgaaggaaatcaccgaggccagccagaacaagtacaacgagctggtcaccaaggccaacgactactcgtcccgcacccgtaccgaggccgatgagtacaacaagcaggttcactccgatgccgacgcgtactcggagcgcactcgttccgacgccgacgcctactcggtgaagacccgtcaggatgccgacacgtaccgcgagaacacgcagcagcaggccgacaactatgaggacgaggtgcgtcgtcgcgccggcgagtacgacagcaagacccgctccaacgccgatgagtatgcgcagcaggtgcgtgacaagctcaccacccagtccaaggtcatcgagggcaacattcagggcctcaagcagttcgaagccgaataccgtgcgcgtctgaccgagttcctcggccagctgtctcgtcaggtgtccgatacgaacaactacagccagatcggcaagcaggcggaatagtcgatgaaggatatccaaggacggctgcgtgttcgcgtagccgtctttgcatgtgtggcggccgtggcgctgggcatcgatcagctcaccaagatgtgggcgcagcaggcgttgggcgacgggcgtacagtgccgctgatcccgggcctgctttcgttgacgctggttcataatccgggtgcatcgctcggtctcggatcgggaagcacatggctgatttcgctgctcgccgtggtggcgtgcgtggtgatggcggtgctggcggcacgcacgatatcgatgcgctggacggtgatgttcgcgttcgcgttcgccggagcgttcggcaatctgatcgatcgcgtggcctatgcggacgggttcctcaatggcaaggtcgttgatttcctgaattatggctggtccgtgggcaatgtcgccgatatctatctggtgatggccggcatcggcgtcgtggtgctgattgtgctggatgtgccgttcagtcgcaaggacctcgatcggattgagcatctgggggaggatgccggtgacgtggcgcgtgacggggagtcagacggcacggcggacgaatcgcaggactcgtcagcgatggtgcaggatgcatcgtccggctcatcccggacggaggtgaccgtttcgagccgtcagcctgatgactcggagaggagcgcttcatgagccgtctcgttccggcgcccgacgcattggtgggatcacgattcgacgtggcggtttccaagatgctgggcatctcgcgtgccaaggcggcggatcttatcgaatccggccaagcccgcgtgctggatcgtgcgatcgccaagtcgggcacgctgctgtatggggagaccgtcgaattcgacatcgccgaagaacggcatgagccggaaccggtgtgtctcgacatggccatcgcgtatgaggatgacgatgtcgtcgtggtcgacaagcccgtgggcgtcgctgcacatgcttcagccggatggacaggccccaccgtattgggcagcctgctcaaacgcggcgtgcgcatcacctcatacggagctcccgggcggcagggcatcgtgtcgcggttggatgtgggcacgtccggcctgatgctggtgtgcaagtcagagctggcgtacaaggagatgcggcggcagttctccgagcatgaggtggtcaagacctatcatgcgatggcccagggcaacctcaaggaggacaaggccaccatcgaagcacccatcggccgcgccaaggtgtcggacttccgcttctgcgtcacgccgtcgggcaagccggcggtcacgcattgggacgtgctggaccgattcggcgaggcgacgctggtttcggtgaatctcgaaaccggacgcacgcatcagattcgcgtgcatttctcttcgatcgggcatcctctggtcggagacccgatgtatggggccaatccggtgctggccggggagctcggcctggaccgtcagtggttgcatgcgatgaagctggagtttcgccacccccgcacccatctctggacgtcggtcgaatcccactacccggccgatcttgcccatgcactggaacttatgcgcgccaggcatgcctcaactggtctggaagccgccgactagcgtacccaatcggcctgtcgcgtagcgctgtcatcctactgtcgcccccgctggcggggggggctgtcgcgtagcgactgggggtggtccaacgccaattcgcgcccccgctgttcttacttatcgcgtttcttccatgcaacgacggaagtgaccacgccggccgccagcagcggtacgcaggccaacgccgcgacgccttcaaccagcagcaggatggcgtctgcaggattgtagacgccgcgattgagatacatataacatgcgattgcggccagtaccgatactgtgccggccgccagcagcgcaaagccgagcgtgcgcaaggcatcatgcgatgaggagcaatattgggccgatgccgcagtcggcatgggcggcgcggactgcacggtgaccggcggcgaatcctcatagtgtggctgatttgcggacgtcattgttcctcctggtggttcgttgccgcgaattgtctggcgacggcggatcatccttgatggcaatctatgcgacggagacactctttgtccagcggaacggacaatgtggtcgaaggctgccgagttatccacattttgggcgtgtcgcgccggattcgattcagcttccgcgagttacatgtggcattttcgcagtgtttactgatggtcgtcattcgctgccatacatgtccctcctgtacaatgaccgtgtcatgcatgatgagacaaggagtgagtatgtatacctcgttggacaggttccgcatcaagccgggcaaagaggatttggcccgcgaatggttccgatatctgaacgatcacttggccgaagcgaatgcgacgatgccggctgagggcgcgcatatcgagtcatggttcctgcacgaggaatcggacggactgtacggatacgtgtacgtgatctacgacgacaatgataaggctgtcgaagtgttcaaggagagtgagaatccgttggacatcaagcacaacgagtacatgaacgcctgcatcgactaccacgactacgccaagatgaagcctgccgtggcgctgggcgactactccgtattccggagatgattggtcgacggttcgtcgacgccgttgtgtttgcagactcgtttgtacaacttatgcatttcggtcaaatgcataagttgtacaaacgatttccctagagaccctacttgccttgctgcgtttcgttggaattccagcgttttcgggaatacccgtggctcgcggcaacgggtgtgtgtgctgtttcccgcgattatgcgggacaacgtccgcattatggcatttcgcgggcgttgtacacgcggcattgcactcgggtcggaaacgcatggagcaagttcttccgcctcgccgccggggcggaagaaccatatgcactgagacatgtcgcccgaggaataatgcagaggacgctccgccagcgcacaatcagttcttgtgcagtttggcgttgagctcaatccccgtcttccggtagcgggcctcaatgcggccgttgacggagttgcggatgaagaggatgttgtctttgccgctcagatcggcgcccttgacgacgtccagcggttcgccggcggcggctttggccttgtcccagacggtgatcttggtaccggcggtgacgtacaggcctgcttcgacgacgcagttgtcgccgagcgagatgccgatgccggcgttggcgccgagcagggagtgctcgccgatggagttgcggagcttgccgccgccggacagggtgcccatgatggaggcgccgccgccgatgtcggagccgttgccgacgacgacgccttgcgagacacggccttcgaccattgagacgcccaaagttcccgcgttgaagttgacgaagccggcgtgcatgacggtggtgccttcggacaggtgggcgccgagacgcacgcggtcggcgtcgccgatgcgcacgccggaggggaccacgtagtcgatcatgcgtgggaacttgtcgattgacagcacgttgacggtggcggcgggagcggcggccggaagcccggcggaggcggcgaaggagcgcgcggcgctggtggcggccgcttcgacgtcgagcttgcgggcgttgaagtcttcgaccgcgaacgggccgtaattggtccagaccacgttcgtgagcttggcgaagatgccgtcgaggttgagggtgttcggctgggcgaggcgcatggagagcaggtgcaggcgcaggtaggcgtcggccgcatccgcgatcgggtcgtcaagggagcttacggtgaacaccggttcgcggcgcacgccacgggcgtcggcctgcggctgcgccagcgccccgaactcgtggttggggcggttcgcgccttcgggcgcggcgccgagcgtcagttgcggataccagacgtcgagtgtgttcccggctgcatcgatgctggccagtccccagccccatgcggtgcgttcgttcgtcatgcttgtctccttggtggatgaacggtagatgcttctatattatgggcagatgggcacgtatgaggctgccgttccgaatcattgtggcgcggtttcgtcacgggagaaaatctagcggggcggctacgatgaaaagctatgagtgactacaggaccgaacgggagcagcgtgagcgccgccgccgcatcatcatgcgtgcggtgtgcatcgtcattgccgtggccatgctcggcagcctggtcattcccgcggtgtatgcgggtctttgacgcgatcattggcgtcctgccgtgacgcgaggtgcttgagatttcgcatatggtcggcagcgtcgtcacacaatcgattcgttcacaagttcaatgattatggtggtattcgatggcagaatttgatttttcacaggcaatcggcgaggcacggtcgaagtatgagtccattgcgaaggcgttggacatcgaacggctgaagtcgcagatcgcgacgttggagaccgaggccgctaagcctggtctgtgggacgatcctgagaacgcgcagaaggtgaccagccgcctgtccgcggctcaggcgcagctgaagcgcctgaacgaggcgaaccgtcgcatcgaggatgtcgagacgctggtggagctcgctcaggaggaggctgacgccgattctctgagcgaggctcagtccgagatcggctccatcgcccaggagctggatgacatggagatccagacgatcgtgcaccagatgctgcgccgcgtcaccgtgatcgattccggtgacaccccgctgctgcctggcgagctcgtcgaccaggcgcgcttcaaggccgccaacaaggagaccatcaagaacggtggcaagccggccgccgctcgtccggagctcatgggcatcaccaaggcctcgctggcaaccgactcgtggctgtccgccgcctccttccaggagacgacgcgcgtgctcaccgaagccgccctgagccagaaggtcgatgacctcaagggcctcaaggagaacgtcatcatcggtaagctcatcccggccggtactggcctcgcccgctaccagaacgccgtggtggagcccgacaaggccatccgtgacacgatctacccgaacttcgggctgggcgcggacatggacggctcgcagaccgacttctccgatgccgacctgtccgatgtggacttctccaacatcgacttcggtgacctgaagctcggcgacgacttcaatcctgacgatttcatcgatgatcagggcgggaacgacttcggcgccgactccggcaacgatctcgtctgagtcctagctctgtcctagctctgtgaaagcggggcccggaaccattgcggtggttccgggccccgctttgtcatatgcgaagcgcgggaatgtctacgggagaatgcatagacgcgaaatactctgtgaaacatcccgtgaaacattctgggtgcgtatcgtcgaatcgattgcatccggtcagagtcccgttttccgtcgttggatgggactctcgccggatggtatttcacatgatggacagtgcaatgtcgctactggcgctcggtgagttggaagaactggtctccgatacgcagcgtggcgggggcgtcgagttcgcgcggcttgcccttgagcacctgcgcttcctgcccgtcgcggatgatgtaggtgccgttgagggaaccgtagtcctcgatccacagcgtgccgttctgatcgatgctgatcgcggcatgattgcgcgatgtggtacgcgtcggatcctcgaccttctcggccttggcgccttcgggcacgtccatggacggcttgcgtccgagcagcgtgctcttgtcgatgacgatggtctggccggtggcgtcgttgtgcaggatgtatatcttccgcggcgccttggcggtgaaggacgacgacagcaccgtgctgtcccagtcctcgatatcgccgtcggacgagcccttggccgcatggctggcggtggaggatgagacgggggatggttccgccgctgcggaagagactgcggcaggcttgtctaccggatcgtctgcgtaccagcccagctcgggtgccgggggatagggaatcgttgccatgtcagcggctcctttcactgacgtgtggcgagggcggcgttgaccgcggggtcgttcagctgggcgagccagtcgaccagtgccgggtaggtgctggggttacgcgcgatgcaggggcgcaattccggcgcgtactgcgcgatcttggcgatgagctcctgatctgtggtctccagcgccatctgagccgtgtacccgtatggattggtggcttggggctcctgctgcgccgcgtactgcgccgccgtgtactggtcctgtgacggctgctgctgcgcggccgatgccgcatacgaatctgcggaatattggtccgcgctgtacgaatctgcggaatactggtccgcagcggcggaagcagcggcggagtcggcggcgacatcctgcgccggctgcgcgtcggccacggggccgtcctcggcggtgacgcccatctgtgcaagcgtctgccgcgcgcgctcatcgccgaacgttgccagccaacgcttcaatcccggatagcagcgcgggttcactgccacattagcgccgaattccgggttttcataggcgattttcgccagcaagaccggatcggcattgggatcctgcactgttgcgacggccttgtcataatcaaccatcgtgacctctttccttgatgttcagatttggttggccggtttctggatgcgtatggtgtcaagcgtctcgtcactgaccgtttcgagatcctcctgctgcgcgagcctactggcatgccacaccttctgcccagcatactcgcccgttatgtccagaacaattacggtgacattatccgtaccgcccgcttccagagcgatgcggatcagttcgtcgacggcggtctgcgggtccgcgcatgccgcagcagtggcggcgatggcggcgtcatcgacttcgccgtgcaggccgtccgagcagatgatgaacctgccggtcggtcggaccgcgaagaagtccgggttgatgccgtccgggtcgccgatgcactgggtgatgatgttgcgcgggatgatgacggcatcttccggcagcatctcaccggagtcgatggcctcctgacggcgggagtggtcgcgcgtgatgcgacacagcgtggaggcgtcccactggccgtcgctgtcggcatccatatgatatgtgcgcgagtcgccgatattgatgacgtaccagtccatgtcggggttgatgtcgagcgccacatcgccgggcgcgtcccgttcgattcgccctggcgcgatcagtccggtcaccgtggtgccggacacgccaccgagctcctggccgatggcgagcacgtcggcctgggcgaggtcgatcgtacgcccgatggtcgtgcggctccggctgaaacgtgacgccagtgtctcgaaacgatccaccgcggcgctgctggcccgttgcccgccgacgccgccgcccatgccgtcacagacgaggaacacgccgtcgtcgatgatgaacgaatcctgattggcgcgtcgcctcaggccgatgttgctgtccgctgccacgtgaatttgcatgtcgttcatgactgtcggcctttctgtgaggagggttgccgtgcggatggttgttgcgtggcgggcttctggccagcgggctgttgcgtggaggatttccgcttgacgggccgctgtttggcgggttgccgcccgtctggcttcctcttgtctccgtgccgccatgtacgaatacttgacagtatacgaacgttatggaaaactccgcgcaatgacaggcgggttcgcagcctgcgcatgaaggactgcgaggcgagcatgagcttgcgggtcgtcagtacggaacgccagtaggcgcttgcctgttcgggcgtgaccggctggccggagaacgccgcgtaatcggcttgttgtcccagcgcaatcagtggggcaccgtcgatgttgagctgccgtgcgatggcctgcgcctggtcgcggcgcgtgccggtgacgggtatgccgctctgcccggcgagcgcgtgcacggcctgccagccggaggtgatgcgctgccgcgcgtcgccgtgccggcgcaggcgggccagggcgacggtcttgagtgcgaggatcagcagacagatcagcagcggtatccataccgggctgccgtagatggcgactttcgccgcgatgcgtccgatggtgctccagatggatgccgccggctcatcggtggcatcctcgccggccagcgccgatttgccgtgtgcctgctcctcgtcgcgcagcgggtcggtgagcggcacgggaggctgtcggaccagcgtctgcgggttgggtggggtgaggttctggttgtcgtcgggtatcttcgtctctttaggcgtcggatagaacgcgacccagccgtagccttcgagattgatctccacccatgcttcgatgtcgttgccggtgaatttgacggtcgaggtgccgttgaccgtttcggtgcggtcgttgctgatgtcgccgtcgtcgttcttgggcaggaagcccatgaccacgcgggatggcaggccgagttcgcgggccatcagcgccatggcggaggcatactgctcgctgtcgccgaccatcgcggatccagcgagcagcgcgttgatgcgatagctgccatgtccgggcagcgacggatagtcgccggtcaggccgtgcgagaaccaaccagaatccttgagctgcgcgaccagcgcctgcgcctgcgcgccggccgtgtcctcgccgcccgccaccgacgaggcgaacttgcccactgagtcaggcacgtccttggtgcccggctggttggtgaccgccgcgttggccttggtgatctccttgtcggtgggtgtgggggcgatgatgccgctttccgtataggtcatgccggtggacagcccggccgggatgatggccgactgcgtgctctcgttgtagtagaagagcgtgtggtcggcggaggatcgggattcgccgccgccgtttccgttggcgccaccggtctttcccgctgacgtgacgtcgacgctgctcgccgctcctgccagcggcagccatttgtcgctcagacccttgtcgatggtgaacgtggcggtgaacttcttgccgtccaccgtattggggatgcgggtgccgacgcgtcggtagtcggatgagtccgaggcttcggtggagtcggacaggttccacacgttgccgtcgaactggtccatcaccgcgagcctgaccggcgtgccctcgggcagattcgtgaccgtgagcagcgtgtcatccttgtggtccttgacgtaggagcgcaggccgctgagcgggcttgcgtaatcgtacgggctgagcggcggatcgtagtagtcgcgcaggatcagacgtgactgcccgatgcccatgcatgcgcccacgcccaggccggccgccagcagcaggatgatcgtggcgctgatccagcgtcccagttccagaagttgccatcgccacgacagccagacgatcatgatgaggccgatgagaacgccggaggctatgggctggaaaccggtctgcgtgcccaacagggcgcagaccaccagttcgatggcgatcggcagcaggctcagcacgctgagctgccgtttgtcgccgatggcgaacacgccggcgaggaatgacagccataggcatatcgtccatgccgccatcaggctgccatcgccggaaccggtcggcggcggtacggcgataaggtatttgaacgcgccgaaggtgctgacgaacccctgtgacagcgtttccacagagggaatcacatggctgatggcggtgtcgttcagcgcgatgaccgggccgatgacgccctgcgcaacgatcaggaacacgatctgccaccacaggcgcagcgcgggtgcggtccctgcataggcgatgagggcgccgagcagggtggccggtacagcggcgacggcccacatggcggctgatccgtacacgtcgagaagattggatgcggcaatcagcgacgtcagcgcgatgacggccacgctgatgaggttcgtgccccaggagcggcgtccgacgcgggcgagcggcagacggttgccgccgcgtgtcagccagatcactgaatgggtggattccgcccatgagccggtggtggtgcccgtgccggtcacggtcgagccgagaccggagaacggacgcctggtctgcccgacctggccgggcagggcgtccacggctgacgtggcggagtccgagccgagtgagctgtcgatcacatcgttcatgcgagcacctccatgatgagcggcaggtcgtcaagcgagccgacggtggccagcgtgaagtccgtgaaatgcttgattgcgcgcacgtcgcccggcgaggtctgcagcacgaggcacgtggcggatttcggcagcgcgagcaccatgcgcttgatatggtcgagctgcttgagcgagccgacggtgaagaagtagaacgagctgtcgggcgagtgtcgcagcgtgctctccaccagattcgggttgtcgtcggtccgcggggtgatggcgctgcaatcgtccaggaaccccatcgggaatttcggcgtgtcatgcgcgctgccggcatgcgtctgcagcggacggtcctgtttgaggcactgcacgcccagcgaggcgtgcacgctcacggccatctcgaactcctcttgactgacgtaatcctgcgggttcacgtcgagcgtcatactcgtgtcggtccgccgcgtcgcctcgtactggcggatcatcagcgtgccggtcttcgccgagctgagccagtgcacgttgcgcacgtcgtcgcccggctcgtattcgcgcagcccgtagaagtcgaggtcgtcgtcgacgatctgaccgctgggctggccttccagatcccgtgcgacgccggcgttgagcgtgttgagccgcacgatgttcggatggatatagacggtgatgcgttcggccagcgccttctcgtggcgcaccagcccgaacgggtctcccttgcggatgttcaacggtccgacggtcaggacggcgcgggagacggtggtgaactcgatatcggtctgcttggactggcccggcgccagcatggggatgccgaaccgctcgtgagcctcgcccaacggcaggtcgccgcgtgcggtcgtggtgagggtgcgcccgggattgtcgatgtccacggtcacatggacgtcgtcgccgacggtgacgcggcggcgcgacacggcgatggacgccttgaacccggtattgccaagcgagagcacgatggcgcagaggatcatcatcagcgccaccgcggcgatggcgagcagctcatgccagcgaaccaacgggaatccggccgcgcatacgatgccgatgacgaccacggtccagcccagtggggatatgaacgaggtgaagaatcgcctgaccgcgcgcttgcagcggcgccacaggcgtgccgagctaagccgtcgcctgtgacgcgccgacttgcccgatgcctgttggtctcgctcgttccgtggtttcggcttgcgcggtttccgcggcttctgcggccttgcttcggatgatgaactgtcgttgtgcctgcgcatggaacgcctttcacgcgccgagcgacggcgccggcacggtctccagcatccggctgatggcctcgtccgtcgtcagaccggcgaaggtggcttcggcggtgagcttgatgcggtgcgacagcacggcgaccgccagatccttgacatcgtccggcaccacgtatccgcgcccgtcggaggccgcccagatgcgcgcgcagcgggtcagcgccaacgcgcctcgcatggacgagccgatggcgatgttctcgtcatgacgggtcgcctcgacgatgcgcacgatgtattcgaggatgttgtcgtcgatgtggatgcgctctccgatgccgcgcagcgcgaggatgtcatcgccggcaagcacgggggagacggtctgcgcgcggtcgcggatgttgacctgccgcaggaggtcgacgcttacctgatggccggggtacccgaccgacgtcttgatgaggaaacggtccatctgggcttcgggcagcttgtatgtgccgagctgttcgatcgggttctgcgtggcgatcacgatgaacggctgcggcacgtcgtgtgtgacgccgtccacggtgaccttctgttcctccatgacctccagcagtgcggactgggtcttcggcgaggctcggttgatctcgtcggcgagcacgatggacgcgaacaccgggccctcgcggaactcgaactcgccgtgcttctggtcgtagaaggtgatgccgaccacgtcggacggcagcaggtcgggcgtgaactggatgcgcttgaacgacgcgctgatcgagctcgcgatgcctcgtgccagctgagtcttgccggtgcctgggttgtcttcgagcaggacatggccaccgacgagcagggcggtcaggcatagacggatcggatgtgccttgccgaccacgacggtggagacgttcgcgagcagcgcgtcgaacgcctgcttgaagtaggcgatgtcgtcggcgctggccggggtctgcgggttggtgttcgcggcggccgggttcgcggtcactgggcgcgcggctgccgccacgggagtattcgcggttctggctttgggaaaggcgacgttcggaatcttggccgcgggtgcggtggtcgggtactgtatggagctcagctgcgtcgcatcgagatcgacgccggtcttggtcgggccgttgttcgtggtgttgtcgccggtgtcactgacgggcgagacggcctcgccgtccgtcttgttctgcaccggggactgcgccgacttgttctgtacgctcttggcttgtgacggcttggcttgtgccgactttttgcctcggattgccttgccggcagcagcacctccgcggcgcttcggcaacgtaggaatggccacggtcggtgccccctgcgacttgtcggcctcaccaaccgcggcaccgcccctggcatgcggtgtctcggaaatcacggtgccgtcggacaacaccgtctcatcggagacctcagtcccatcgccgctcgctgatgagatggaccgcgctactgtgctcttttccgcgttgccttccgcggtgtcgtttttctcggctgcgttttccccggcactgtttttcactgtgctcggtgcggctgcattcgtcgtggcctcggcggactgagccgtgttgccggacgacaggacggtcttgtccgacaacaccgtcctgtcggacagttgcgtggcgtcgtcgagttcgttgctctcgctcatcgtgatactccttgatgtgtgtggtggacggtgttgtcgtatcggttgatggatggttgataaatcatggtcggtttgaggccagtgtgctgatggatggcatggaaccgaacgaccggcgtcggatgcggctcgggtctacgccttccgtgaccgttccggatccctctgccggtttgcgcattccttggacttccctgatgtcgtcggcggtgttcagtgcggagtcggcaccggtcacgctgatgtaccaatacagcttttccgtgtcgatcctgaacgatgagatatcgatgtacccttgcttcgaagctgtgctccatgtgacgttccaatcactttcaccggtcggcttgccgctggtagtggagaacgcgacaaggaccgttgccggctgaccgtagaggttcacgctgccgccggacaccgtgatgcggttacggtctgtcgtgctccacgccagcgtaggcggttcgatcttcgctggggtcttgtatacaaggcccttaccgtcaaatatgatggcttcgctggagtgccccttgaacgactgcgtagctgatacagtgccgcaggtttcccacgggttgatgcggtaagttgcggcggctgaatcgccgttgcctctgtactcctgaccgttggcgaaaatggagagtccgtcatgctcgccattaccgccaactgacacggagcactcgttacctttgagcgtcacctgcaggtttttcggaggctgtatcttgtactgcggcgtcaccttgttcgagtcagccgaagctggtttggcgccgctttgctgcgggttcacggtcgccttgacactgagctcctcataccactgatcgcggctgatcgtatcggtgaaggtgtgggtgccgcagggggacgacatggagattgcgccgctcagttccacgctggaacatcccgcgttgtgcatgttgccgagcgtcaacgtggccttcaatgtattgccctttattaccgataggctgaccgtcggcgcgtccgggtcgccccagggcgtcgccgcgttgctggcggcactgggctggccttcgccggcacggttctttcctttgacggtggcggtgtatgaggtgccatcgccggtggcgctgttgtcgattgggaacactagggaattgccggaggtctccttggtgacggaaccgccgcccgaaccggtcagcgtcaccgtgtagctgtccggcttcgtaccgacataatccggaacatcccacttgaccgtcacacgctggtagccggcctcggtggtgaccttcttcggtggatcgggcaccttgtcgggcatggctttgaccgaggtagacggcttcgaccagccgacctcgttcttcgccttgacggtgaacgagtattccttgccgttggtcagcccggtgatctggcaggtggtgaccgcgccgcacgacttgctgccgccgtcccaatcgacctcgtagtcggtgatcgggctgccgttggccgcgcctgcggtccacgagaggttcaccgaaccgtcagccggctgcccggagacaggggagagcagcggcgcgccgggcttgtccaccacggagacggtgatggtggcggtcacctgtcggtcgcgcgaacgggtgccgtcctgcacggtgacgagcacggtgttcgaggatgcgccgatatcggttccggcggtgatgctgatgttgccgttcgaagagcagttcacggtcagcttcgccgaatcgtcggacttgcagctgacggcggtcagcgacgaatccgggaacggattgtaggcgtcggagaacaggtccacccgttcggtcgaaccggccttgagcttcaccgtcttcgcgccgatacgggcaagcgggcggttcgactgcaccacgcgggcggtcatgccggccttgaccgtgccgcccgaatagatgatggtcacggggatgctggccagcgatcccacggtagcgtccttgggggcgctgacggtcaactggccggaggcgctgacgcgcgcggtgatgccgcccgattcgctgccgccggaatatgtgtactgcttctcatcttcgtatgtgccagcgggggagtgggtcagcgcggtcaggtcgatgatcttcgcatcctcacctgccaccacgtcgatcgtggacgacgagaaggtcggcggtggcacttcgcggccgatgaccgtgatcggcagggtcagcactgcggagttgatgatctgcgtcttgtcgttgcccttgccgtccgccgcggtgaacgtgatcgaggcgggaccgctgtaatccttcggcgcggtgaatttcagcgtcgtgtcgttcacgtagaggtcgccgccatccgatttggtggcgctgaccgattcgggggactgcacgtaagcggtcttgccggcgcccacacgcacatagtcggcgatgttgatggtgatggtctcgcgcgagttcaccttcagcggcggcgccttcggacgcagcgtcggcgggaacacgccgtatgcgggcacttggatgaacgcggtggaggtgatgccgtacgtcgtgttcgttaccgtgtacggcaccgaacgggcctcgtcggtcagatccacggagatgacggtcgacttctcgccgcccttgaccttcgcgtggtcggtggcggacgggtcgacgccgaccttcagttcgttcgcggtgccggacgggttggcgatccactgcgagacatcgacctcgacggtccgcttgtcgatggtcgcggcggatggtacgcggtagtcataggcggtgggcggctcgatggtcgcattcgggtcgacgttgaccgtcaacgtcgcggtgtcgctcaggccggccttatcggcgaccgtgtgcatgatgtagaacgttcccgcctggtcgggcgtggtgaacgagatcatgttgtccttcacgctcgccccggagataccctgtgactccagtttcttcgaaacggtcagatcggtgttgtccccggaaatgtcgttgagcgtcaccggcaccgtggccgccgtgtgcgggcgcagcgtgatctcgtcgtcccgcgcgtacacgccggagtcggacgcgccctggaacacgcccaccctgacctgtgcctgtgcgcgctggccggtccaatcctccaccgcgtaggagaacgtgtcggtgcctgacgagtcctcgtacgcctcgtagatcatgtagttcgcgccgacctcggtgatgcgtcccagttgcggggccttgttgcccaggccgagcagctggtcgtcgtcgccgtccacgtcgatgccggtcagtgtaattggtatgcgcactttctgacccgcggccacctgcgcctcgacgtcctgcggagtgggggcggccttgttcttggcgtccttctgatgcacggtgatggtgattgtgccggaggccgagttgccgagattgtccttgacggtgtaggtcaccgggaacacgcccgtctgtttggaagcctgataacgcacggtgtcgccggaaacgaacaccagtcccttgaacgtgtccttgtcgtactgcagcttctgctgcagcgtcaccgtggtgccgtcggaatgcgagacatggtcgagcacgttcaccgacacgatgccgtcggtgcgcacctgcgtgttgacgttcgacgccttgggcgcggagttgccggcggtcagtgccggcggctgcagcactatcgtgccggtggatgagccggccgcgttggcgacggtgtacgtgatctccacgggcttggtcggcacctgccgtgcggtcagatacacgcgcttgtggctcaccaggccggtcttgatgcccagcgacgggtcggcatcgaccgacgtgaccgacagcacgccgcccatcggatccacgtcgttggcgagcggttcgacgatggcggtgttgttcgaaccgagcagcgccacatcgttggctgcgactggcttggcggatttgcccgcggccggctgcacctcaagacgtgcgaggccggtggacgggatggagccttgggtgacggtgtaaggcacgtaatacgtgcccgtggcggtggccttgaatgtgaaggacaggtccgccgcgttcatggtcgcgctggttttcgcgggcggttccacggtggacagctgcgcgggctgcgccgatgtgccatgcacgtacggcttgaggttgaccgtggtctcggtgttcggtgtggtctgcttgaccacggcgtcgatggtcgccggcagcgtgtttgccgggcggatggagaagtacacgagtccggtgccggtgttctgcccgtcggagacggtgacctgcacgcccacttgccccgaggtggcggaaccggtgttgaacacgagctgcccgtctgcgcgggtggagacgacgacctggtcgctgttctgcgggaccgccgacaccaatgtcatcggatcgccgtcgggatcctggaaactgccgagtgcgttcgtcgtgtacgtggcaccctgctccacgtcgtattcgggcggcgtgtcggcctgcttgggagcgtgattggcggacgagccggtcagcgtgaccgtcaccttggccgtcgaggtctggccgcgcccgtcgctgatgtcataggtgaacgtcaccgtgccggccgaggccgccgaggcgtccagctgcaggtaccggccgtcgtacaccggcgatacggtcatatcgccgcccgccggggccccgactttggtgatctgcagcacggagcagtctgtctgctcgtcgttgcgcagcacgtcgaggatctgttgtccgcccgcgcgggcgccgatctcgtcgtcctgcgccttgatctgcccggattgcgcggaacaggtcttgttgaagttgcgctggttgttggcggactggtcgttctgcttctgctgggcggtctgctcggtctggatggtgttccactgtatcttgatgaccttggtggagtccgaagggttccacacgttgccgtcgaccacgtcgttgagtacggtcaggcggtggttggtgcggaacaccaaatccgacgtggtgctgaccgattgcagcgagccgaattccgggttgctgacgttcggcgagcatacacgcacgtaattgttcgcgctttgcgcccacgcggccgacacgcagccgtcggtggagaccggtttggctgcgtctccggcaccgccggaggtgagcgtgttgactttcttctctcccttgcccagttcgaccaggtacaggccgttcttgccggcggccgcgacccaggactcctgacggccgtccgtgtcggggtactgcagcgtcaacgggctgttggcgccggtgtcggcgctgcccttgtgccagtacagtctgccctcggatgtgacgaccgcggtgccgtccaccacggtgaaatcgtcggcggatacggtcttcccttcggtgagggagctaccctgcacggccttgcctgtcggatcctgcatcgtgagcacggtaccgtcggagggccggtatccgtacacggtgccgtcatgggtgaccgcgatcttgcctccggtgcccagccgcatggacgggtcgctggtggcggggttgacggaattgaggtcggagctgcgaccgacccacacgttgccgtttttcgtgttcaggaaggcgatggtgccgccgccggtcaccgcggtcgtgtctcccttggtctccgtcctgccggtggtacccagcgtggcggaggagatgccggtggccttcgcgccttcggtgagcaccgtgtcgctgtcgtgctggacgatgtcgaaacgggctgcagacgaggccaccgccgaatccggttccttgagcttgacgttgaagcgggccgccttgcggttcttgagcgaggtgacccaaacggtgccgtcgtcgagatgcacgtgttggcgggtgatggagctcacccagatggcgccggcgatgatgccgatcagcatgacgagcgcgatgacgggcatcgcccaacggtgcgcgtcaggcgagaccaggcggcgcatggaggagcggaacgcccgctcgcgttggcgctggttaggctgcttgctcatggcatcctcttctctctcgtttgctcgcttctcgtgcaatgccgtgccgcatggtgcagtccttcatatagtgcgttcctattgcctcaccgcgcatgcgatggccggatcctgggacatctgcttgtcgctgcgcacgatcttcacttcgatgcaggtctgtttgtcggtcacgtcatgcagctcgactttgcggtcggccacgatgttggtgctggtactggggccggaagtggcagaattgccctgtaccggcgaccatgcgtacatgtcgccgtccttgggctgcgggttcgtccaggtgaacgtgacggtggtgccgtcgtaggttccgttcaggttttcgagcgtcggcaccacttcggctcccgtgatgtcgtcgggattgccgtccgttccgttggagtcgccggtggcgcccggcgtggagaccgatgtgcggttgcgcgtcgcggtgtcatccatgtgcggcattacgacgaagacgaacgtcaggacgaccgccgtcagcgcagccacgaccacggccgtgatggacagcggcttcttccacgcaccggtgggagcgtccattcgcgtcacgttcgcggggccgggcgcgacgcggcgcttgccggtcatgctgctgggatattcggggacgccttccacggtgacgggcgtggcatggccgtagtaagcctgttgcacctgctgcatcgcgcgggcgaattccagcgccgtgccgtaacggttgtccgggttcttgtcgagccccctgacgagtacacgttcgacgtccgcgggcacatcagggcggccgattggcggcaggcggcgactgacgatgacctgcgcgagttcctgctgcgtatgcgcctgataaccatgctcatacggcgaacggccggtcagtgtggcgtacagggtcgccgccaaggagtagatgtcggcggcttcggtgccgccgctgcgtccggtcagcacttccggcgcggcccatggcacggagaaaccggtctgggttcccgcctgatacacattcgtggagatgccgaaatcggcgagcaccggcagtccctgcggggtgatgaggatgttcgcgggcttgatgtcgcggtgcaggatgcctttgcagtgcgcggtgaacagggcgctgcaaagtttgatgcccaggtcgagcatctggtcggcggtgagtggtcgcttgcggatcagctccttataggagccgccgggcgcgtattccagcacgatgtagccaagtccggtgctggtcacgccggcgtcgtggatggaaaggatgtaggggtgcgcggaaagctccgccatgtagttcgcctcattgcggaatcgggcggctgcgcgggggtcgagggtggcgctgctgaccttgatggcgacgtcgcggctggggacgcgctgatggtaccggtatacgctggctgtggcgccggtgccgagtggctggatgaaatcatagccggatatccgcggcggtgttggctgtgccggcatttggctatccccccttacgacatctcttcttcttactctattccgaggtgttcccacgcacaacccttgatggggagcgctgaggagtgctcgccgcaggcaggagctgccgtgcgatgacgcagttagtccagaataaaactgatataaaaaacggaacatatggttcggttttcgattgttggcatatgatggaggaactgtctgacggacgacggggccggcgacgggaatggaggtgccatgaaggcggttgaagcactgcttgagggggaatccggcaaggcgctgctggtggttggtgctccttgcgtgggcaagagcacgctggcccgtgatgccttgatggccgggctgcgacggttcggcgaatccggagcgataatgacggtatccgggcgtcagatcgccgatgtgataggcgatcaggtgattcgcgagctgggggcgacctcccaggcgcgaccggtcacgacgctgtcggccatcgcgttccggctgatcaccgtcatgcgttcgaggtcgggcgagccgctgccgaggttgctgaacggcgccgagcaggatgcgctgctgcgttcggtgtgctccgtccatgtggctcatgtgcgggcgggggatccatgcggcacgtgctcgttgctgcgcgaatactacgccagggatgattgggacggcgtgctggccgatgccgtggccgggaacgacggcgagggtggtgatgcggattccggcgtaggcgtcaatgccgccttcgtcatgcagctgcgcgacatgttggcccgcatggatgagctgggcgtctccgaggatcgtgaaggaacggccctgtcggcgttgaggcattggtcgccgcgcgtcgagcgtttgcatgtgcagtggcgtctcgcgttcgcgttgcgccgcgaatacgagaccgcggtgagtcgtatgtacccgggcgagtatcggttggactcgtcgcgtctgctggtcgagggggccaaggcggtcgggatggtcggcgatgacgatctgccgcgtctgctggtcgtcgatgactgtcaggacctcaccttcgccgggttcacgttcctgaaggcgctgcgcggtgcggggacgcggctgctgctggtcggcaatccggacgaggccgtgcagacattccgcgggtcatatccggaatacctgttcgaccagattcgtcgtcagcttggcgccgacatggttcgtctgccggctggcggtgccggaaatggccgagttgaggagcgtgcggtggaccacgtcgacggtcatacgtatcgcgatctggtcgcatcccgtatctccctgtccatccgatccacgcaggacgagacggttcctctgccgcagaggccgggcaaattgccgcagctgccggcgagtctgccgattgtcgcattgccccaggccgatccgctgccgggcgatggcagtctgaaaaccgcgctgtaccgctcggccgacgaagagacggaagacgtcgtatggcgcatcaagcaagcccacatccttgaaggacgcaactggaacgacatggctgtcatcgcgcacgacaacgccaccgtgcgcacgatcggcgaacggctgcgtcatgacggcgtgcctgtacggtattcatcggtcacacgaccgttgaaggacgagccgttcgtgcagggattgttcgcgctgctcgaattggcgatgctcaggaaccagacggtgcccgcgctgggcatgaatctgcagcagaccgcactgtatgtgcgctctcgggttgccacggtgatgggatgcccgctggtcagcgtcggcggcggacgggatcatgagggatacccggccaggctggagccggtggacgccgccatgaacgcgttggcatcactcggcaagatcgtcacgtgcgaggacatatgcaagggggatgcgtccgacgatgtgcctggcggtgccgccgacgatgcggggaagaccggggacgctggaattgctggtgacaccgctcgaatgcatgccttgggcaggctcatgcacggatgggagcaatggcgcgaatgggccgtctccgggcgcgatcggaagaccatcaccgacgacacgatcatcgatgtcaaagcaccgcaaggcgacgaactccagttcggcgtcgatgccatgtacctgttgctggaattcgcggatgacgcgcatgcgatgcatggcggtgtcgccggtctaggcggtacaggtgacgttgtcgacgatgccggttccgctgtcggggcgggcacgaagggcgcgtccggtataaccgccgatgacgtgctcgccgccgttcaggaggtgtgcgggcggggagacccgcattcccgcgtgtttgcccacctgtggaatctggtggggacggtggcccaaggcctgagacaactgccggcgaaggaaccacagtatgcgttgtccgtggcttggaacgcgtgcgacgtcgcctcccgttggcagcgcgaggccctgaacaacacggatgccggacgtgccgccaacgaccgtctggatacggccatgcggctgttcgactatgcatccggctcggccgcaagccgggatctgcccgaattctttgcgcaggtgagggcgatgcgcatcgaagcggattccctggccaaagtggcccccatcgacgaggccgtgacgctgaccacgccggcgggctcctcggggagacactggccgttggtgtggattccggccatccagcaaggcatatggccgaacctggcagcccgaaacacgatgttcggtggtgaggatctggctgatgtcatgctgtatggaggactgtccgatgattccggagagcatggcgacaacaaactggaatccgtgctgtatgcggagcagaaaagcctgctggtcgcgctgacccgcgcatcggagcaggtcacggcaagtgcggtgtacaacgacgatctgaccccgtctgacttcctgtacggatacataccggaacgattcaaccgcgaacggcatgcgtcggccgaagggcgggaatatacccaggtcggtgaagccggacggctccaaggtctggacgccgatcctcgcggcctggtcgccgccgcccgcgtggcgctcgccgtacacccacgaggttccaaggaatctcaagatgccgtggatgcgctgcgactgctggcaaacaatggtgtcgaagccgctgacatcacgcgttggccgttcctcgacgaggtcgaggatgcgtcttccggctcccgcacggtgggatcgcgggcggcggctccggaaccggacaaggccgcggagggaaccggccaatcatcggtgccgcggatcgcaacattgtcgccatccgccgtggacagcatctggggatgtcccgtctgttggatgatggaaaaccggttcactggtccgcgcgccggcagtgtggcgacctcgttcggctcgctgatccacgccgtcgccgaaaccgccagcaacgagggcctggacgcggcggactggcgcgatgacctgccgattccggaacgcgtcagcacggtacgggaccgtatgatcgccatctatgaggagctgcgcgacgatccgacggccaacaccaacccggccgatcaatacaacgcgacgcgcaaggacaataccgcgcatgacgtactgggccacatcgccagctacttcgtcatgtccaacaccgacgaatacccggtaaacaacgtcaagaacttccagatcggtacattggaaagcgcacaatgcgagcgttcgttcattgcggtattcagcttggacgacattcttgccgcctataacgcgatggacggcgtcgacccgatcggccgcgatgaactcgccgccatcatgggatcgctggttggcgggtggcccgaagccatgaacgaccggctgaccgtgcgtctgtccgggcgcatcgaccgtatggagaccagaatcatgcccgacgggaagcgtcacgttcgcctgatcgactacaagaccgggaaggtgccttcgaccaaggccatattcaacgatcttcagctggtctgctaccaactgggactcgcattcccggaaaacgggccgcgcggagccgaagcgctgcaagtcatgccggacatcgcgcaaagtggtctgttccatgtcgcacagaaggatgcacccgcgacatccggaaccagcaacgcgcaggagggaatgtaccagccggcgctgttcgccgatggcagtctgaacacgtcatcgttcatgccgcggaaccgctacaagaccctcgataagctttcggatgctcccgatttgattgaagagcctccgaccggtgtaagcgcagcggcatggcgacagttcctcggcatgcgcggcacgcaggccgtatggtcgctctccatgatcgcgagagtgttctacgccgccgcggcgagtcggtcgacccatatacaggcaaggccgaaaccggatcatctccagtattgccgcatgaaagcggcatgcccggcatgcgccggcgaaatcaacaccgtcttcgaaacgaggcagtcatgaacgcaccacgatttaccgacagccccgagcaggcaaaagtcgtcaacgcgcccaccggcgatgacgtgctcgtcgtggccggagcgggcagcggcaagacctatacgatgacccgccgcatcatcaacctcatcgcacagggcgtgccggccgagcgcatcctcggcctcacattcacgcgcaaggccgcgtcggaactgctgtcgcgcgtgtccgccgccgtgctggcggacgggggagacgagcgctttgcgaaccgggcgttcctcaagccggaggtgtcgacgtacgatgcgttcttccagaccatcgtgcggcaatacggcctgcttgtcggcttcgaccagaacacgcagccgctcagccaggccggtgccatacagctggcgaccaccgttgtcggccgtcacatggacatcctcttcgagcaggatctcggggcgttcaagaccgtggtgaatggggtactggggttgtcgcatgccataggcaacgccatgatcggtggcagcacaacaacgatggacgaggccatcggccgtgtgcgggcttgggaccaggcattcctcgcgcaactcgatatcgccattggcgatacgccggttcctgacgaagcgccgaaggccaaggttccgacaaaaaacaagaaggacacggaggagaccttcgcggccaaacaggaggaataccgggcgcaacttcgtgacatatgcgtgtacaagtgtgcacagctgcgcgacgtgacccggcgtcgggagacgctgctgacgctcgtcgaggaatacgagcaggaaaagcgggttcagaacatggcggaattcagcgatttcaccattgccgcctaccagctcgtcgcgcgattcccctccatcggggagcggtaccgtcgccgttacacgcatgtgctgcttgacgaataccaggacacctccaccacgcaggcgatgctcctcgccaccctgttccacccccagtcggctgatgccgatgctgataggtcttcctcccgctggcgggaggcggcgcgcagcgccggagggtggtccaaggatggcgtcgggctgtcgcgatccgcggtgaacgcggtgggagacccgttccagtcgatctatgcgtggcgtggtgccagtcccggagcgttccgcatgttccaaaaggacttcggcatgccctccgacgcgaaaccatacccgctcagcgtcacgcgacgcaacacctgcatcgtgctcagagccgccaacaacctcaccgagccgctgcgcataccgccacggcgggccggcagctccctgatgcgcgaagtggacgtcgcgaacctgtccgcgatggacaacgccgcggaaggtacgatcggcgtgctgggatttgccaccttcggccaggaagccgatgccgtggcacgcttcgccaaacaggccatcgcacggtaccggaaggacgacgccgccacggccgcctccgataccccgcatgtggcggtgctgttccgaggcaagacgcacatggcgcaattcgcccaagaactcgaacgggcgggcctgacgacgttggtcgtcggctactccgcgctgctggagaggccggaggtccaggatctgatcgcattgctgcatgcgaccgccgaccacaccgattcagcgtcgttgatgaggctgctggctacgccgcgattcggtttgggatccgaatcgctcacccgcctcgccggcatggccgaagatctcgacagccaatgccgctaccgtgcactggtcgaatccggcatcataggttcaggttccgatggcgctcgtgccgatgatggtcatgatgaggcaatagtctccacgtccattgattccggtctcgtttcggaagcggatggcggctccgacatcgcgacgttcgccgactcgcaggtgaaggccatcgttaagcaataccgggatcgagtgccgcatgcagtgttcctcatcgacatgatgatgcgggatgacctgccgtcgctgctgtcgcgtcgcggcggattcgacgagacgacatcacgccgtatcatacaggcgggcgaagtactgcagcgtgtgcatgccgtgactaatcacccgctgaaggaagtgattgacgccgcggtgcgggccttgaacctcgacatcgacacaatcgtcgcccaggcggtcaaaaacccctcccagccggtgaaccccacgcaggcgcgttcgcctctgcagtcggtcgccgcactggtcgacacctatacgcaggaaatcgtcgaaggcgtgaatccgactttacgtggattcatgtcatgggttgactcgcttggccagatagaggaggataccgcggcggtgcccgacactcctgcggacgtggtgctgatgaccatccatcaggccaagggattggaatgggacgccgtcgccgtggtgtccatgcaatcaggagtgttccccagcaatcagggcggtttgcatgtcgagctggacgcggagcatcccggcggcggtgccggcgaatcgtggactcccccggaatataaggcgacggttcgttcatgggcggacgacccggccgcggtacctgcgcccgtgcgcgtcgacgccggtatcctgccacgtttcccgcacgacgcgaatccggatgacgccccggtcgaaacgctgcgtgccctggacgatgtcgaagtcatcgacgacgagttctacggagacctgcgcagcaaggacatcggagacgatatggatgtcgccgacccgtccagctggtatctcacccaggaagaggaatatggccgacgtctgctggctgacgaacggcgactcgcatatgtggcgctgacacgggccaagaaagacgcgctgctcacctacagccagtattcgattctggatcgagacccgagccagtacctgaaccgtcccggcaaaagaccgagcgcctcgaagccgtcggtattctggacggagatgcaggactcgctatgccatgagagcggtctggtatccgcgtgcaagagcgggagcgcgggatactccgagaatgcggatgccattgccgacagtagccctgacttggcggtggccggtgcggcatcaggtgcgtctgcgcacccgtcgctggaccagctgggtgtggacaggccacaggggttcttcgtcggcgaccacgccaccgaatatgagcgggatgtcgtcgaagaggcgtggaacgccccattggaggaacgcgaacagggcggcggcccgacatggccggccaagttgtccgaggaaaccctgtcgaagctcaccggcgggatgtccggcgattccgtgcttgtgaccgacgatccggactccctgctggcacgcgcccgaatgctcgttgaagaccccgatctgatgccatggtccttcggccgaggcgagcgcgagatcgaccgctatgtccgccgtcaggcggagcacctgctggagcacggacggcagaacgtcaccgcgttgcaggcgagagcggggcatatgacccagcgcgaggaacgcggctattggcgtggcctgatccggcccatcccgcgcgtcgcatcccccgccgctgaggcgggcaccctgttccacgcatgggcggaacaattcatcaacgcctacggcgacggccaatcaatagatgcagacggcatcggcgcatacgattccagcagcatcgaaaccggtacggccggcacctgccgcgagccggtgacccgcgaatccctgctgcacgatctgtccgaactggaaatgaaatccgacacactgacggcgaaggaacgacagctcaccgtatggcagcgtcgactcgccgaatcgacgtggtcggagcgtcgcccggcgtgggcggaacgccagatcgtcgtgtcgattccccagctcggtgacgtcatcgtcaacggcaaactcgatgcggtgttccacggcggactggacgcgaacgatccgacgaagcaatacaccatcgtcgactggaagaccgggcgcaagccacgcaagccgcaggacatcgaacacaagctcgtgcagctcgactggtatcggctgctgctgtcgtacatcgagcacgtgccgctggacagaatcgacgccaccctctactatctgagtgagcctgatgaaggcgcgcgcgagctgcacgcccgcgcgaaaaccgaacaagagatcctagccgagttgagctccggcattcccgaaggatccgacaatgactaggtgaccgccaagggggcggcacacgctgcggatggaacgcgccgcagccgtcatgccgggagggatgccgcgacccttggcgcaccgtgtgggcgggcacacgtgccggacgcaacaaccacaaaggagcagaaccatggttgcacacgacaacaccgtcatgaatgccaccatcaccaatgccacgccatccgccgatgacgagagcgccctcccggagagcacgccgatcgggacggacccacagcgtggcgtcatgtctgacgtcgtgcctgacgttacgccggaggaggtgccgtgcaccacaatcgcatctacgccggcaacggcaacagtgcccgccgaggagatgaaaccatcgcaatcggtgacctaccggcccatgcgttggaatgatctggacgacatcgtccgggagttcgaccgcacatggggtcagtgcagcgcggccgccggcacgccggtgtccatgcagatatcccggcacttcgtgctgcactacctcgaaccgaccacccgcgccatcatcgccgaactcgacggccgcttcatgggcgtcacactgtcgcgcgtcgccggcgagccattggccttcccgcaagccaagcaggaactcgccgcgatcaacggcgaactgaaccggtcgacgctcggcacgaaaaccctgtccgagaccgagcaatggcatgagatggaactgcgcatggaacgcgaaatcgacatcaacgacgtcgcgcgcggcgagatcgagctgttcctcgtcgcgaaaagcgctcgcggacacggcgtcggcggttcgctctggcggcaggcgatggactatttcgcgaattgccaggtcgcccggttctacctgcacaccgactccagttgcgacgtgagcttctacgaccacaaggggctgaactgcatcgccgcccgatacgcggcggaccatcccgaggatggcgcagacatggacgacatcttcatctacgccggaaccccggagaacactcgatgagcggggctcaacagcagagccgatccgtcgcatcgcagtcgccgtacgcgcaactgttccgcattcccggcgccaaggcgttctgcatctccggagcggtggcccgattgccgatctcgatgatgtcgctgggcatcgtgctcgcgctcaaccacatgtacgacaactggacggtcgccgggtcgatgagcgccatgtacatcctcgccgtcgccgcggtcacgccgttctacgcgcgcctgttcgaccggttcgggcagcggcgtgtcggaccggtggcgcttggcgtgcagatagtggcgatgcttgcgttcgcactggcggcgctcgcccgagtgcccatcccggtgctgttcgcgctggccatatgcatggggctgacccagttctcgttcggcgccctcgtgcgcacccgctgggcgtatgcgctgcgcggttcgcagcacgagtcgctgctcaacaccgcgtatgcgctggaagcggccatcgatgagatcgtattcatcttcggcccgattctggcggcgttcctcgccacctcggtgcacccggtgtcgcagttgttcgtgcccacgctggcctgcggcatcgggggagcggtgttcttctcgctgaagaacaccgtcccgcccgtgttggagccgattgacgtcgtcgccgccgaaataccggacgcgcagtcgaacgccgtcaccggtcagccggctcccgcactccagacggccggagaccatgccgcaccgacgccctcccccgaagacaacggtttccggctgcgtcgtctgcaccggccctattccgccaagccgcgcaatgtactgacgtatcggggcattctgccactgctggtcgtgttcgtggtgttcaacatgagcttcaccgcattcgacgtgtccatgacggccacgatgaaggccgccggcgcggagcggttcctcggcctgcagctcgccatgttcgcggtcggctcctgcatcggggcggtcatcttcggttcccgggagatgaaaggctcgcactggcggcatatggtcatgttcctgacgctgctcaccgtcggctatgtggtgttccgcatggtgatgggcaatttcctgatcctcggcatcatggagatcctgaccggcctgtgcgtctccccgctgttcgctaccggcaacctgatcgtcaaggacatcgtgcctgcgcgctcgctcaccgaaggactgtcgtgggtgaccaccgcaggctcggtcggcacctcgttcggatcgaccatcgccggtgccgtgctggacgcatccagtccgcacatgagcatgatgattccgtggatcgtcaccctgtgcgcggtgccgctcgccctgctcggctggttcctcgcccgaaaacggcgctgacgtccgtcagccatgtacccgccgtggaacgcgatgacgcagaagcgcgtcgccgtgccgtcaacaatcgccttggcatacggcctgcgctcgtacaggctcgcgccggtctgagcacctgagccgacgccgtcaccctcgcccgcgctcctgcgcagatctccagtatctgcgcgaccctgtcgttcacgtccgccttcgtggcaagccggtgttcgagcaacggctcgccgatggaccgcccgatggtcatttgcgggttcagcgcactgtacgggtcttggaagatgtactgcatctgcggacgtatcgtgcgcagttcgcgctgggggagcttgaacaggtcatgtcccttgaacagcacctcgtcgcgctgctcgatggcctgttcgtggcgcgactggtagtcggccatgatacggtcccagttgtcctccgaccacgagcccatctgcactcacggtgtcacctcggaatccgcgcacgtcttgaggacggaggtctttgatgcggatgaccttatctgccattcgacgtttcctttttgacctcgaacgggagtccctgttccctgacgacggccttcaggaagatcgtgaccgcgccggagagggtgagcccgaggtcttcgagcacgcggctggattcctccttgagctgcgggtctatcctcatggtcgtggtgggtatgctcgccatatgcgcctcctatgcttgtcggttgttctgactgtacatcgtatgcacggtgtcatgcggctttccgccaataatccatgtacggtggtgtcatgcgctggcagtcacggcggcggatgcgatacaggcctttgccgagctggcgggcgagcagcccatcatcgtcggtttcgccgaatccgtcgatgaacgcgacgagccattggaaccagtccagataggcttgcaggtatttcgttgacacgccgtggaagccgaacatgaaagcctccaatcgcgcatgcagcgtgttcacgcgggtgatggcgtggtcgcgctcctgtggcgtcagttcgccaagttccttcctgaccctatcggctatacgcgccaccttgcccgttctcataccaccacggtagctacccagtaaccacgctgcaaggcaaaaagtcaaccttggtctaacagggccaaaatttatgaagccgtatcagtgcgttgtggaacggtgcgccgaaccggtcggagccgggatgtgacccagcttacggacaggtggccggaccatgggccggcatgcctatatattggtagggaattttggaaaagttacggacggtttcgctcggaaaggtcgtgtgatggtcagggtttcagtggtcggcgccaaagggcgcatgggatctcatgtggtggatgcggtgaacggtgcgcaggacatgcagctcgccttcgcactcgacgcgggcgatgacctgatgcggatcacgccggagaacaccgatgtcgtggtggagttcaccgtgccgtccgtttcgctcgacaatgtgctcgcgcttgtgaagcggggggtcgacgtggtggtcggcaccaccggttggaccgatgagagactcgccaaggtcacggcggcgctcgccgaggctccccgtgacgatcaggccgtgttcatcgcgcccaacttcgcgatttccgccgtgctggccgattatttcgccaaggtcgccgcgccgtacttcgagtccgcagaggtcatcgagctgcatcatcccaccaaggtggatgcgccctccggaaccgctatccacaccgcccgcgccatcgcggatgcgcgcaaggcggccggcctcggcgccatgccggacgccaccgagacggatggcggctctcgcgggcaggtcgtcgacggcgtgcacgtgcatgccgtgcgtctgcgcgggctcaacgcgcatgaggaggtattgctcggcaatgcgggcgagcagctgaccatccgcgccgacagcttcgaccgcatcagcttcatgcctggcgtgctgctcgccgtgcgcaaggtcgccgacggcggtcatgccggcctgaccgtcggcctcgacaagttcctcgacctgtaaagcgttggcctggcatcccccatccggcgatagtcccgtttggtggggtctggatgggactttggtgggatgaaggagatccgggacgcgttcatattatgtacgggtgacggcgatgcgtccttgctgccaagtacggtaaagagatatgagtgacggtactatgcatcttctcaacccggctccgttcggacgcatcctccccgcaatggtcacccccatgaaagcagatgggacggttgatttcgaggccgcgcagtctctggcgaagcaattggtcgccgacggcgccgacgggttggtggtgaacggcacgaccggcgaatcccccgtgacccacatggaggagaaggtcgagctggtgagggccgtcaaggaggtcgtggatgtcccggtgatctccggtgccggatcgaacgataccgcgcacaccgtgcgcatggtcgagcagacgcaggaggcgggagccgacgcggtgctcgtggttacgccgtactactcgcgccccagccaggacggcgtggtcggccattacaaggccgtcgattccgtggccgagaggccgatcatcgtatatgacgtgcccggccgtaccggactgaaagtccgcgtcgaaacatatgaccgtcttgccgagcttgagcatgtcaaagccgtcaaggacgcgaccggcgacctcgccgccgccgtcgaaaagcagcagcgcaccggcctcgcctggtattcgggtgatgatggcctgttcctgccgttcctgtcgatcggtgccgtgggcatcatctcggtgatcgcgcacgtcgcctcctcgccgatgcgccagctggtcgaggcgttcgaccgcggcgacatccatcaggcgcagcgcctcgccaaccagctcgccccgcttgtccacgcgctcaacggcgacggctaccaggccgtcatggccaaggcctcgctgagaatcaagggctatctttcctccacggccatgcgcctgccgaacatcggcccggacgccgatcaactggccaaggccgaagagggcatgaaagcagcgggactgctctgaccgggccacaccggcctcgctcgggatgcacccggattacggcatcgtccgactccgggaacggccgtcccggtcgcggatgcgaatggcctcggcggacacgggcgagcggttgtagataacgtcgtttccgtgacacagacggaaacaaagaaacagaaaaccaatagagaatggcacaagaacaacaaaagaagaacaattcacgcaggtcccgttccggtggcgcgtcgcgccgccgcggatccgcgaatcgcaacaccagcaacgccggctcgttcaagggccaggccaccgctccccagcaggacgacgtcctgatcgccccgccgaagtaccgcaagggttcgatgcgcatcacgccgctcggcggtctgggcgaaatcggccgcaacatgaacgtaatcgaatacaacggtcacctgctgctcatcgactgcggcgtgctcttccccgaagaggagcagccgggcgtcgacctgattcttcccgatttcagctacatcaagaaccgtctcgacaaggtcgacgcgctcgtgctcactcatggccatgaggaccatatcggcggcgtgccctacctgctcaagctgcgcccggacatcccgctgatcggctccaagctgaccctcgccttcgttgaggcgaaatgccaggagcacaaccagcatcccaccatggtggaggtcaagggacgcgacaagctcaaggtcggcccgttcaacctcgaattcgtcaccgtcacccactcgatccccgacgcgctcgccgtgtacgtcaagacgcccgccggctccctgattgacaccggcgacatcaagctcgaccagctgccgctcgaccacaagatcaccgatctggtggaattcggcaagatcggcgagcagggcgtggatctgctgatgatggactccaccaacgccgaggtgccaggcttcgtcaagccggagacctccatcggacccgcgctcgaccaggcgttcgcgcaggcgagccgcaagatcatcgtcgccagcttctcctcgcacgtgcaccgcgtccagcaggtcgtcgacgtcgcccacaagtacgggcgcaaggtcgtcttcgtcggccgctcgatggtgcgcaacatgtccatcgccgccgacctcggctacctgcacatccccgaaggcaccgtcatcgacctcaagaaggcgcacgatgtgcaggacgacaagctcgtcttcatgtgcaccggttcgcagggtgagccgatggccgccctcggacgcatcgccgacggcaaccaccgcgacatcaccatcaacgagttcgacacggtgatactcgccagctccctgattccaggcaacgagcatggcgtgtacaaggtcatcaacaagctcgtgcagctcggcgcgcgcgtcgtcaaccgcgacaacgcggccgtgcacgtgtccggtcactgcaacgagggcgagctgctgtacatgtacaacatcgtcaagcccaagtgcgcgatgcccatccacggcgagaaccgccacttggtcgccaacggcctgatcgccgtcaagaccggcgtcgatccgaagaacgtggtgctggcggaggatggcgacgtcgtcgacctgtaccacggtcaggccgcggtcgtcggctccgtgccgtgcggctacgtgtacgtggacggcgattcggtcggcgagatcaccgacgaggagcttgagaagcgccgcatcctcggcaccgaaggcttcgtgtccagcttcgtcgtggtcgataccgaggcctccgaagtcgtcaccggcccgaagatcttcctcaacgctgtcgccgaagacgaaagcgagttcgacaagatccgccatcagatcgtcgagcagctgcaggacgcgatgatgcaggggacgaaggacacgcacagactgcagcagatcatgcgccgcacgctcggcggatggatcgcccgacagctgcaccgcaagccgatgatcgttccggtcgtcgccgacatcgcccaggacatcatcgaagaacccagcaagtaaaccgcttcggctcacgcaagtgacgccggcatacgtccagaagcaagcctgaacgtcaacgtctcagcgaggagtagggaaccgcgtgaacggttccttgttcctttttctgtcgcgacggtcccggcttctttcgggaagacatatcagaaggagttagaaaatatgccaggtgcaaaccttacccgcgtggaagccgaggaacgcaagtccatcgtctccgcccccatcagctaccatgtccagcttgatctgacccgggacgcgcgcacgttcggctcgaccacgacgatctgcttcggcgccgagccgggcagcgagacgttcctcgacctgatcgccgacaacgtgaccgagatcatcctgaacgacgaggcgctcgaccccgcgcaggtgttcgaggacaaccgcatcgcgctcaccggcctgcgccgccgcaacgaggtcaccgtcaaggccgactgcgtgtactccaacaccggcgagggcctgcaccgcagcgtggacccgtccgacggcaacatctacctgtactcccagttcgaggtgccggacgcgcgccgcgtgtacgcggtgttcgaccagcccgacctgaaggccacgttcgacttcaccgtgctcgcgccgaagtcgtggatcgtcacgtcgaacatgccggtcaagtccaaggaggacatcgacgacgtcatcaccgcagacggggtgctcggcgaccacgagcccgaatccgcccgcagctggacgttcgagaccacgcctatcatgagctcgtacctgaccgccatctgcgccggtccgtacgccgaatggcacaccacctacctcaacgaggacggccgcaccgtgcctatggcccagtactgccgccaggcgctcgcccccgcgttcgccaaggacgtcgactacctgttcgacatcactaagaagggcttcgcgttctacgccaagacgtggggcgtaccctacccgtacgccaagttcgaccagatctacgtgcccgagtacaacgcgggcgcgatggagaacatcggcatggtcacgatccgcgaccagtacgtgttcgagtcgaaggtcaccgacgcgctcgccgagcgccgcgtggtgaccgtgctgcacgagctcgcccacatgtggttcggcgactacgtgacgatgaaatggtggaacgacctgtggctcaacgagtccttcgccgagttcacctccacgctcgccaccgccgaggccaccgaatggcatgacgcctgggccacgttctgctccggcgagaagagctgggcgctgaaccaggaccagctgagcaccacgcacccgatcgtcgctccgatcaacgacctcaacgacacgtacgtcaacttcgacggcatcacctacgcgaagggcgcctccgtgctcaagcagctcgtgtactacgtcggccgcgagaagttcttccagggcatcaaccagtacctcaacaagtacgcatactccaacgccacgctcgccgacctgctgcacgagctggagaaggcgtccggccgcgatctcaaggcgtggagcgccaagtggttggaggagtccggcatcaacacgatcgccaccgaggtcgaggagaacgcggacggcaccatcgcctcgctcacgctcaaccagaccgcccccgccgagcacccggtgttgcgcccgcatcgcctcgcggtcggcttctacgacgaggatccggccaccggcaagatcgtgcgcaccgaccgcttcgagcttgacgtggacggcgaatccaccgtggtcgccgccgcggccggcaagaagcgccccgcgttcatcctggtgaacgacgatgatctgacatacacgaagctgcgtttcgacgccgattcgctctcgttcgccctggcgaacctgcagcgtttcgatgatgcgctcgcccgcgcggtcgtgtggctgtcgctgtgggacatgacccgtgacggcgatctcgccgccgagaagttcatcgacacgacgctggcgctgctcgccaccgagaccgagtccaccacgttccgttacgcgctgagctgcatgagcaccaccgcgtggcactacaccgcgccggatcgccgcgcggacgtggtcaagcacgtcgccaaggagctgtggaagctcgtcatcgccgctcccggcggatccgaccagcagttccagctcgtcacggcgtacctcggctacggcgaggagggcgacgccgagttcgccgagcacgcgcagggcctcttcgacggctcgctgatcgtggtcggactggagatcgacaacaacttcacgtggacgatcatcaacgcgctctcctcggtgaagctgatcgaccaggccggcatcgacgcgcagctcgccaagcgtgacaccaccgagaaccgcgagttcgcgctcggcgcccacgcggtgcgcttccgccaggacgcgcccggtgagcaggtacacctgcggggtctcgtccatgtgcagcgtgatccactcgttgtgtgcacgggtcgggaagtaggcgctgtagatcttcttgccgagtgcgagcacggactcgtcaaggtgtgtgccatcggaattacggatggcatcagcgccccacaattcggcaagttccttggttttttcagcgaagttctcttcactgggcaatgtgaagcggccagtgctggtcatgggttctccttcttgggaacagtcatcggggaaagatatatgggtgatgaaatcacgaaggccgatgaaatggccggcatcatcgcaggcccgctggatcctgactgcgcaaatccttgacgcctacgatgacgctggacgatggtaatcgtgtcactgatcgaggtgatggccgtaccgcccggcactcagtgacacatcatgccgggcggcggttcgtggttttctcccgcacatggcgggagaaaacatcagcccttgacggcgccggcggccaggccggactgccagtagcgctggagaccgaggaagatcacgatcaccggcagcacgccgagcagtgcgcccatcatcagggcgccgcgatcggtgaatgtggccaacgacaccatgccgtacagacccagggtcaccggcttgagggtgtcggaggacaccatcatcaacggcagcaggaagttgttccacgtggcgacgaacaggaacaggaagatcgtcaccattgccggggcgagaagtcgcagcacgatggtgaagaaaatcctggcttcgctcgcgccgtcgatgcgggcggcttcaagcagttcatcaggcacagagctctgggcgtacgtacggcccaggaagaagccgaacggcgagacacagcacgggatgatgatggacgccatcgtgttggtcagcttcagagcgtggaagatcgagtactgggggatggtgagcagggcggcaggcatcagcatgcaggccatgatgatgccgatggcgacgttcttgccgcggaagttgaacttcgcggtggcgtagccggccatgacggacacgatggtgccgatgagtgcggagacgcccgagtagatcagcgagttcagcacccagcgccagaagttgccacgggtccagccgagcagcttggagtagttggtggccacggcgttggggatctggtcgagcgacacggagaaccacaggccattgccgctggtcatctgggagggcgtcttggtggacgcaatgatggcccagtaaatcgggaacaggaagtagatcagcgccaacaccagtacgatgaccgtaagtgtcttgactgcaggcgacggcctcatggaacggggcagatcgtgctgtgcagcctcgcgctgcttctccaaacgacgttcgcgcttcttgttcgcgcgcacttcagcggttgcagagctcattactcgttcaccttcctttcagcaagggtgtacacgacggcaagcagacctgcgatcagtgccatgacgatggcgatggctgatgcggggccgtcacctgacggggtaagcgttccctgcgaagtattcatggccatcatcatcggcgtgtacgccttggagatgcccggatccgcggtggacatgatctgcggctcgttgaacagctggatggtgccgacgatggacagcagcatggcgagcagcgccgcgccacgcacgttcggcagcttgatcttcatggcgacctggaaaccgttggcaccatcgatgcgggcggcctcatacaggtcgtgcgggatggcctgcagcgcggcgaggaagatcagcatgttgtaaccggtgaacgtccaggtcgtgatgttggccatggaaccgaggacaacgttgttggcaaagaagtcgacatggatgccgatggactccagacccttgacgattggggaaatctgaccgttgtacaggtagacccagatgatggaggcgacgacgccggggatggcgtagggcaggaagtagcccagacggaaaccggtaacgtgcttgacgacaaacgaatcgatgaccatagccagcgcaagggcggcgatgatcatgatcggcacctggatgacggtgtagagcagcacatggccgacaccagtccagaatttgccggaagtgatgacgtattggaagttctggaatccgacgaactcgttgaccagttcgccgccgccatagaggccgccgccttggctgacctgacggaagaagctggaatagacggcccagatgatgggcaggaggaacacgaaggcgaacaagattgcgaacggcgccatgaacgcccagccggttcggttctcgcgcttgaatgccttcgagcgctttggctttgcggcggcgcgtttcggcgcggcacccttggcctgagtaatggatgcagtcataatacaaacctgtcttttcgaaaaacagaaaaacgattccacgagcatgtactcttggacatatgaaaggccggagtccgaatccccggcctttcattttatgatgcctgaggcatcgggggtcttgggtgatggacggaacttttcagcttatccatcaccggaccgggttatgttcactccttgacagggagcttggcgttcttcagcgcttcgacggaagtcttctgagcggtgtcgaagatgtcggagaccttggcgtcaccagtggcggccttggcagcagtctcgttcatcgctgcacccacggcggagaagcccgggatgtagttgaacgaagccatgttgtcgttcgctttcttgaactcagccatgatgtcctggttgctgaagaactcggaccacgcagccggagtcttggcagcctcagtggtggcggccacgaccagaccctgggagaccagatccggaacctgggtgttgaaccagtcgaggaacttcatggcctcggccgggtgcttcgagcccttgagcacagccacgccggaaccaccgtcggagccggtcttggtgccgttgccgaaccaatcgggcagctgggcgaccttccactcccccttgccggtgccaccggcggagctgatgaacagcggggcttcccaagcggcagccacagtgccgatcagctgacccttgttaatggaggcgtcgaaggacggatcccaacgcgggttggtgagcgcggacttgtcgtcgagcagctgctggtacaccttggccacggccttggagcctgcagtctgggtgtcgaccttccaggcattgccctcagtcttgtaccacgcgccggaagcgccggaagtgccggacatcgtcatcatgccctcatcgggctggaacgtcatgatgtacttaccctgggcggcggtcttcttggcggtcgcgataagctcgtcagcggtctgcggcacggtgatgccgagcttctcgaactccttggcgttgtagaagtacgtcagggggccggtgtcctgcggcagaccgtaggccttgccaccgatctgcatcatggagaacggaccctcagcgaagtggtccttgtacttcgcggcctcttcggtgacgtcctgcaacagaccctgactgaagacctcaggcaactcggcgtatccgacctgagccagatcaggagcggcgccggccttgacgtcggtcgccagcttcttgatcatgtcctgagccgcgccatcgaacttggtggccttgacttggatgttcgggttgtccttgttccacttggccacgatgtcattgaccagcgtcatgccctttttatccggcaggcgatgcatgtaggtgatcgtcaccttttcgtctttgggggtattgctgctgttgttcgtgggcgaaccgcaaccggcaagggcgatgcccatgacagtcagcgacgccagaccagcaagcagtcgtttcttagctaccatattcctaactcctccattgagatggatgttgcctcctcgtcgtggcaactaattagttagtgtaaaggcatgccaaggaaatgtcaactacattaacatttgtgtcgtgtcaccggtcacacagatggtaacccacggtgtgcaacaccgcacgccagtaagcatgacagatttatgtatataaagtttacaatttatttttctctcttctagtcgtcaaggccatccctatcgacaacaacggagtctccccgcgaaaaaccttacggaacaccggcctatacggcgtgtcgtccattccttcggcgctcgaatcaagctcatcctcataatgtgacactcctcacattaccagagtcattctggtcacgcagccatcttcatcccgctcacgcgccgaccgcaatgccgggcacgatacggaaaacgccccggcgtgtcatcaaggacacgccggggcggggcgcaaaggcgatcggtaccgcgaggcgtctactcgacgctacgcaactgcgctgctatctggatggcctcgacactggcttcggccttgcttcgcgtctcctgccattcggtggcgggcaccgaatcgagcacgagaccggcgccggcctgcacgctggcctgatgatcgcgcaggaaggcggtgcggatggcgatggccatgtccatattgccggagaagtcgaaatagccgactgtcccgccgtagatgcctcggtcggccgcctccagctcgtcgatgatctcgatcgcgcggggcttgggagctccggacagcgtgcccgccgggaacgccgacatgaacacgtcgaacgtggtcaggttcggatcgaccgtgccagtgaccgtcgagcagatgtgcatgatgtggctgaaacgcttgatgtccatcagctgcacgacctcgacgctgctgggcaggcagaccttgctcaagtcgttgcgcgacaggtcgacgagcatgatgtgctcgctgcgctccttcggatcggcgagcaattccttggcaaggcgctcatcctcttccggggtggcgccgcgcggacgggaaccggcgatcgggaaagtcatcgcatgcccgttgtcgaccttgatcagcgtctcggggctggaaccgatcacgttgaaatcgcgtccctcggcgtcggtgagcgtcatgaaatacatgtacggactggggttgagcgtgcgcagcacacggtacacgtcgaacgggtcagccggcgaatccagatccagacgctgggatatcaccgtctggaacacatcgccgtcgacgatgtgccgcttcgtctcctccacccagcgctcatactcggccttggcggtgcggaaccgcagctgggggtggggcaggcttcggtcaagcacgctcacgcgggcctcccccgccaccggcgtggcggccttgcgctgcatggcatccagccgttcgatggcctcgtcatacgcggcatcggcgcgggtcggccggtcgtcgacgttcaccgcattggctatcagccacaccgagccggacacatggtcgaccactgcgatgtcggtggccaaggccagcgtcacctccggctggccggtctcatccggcgcctcggcgcgcagtttgggctcccaatggcggatggcatcccagccgacggagccgaccagtccgctggtcaggttcggcagtccggccacatgcggcgccttgagcaccttgagcgcggcatgggccacctcaatcacgtcaccctcagtgggcactccggccggcacctggccgagccagttcgccttgccgtgatcggagcgcagttgagctatcgaattgacgccgatgaagctgtatcggctccaggaaccgccgtattccgccgattccagaatgaacgttcccgaacggcccccggcgagacgctcgtaaaagcccacgggcgtcaacgaatcggcgagcagtcgccgcacgatgggaaccacacggtatccggcgtcggcaagccgatggaactgggcgcggtccggccatgtgccgccccattcgagatgctcgacactgcacgcggccccatcatcgtgcaggccgccggccacaccggcatcgtcaatacgccgctcgctcatcacgcattctcctgttccgcggtacggtccccgacgacgaccggcaacgggccgccctcctcgaagcacgagcgcttgccggtatggcaggcggcacccacctggtcgacctgaaccagaatcgcatcgccgtcacaatccagcgccagggacttcacatactgcacatggccggacgtgtcccccttacgccagtattcctgacgggagcgagaccagaacgtcacgcgaccggtcgtcaacgtgcgccgcagcgcctcgtcgttcatgtagccgaccatcagcacctcgtgcgtgtcatactgctggatgactgcggcgaccagcccgcgcgcgtcacgcttgagccgcgcagcgatgcgcgggtcgagttcgtcggtgttgtcatagtcgatggtggattgcgtatctgtcatgtccttcatattcctgttcatgtccctatggagtcgtgttcatgcatgcggcgaatcatcgccggccggttccgccgcgatttacaggcgaaccgtgtatcccgcggaccgaagcgcctgcttgacctcgcggatggtcaccagaccgtaatggaagatcgacgcggcgagcaccgcatccgcaccggcggcgatggccgggggaaaatcagcggctttgcccgcgccaccggaggcgatgatcggtatcttgacctcgcggcgcactgccttgatcatctccaaatcgaagccctcacgggtgccgtccgcgtccatcgagttgagcaggatctcgccagcgcccagttcctcggcccgcttgacccaccagatcgcgtcgatgccggtggacttgcgcccacccatcgtggtcacctcgaacccggactgcgtatgctgttcgccctgctcgcggcgggcatcgaccgacagcaccagcacctgattgccgaatcggtcggcgacgcggctgatcagcgtcgggtcgttgatggctgcggtgttgacgcccaccttgtcggcgccgcaacgcagcagcgagtcgacgtcctcgggagtacgcacgcctccgccgacggtcatcgggatgaacacctgctctgcggtgtggctgaccacgtcgatcatggtctggcggtgcgagctggaggcggtcacgtccagaaaggtcagctcgtcggcaccctgacggtagtactcccccgccagctcgaccgggtcgccggcatcacgcaggttctcgaaatgcacgcccttgaccactcgtcccgcatcgacatctaggcatggaatgactcggacggccaacgacatgattgctcccttatcaagctcggttgttgtacggataccaagggtagcgtccgcccgttacagcagtgccgcggcgttccgctacatgggacgggaaggccgcgccctctgcggttcgagattcgcggcctgcagcagtgagagcgcggttaggccgcgaaagcctctttggtcttggcggcgagctggccgcaggcgccgtcgatatcggagcctcgggtgtcacgcagggtggccgtgattccggcatggtgcaggatatcgaggaactgctgctcatcctcgggcttggatgcggtccagcgagatccctcgatcgggttgagcgggattgggttgacatgcgcccaatcgtcgccgtaatggttgagccgcttggccagcagtcgcgcgtgctcggcctggtcgttgatgccgcgcatcaacgcgtattcgatgctgacgcggcgcttggacgacaggaagtaatcgtgggcggcgtcgagcacctgagtggtgttgaaacgcttgttcatcggcacgagctcatcgcgaagcgcatcactgggcgcgtgcagcgacacggccagacgcaccgggatgccctcggccgtgagcttcctgatgccgggcacgacgccgacggtcgatacggtgatgttacgcgcggagatgccgaacccttcgggaggcatcgcgctgatctggcgcacggcggacagcacggaccggtagttgcccatcggctcgcccatgcccatgaacacgatgttgctgagccggccggggcctccggccacttcgccgtcgcgcatcatacgagcggcgacgcgcacctgttccagaatctcgccggtcgacatgttgcgggtgagtccaagcttaccggtcgcgcagaacggacagcccatgccgcagccgacctggctggagatgcataacgtggtgcggttcgggtaacgcatgagtacggattcgatgtgagagccatcgaaaaggcgccacagcgtcttgatggtggtgccctgatcggccacctgatgggtcacctcgtcgatcagaggcgggaagaacgcctcgacgatatcgccgcgtgtggcggcaggcaggtcggtgaacgcctcggactcggtctccagccggccgaagtaatggttcgccagctgcttgacacggaacttcggcaatcccagatccttcgccctggcgatgcgctcgtcaggcgtcatgtccaccagatgcaccggcggcttgccccgtcgggcatggtccttggacagcacgtcgcggaaagcccccttgtcgccgggggtgattccggtctccggctgttccgcatcctgcgcatgcccggtcgtcattgctcctccatcatcgttcgtatcttgtcgtcgcttcccgcatcgtcatgtccgatcgtcaagacgaccgtcacatgccgacaatccacagcagtccggccaggaacggcgcgcacatgaggatggaatccacacgatccatcacgcctccatgacccttgagcaggtgtcccatatccttgatgccgatatcgcgcttgagcatggacgcgcacaggtcgccgaacgtgcctgcgacgccggtcagtactcccatgacgatcggaacccaccagcgcgacgcccacaccgcgccgtcatacgtgcagaagaacaccgcgaacgcgccgatcatcgcgaacaggatcgaaccgaacagtccctcgaccgatttcttgggggagatgcgcggcgacagcttgtgcttgccgaaccatgcgccgaagaacaggccgccggtatcgctcagggccggcaggaacaccagcgtgatcgcgtgcgcgaccggatgcccgttgaacaccagcgacagcacgatgcagctggccagcgtagggatgtacagcacggtgagtatcgagacagcgacatgcgacagccgactgtgatgcagttcgcctttctcatggttgaacgacgactgctcgcgcgcggcggcgtcggagctcgacagcttggatgcgacggcgagcgaaagccagttgccgaagctgaaccgggcggtggcgagaatggccaccagcatcagcgtcgccatcgtcagcagcgccatcgtgccgaaatggtacgggctgtaataggtgccgagcaggatggccgccgaacacagccacagcgcgacgaccgggatatgcagaccgaccgtggcgaaatcgacacggagctcccacagcgcaagcaccatgaacacgacgatcagcagcacgaacacgtcgatgcggatcagcaggctcgccaatatgatgatgacgagcaccgcgccggtcgcgaccgcctgcggcatgttgcgcccggtcttcttgttgatgttcgccagggcctcctcggcctccacatgaagctggtcgttgtgttccatgatgttcaaccgcctccgtaagtcgatggtgccatgatgattctgccttcatcatagcgaaccggacgaggcgatggtcacatgccgcgtccggttcaacgatttcgtcatgaaggtcagacctccatgatctccttctgcttggtctcgaacagcgcgtcgagctggtcggtgacctgcttggtgaccttgtcgagctccttgagcagacgatcgccctcgtcctcgcccatctcgccgtccttgacggacttgtcgatggtctccttggccttgcggcggatgttgcgcacggcgaccttgccgtcctcggccttcgacttggcgagcttgacgtattccttgcgacgctcgctggtcagctccggcatggtgatgcggatgacgttgccatcgcggttcggattgacgccgagatcggagtcgcgcagggccttctcgaccttgctggcctgggacacgtcgaacggggtgacggaaagggtgcggggctccggcacgccgatggacgcgacggccttcagtggagtcggagcaccgtagtagtcaacgacgatgccattgagcagcgcggggttggcgcggccagtgcggatgcccgcgaagttctccttggtgttctccacggacttgttcatctgttccttggcttgttcgacaggattggccattttgtgctccttgttgttgttcttcgttgaagttggtttcccgggttggatgcaggcgcgcgatcaccgatgcgcgtcgctcacgcgagcgtggattcggcggtggacaccagcgtgccgatctcctcgccgagcagcgcgcgggtcacgttgccggcctcttcgagaccgaacacgcggatgcgcttcctgttgtcgcgggccatggacagcgcggcggcatccatgaccgccaggttgtcgacaagggcgcggttgtagctcagcgttgcgaaacgcttggcatctgcgtccttgcgggggtcggaggtgtagacgccgtcgacgccgttcttgcccataacgacctcatcgcaatgaatctccagcgaacgctggatggacaccgtatcggtggagaaatacggcatgcccgcaccggcgccgaagatcacgacgcggcccttctccaagtggcggatggccttgagcggaatgtacggctcggcgacctgacccatggtgatggccgtctgcacgcgggtggcctgcccctcctgctccaggaaatcctgcagcgcgaggcagttcatcaccgtgcccagcatgcccatgtaatcgccgcgggaacggtcgatgccggcctgctgcaattccgcgccgcggaagaagttgcctccgccgacgacgatggcgacctgaacgccctgccgcacggcggggacgatctcctcggcgatgcgacgaatcacctgcgtatcgatgccgacctttccgccgccgaacgcctcaccagacagtttcagcaatacccttcgtggctgatccgccgctactccatctgccatgcatagcctttctgatatcggttccctgatgcttcgtgagccggaaccgcccgacatactgcctatcagcgtatccgcaaactgcgacagtgcccggtagcgactcgcgcgatcacagcgattcggcgaattcctcgacccgggccaccacgtcgtcgagatacgacgcagaagtgcgccaccggccgggaacctctatcgaatgattggcctgcgggtactcatgcacgaggccactgagacgatgggcccggtcgctgcggtacagcgggtccgcggttcctgcgcagatcagcggttcgggagccgagccgggctcgtaatcgtcatcgcccggcacagggatgacggaccgtgtcggatcgaagtcggccggtgacagcacgggcgtcagcaaggccatcgggacgccgagccgggacacatgcgggtagatgaacgtcgacagcgatttcgccaccaccagggtgcgcggctgcgatgccggactcgaccggcgagggatgccatccagccagtcgtcgacagctccggacagcatcgagaatattctcggcgcgggggtcttcgacaggtccgcatcgacgtcgagccgttccacgaaccagccggcatcggccaacgccatcgcgcagtaatacagcagcggccgatcgcagttgtatccggtgcccggcatgatcagcgcatgccggtcggtcctatccgatgccatgcggttcttcggccattcgtttctgcggcaggtgggctgcgccgttccgctccccatcaacgatgaaatcatcgtcatgatcccccatatgatttttcgttattcgtgtgattgcatgctgtcggctggcatggctgcgccggccatgccaggtatgacaaaggcggccgacgcatgaaagcgcggaccgcctttgttgaggttcatctcagctcacaggctgctcccccggcccgatgatgcggaccggagcgggacgaatcaaaccttcgcggttcgattcactcctcttcgcccttgccgacctcgatgcgggcgaaggccacggccttgccgccgacttcctcgaacagcttgccgacggtcttggacggatccttgacgaacggctgctcaagcaggacgacttccttgtagaaggcgttgagacggccttcgacgatcttcggaacgatcttctcgggcttgccttcggccagggacttctcggtggcgacgcgacgctcggactcgacgacatcggccggaacgtcctcacggctgagccacttggcgcccatggcggaaatctgcagagcggcctcgtgagcgaccttggcaccggcttcgtcggtggcgatcatcgcgacgatgctcgggggcatctcgacggacttcttgtgcgcgtagatctcgacgtgcgggccggagatcttggcgaactggccgaccttgacgtgctcgccgaacagggcggccgcctcttcgacggcgaccttgacggtgccatcctcggcgttggacgccaggagctcgtcggcgttgttcgcgtcggcggccacggcgtagccgagcacggtgtcggcgaattcgacgaacttcggggtcttggccacgaagtcggtctcggaattgagctcgacggcgtaaccggtctggccttcggcggactcgatcaccttggaggcgatggtgccttcctgggccttgcggccttcacgcttgccagcggcctggatacccttggcgcggatgatctccttggcgcgggcgacatcaccctcggcctcggtgagagccttcttgacgtccatcatgccggcgccggtgtcttcgcgcacctgcttgatcaaagctgcagtgattgctgccattgatttgtctcctcgttaaaaatgtgtccccatagtgatgggaggctgttgcacctcccatactacaggaggtaggtcactcggccttggcttcctcggcctcggcggccggagcggcttcagcggaagcgccctcggtcagcagttccttctcccaagcggccatcggctgctcggcttcggtctcgccctcggccttggcggcccggccggaacgctccagcaggccatcggccactgcgtcggccatcaggctggtcagcagctcgatgccgcggatggcgtcatcgttggccggaatcgggtagtcgacggactccgggtcggtgttggtgtcgacgagggccacgaccgggatgcccagcttgtgggcttcctcgacggcgagcgattccttgttgatgtccacgacgaacatcgcggagggggtgcggaccatgttgcggataccgccaagctgcttctccagcttatccttctcgcgctccagcagcagcagttccttcttggtcagaccggagccgtgcacgtcggagaagtccatctcctcaagttccttcagacggctcacacgcttggagacggtctggaagttggtcagcatgccgccgagccaacgctcggacacgtagggcatgttcacgcgcgtggcctgggtctgcacggcttcctgggcctgcttcttggtgccgacgaacagcacggtgccgttgtgggcgacggtggccttgatgaagtcataggccttgtcgatcagctccagcgacttgaacaggttgatgatgtggatgccgttgcgctccatcaagatgtactgcttcatcttggggttccaacgacgggtctggtgaccgaagtggacgccggccttgagcatttcgctcatcgtgatctgtgccatagcactacctttcttgtcggttcttgcctggtcatgcgtacctgagtgcagccccgccgaagcgtggccgaccgacacaggccgtcgcggacatgacgcgatatggtgtgcaccggttgacgataacggttggccgtcgccacctgcgactgcggtgacggccgggttggcgcacaaatattcagaataccaccacgtgcctacttggcggcgtgctcacgcatgtaccgcaacgcctcgcggcgctccgtcttctccagccggtcgaggtacacgtgaccgtcgaggtgatcggtctcatgctgcagcatgcgacccatcaggccgctgccctccagcacgacctcgttgccgtccaggtcgatgccgcgcacgcgggcgtaatcggcacgacgggtcttgtaccacaggccgggaacggacaggcatccttcgtcaccgtactgttcgccgctcttctcctccagcaccgggttgagcacgtacccgatcttcccgttgatgttgtacgagaaggcgcgcagcccgacaccgatctggttcgccgagagcccggcacgacccggatcgtcgacggtgtccagcagatcctgcacaaggcggcgtacggagggcgtgatctccctgatcgtctcgcacggggtgcgcagcaccggatcgggaactgttctgatttcgcggatggccaattacttctcctcactggtgtcgttgctgtcggatgccgcgtcgcccacgctgtcctcctgctcggggctgccggattcggcttcgtcgtccttcatgaagcgaatcttccccttcgcctggtcgaaggcctgcttgacgctttccgaagactgcttcacggtctcggcggtcatgtcgaggatcttgacggtggcgggcagcggctttgcggcgttcttcggagcatagatcatgttgtcgatcacgtcggcgtaacgctgcagcactttcgggcggaccaccttcatgctgggtgtcagagtgccgtcctcctggttgaactcctcgtccagaataacgaacttgcgcaccgactcggcgcgggagacgttgccgttggccttgtcgatgtactgctgcaccaacgctcggaccgcgtcgttggtcgcgatctcgctcatcggcgcgtcgatgtcgaggttctgcgaggcaagccacgatcgggtcatctccgcgtcgagttcgatgagcgcggcgatgaacgggcgtccgtcgccgatgacgacggcatgggcgacgatcgggcatgtgttgatgacatcctccatcggcgccgggctgatgttcttgccgccggccgtgatgatgatgtccttcttgcggcccgtgatgaacacgaatccccgatcgtcgatcgtggcgaggtcacccgtgtgcagccagccatcggaggtcagggcctcggcggtccgctgaggctgcttgtagtagccaaggaacacgttcggccccttgatcatcagctcgtcgtcatccgcgagcctgatggagatgcagccgggccggccgacggagccgacctcgttcgcgtcctggaaattcaccaggcagggcgcggccgtctcggtcatgccatacccctggatgaaggtgatgccatcgaatccgttgaagaagtgcgcgagatcggcattgagcggggcgccgccgcaggcgagccacttcatgttggggcccagggcggaacggatcgacgagcccacggtctgcatgtagaagctgtgctggatgcgggcgcccagggaatgatggccgccggccatctcgtccttcgaccactgcacgaaatgatcgaacgccttggcgaacaggcgccccttgagaccggctccggccttctgcgaggcggcgttgtacaccttctcgaacacgcggggcacgcccagcagatacgtgggtttgaagccgcgcaggtcggcgagcagccgcttggcgctggggatatagccgaccacgccatgcgagccgatggccacgtactggatgtaccgcgcgaagcagtgcgccagcggaaggaacagcagcagacggctcggctggtacagcatgtcgttgagtacctcatagccgttgtagaccgtgtggttgaagttgcggtgagacagcatcacgcccttcggtttgccggtggagcccgacgtgtacacgatggtgaacaggtcgtcggcgcggacgcggccgatcgccttgtccagttcctcgtcgctgacggactcgccgaaatcggcgaccgcgtcgaggccgttcgccttgaagttgaacacgtagcgcaggctctcgctgtgcgcgcgaatctgctcaaggatctgcgcatgggagtcgtcgccggcgaaggcgatgaccggttcgacctctgcgacgatatcacccgtctgtttgggcgaatcggtctcgtatacggggacgctcaccgcgccgatggaggcgcaggcgaagtccacgacgccccactcatagcaggtggcggcgtatatcacgaccatgctgccgggcttgaccccgaggccgagaagccccttggccacctcacggacgcggtcgttcatctggccggcggacacgtcatgccactgcctcgtctcatcgtcctgccattgggcgatgaggtcatcggggtcgcgttcgcaacgcttggcgagcagtgaatagatggtgtccaagtctgtggtctgatagatcgtatcgacggtgtattcacgcaacataggctccactataagcatggccgcgtaccggcacgcggccatgcggaacatatcatccggcttgcgcggcgtgtatcacccgatgtccgtcatcgtgcacagccagcggcatcccatctggcgcagcacgatgttcgaccagtagttctgcacgccgatggtcagatgcgtcgatatctcgaacgtcgtcggattgatgaacatccccgacatcatccggggcaccaccggcagataccggagtttggccttcagctcaggattcgactgcatgtggttgtcgagcaggtacgccatggtctccagcttcttgagacacgggccggtcaccgcccgtctgagcttgcccgcatgcagctgtccgcgcatgatgtcggcggacatgcatgctatgcgggcggacgataccgccagcgaatggccctgtgcggcgttgatgcttcccgcgccgcagctggtgatgtgatacggcaccggaacgtcggacgattcgatgatgacgtacccgtcgaggctcggcaccgggcagggcgggttttcgcgcgcgtaatgataagtgggttgctccatgtccgtttctccgtcttctctctcgcccccatccacgatgaaaggggataatcccagcacaacacaacaaaggcacccccgcaatggacgagggtgcctttttgtgcaatcgtgccgcgattcgagcctccgacgcggaggcgaagcatcacggatcagacgtggtaggggttgacgaccaccgagcaacgctggaagctcttgacgtcgacatagcccgtggacgccatggctcggcgcagcgcgccgatgtagttcacctggccatcagcgcggtggctgggcccgaacaggatctgctccagcgagccgaccgtgccgacatcggtgcgggaaccgcgcggcagggtctggtgacgggcctccgcaccccaatgcttgccgccaccgggagcctcggtggcgcgggcgagcggagcgccgagcatgacggcgtcggcgcccatggcgagggccttgacgaagctgcccgaatcccccatgccgccatcggcgatgacctgcacatagcggccgccggactcgtccatgtaatcgcggcgggcctcagccacgtcggcgatcgcggtcgccatcggggcgtggacgccgatcgtcgtgcgcgtagcggtgaccgcaccgccgccgaagccgaccagcacgcccgccgcaccagtgcgcatcaggtgcagggccgccgtgtagttcgcggcgccgccgacgatgaccggaacatcgaggtcgtagatgaacttcttgaggttcagcggctcatggccgagggacacatgctcggcggacaccaccgtgccgcggatgacgaacaggtcgacgccggcttcgaccaccgtggagtagaactgctgggtgcgctgcggggaaagcgcgcccgccacggtgacgcccgcatcgcggatctcatgcaaccggcgggtgatgagctcgggcttcaccggctcacggtagatctcctggatccgctcggtcgcgacgtcatcgggcagctgggcaatctcgtcgagcagcggctgcggatcgtcataccgcgtccacagaccctccagatccagcacgccaagagcgcccagccggcccatcgctatcgccgtggcggggctggtgaccgaatccatcggggctccgatgaccggtacgtcgaactcataggcatccacctgccacgacgtcgacacgtcctgcgaatcgcgggtgcgacgagagggaacgatggagacatcatccagcgcgtaggccatgcgggccttcttgcccaaaccgatttcaatttcctgagacatggtttcaaggctaatgccgggctgtgacaccggacgcggccgcacacgcgcatcacccgccgtctcacattgtggcgaataccgagcggcggacaacgcgcggtaacatcgatgcgctaagactggtgcacatacgccaatcacgctaggaggaaacgcatggccaaaatcaaggtcgagggaaaggtcgtcgagctcgacggcgacgagatgacccgcgtcatctggaaggacatcaaggaccgtctgatcctgccctatctggacgtcgatctggactattacgacctgggcatcgagaaccgtgacgccaccgacgaccaagtcaccatcgacgcggcaaaggcaatccagcgcgagcacgtgggcgtcaagtgcgccaccatcactccggacgaggcccgcgtcaaggaattcggtctcaagaagatgtggaagtcccccaacggcacaatccgtaacatcctcggcggcacgatcttccgcgagcccatcgtgatgagcaacgtgcctcgtctggtgcccggctggaccaagccgatcgtcgtggcccgccacgccttcggcgaccagtacaaggccaccgacttcaaggtgccgggcgccggacgcctgaccgtcaccttcactcccgaggacggctccgagccgattgagcacgtggtctatgactacggccaggacggcggcgtggcccaggtgcagtacaacgtcaacgattcgatccgcggcttcgctcgcgcctgcttcaactatggcctgatgcgccactacccggtgtacctgtccaccaagaacacgattttgaaggcctacgacggccagttcaaggacatcttcgccgaagtgttcgagaccgactacaaggacaagttcgccgaggctggcctgacctacgagcaccgcctgatcgacgacatggtcgccagctccctcaagtggcacggcggctacatctgggcgtgcaagaactacgacggcgacgtgcagtccgactccgtggctcagggcttcggctcgctgggcctgatgacctccgtgctgatgaccccggacggccagaccgtcgaggccgaggccgcgcacggtaccgtgacccgccattaccgtcgctggctcaagggcgagaagacctccaccaacccgatcgcctcgatcttcgcgtggaccggcggactcaagcaccgcgccgacctggacggcacgcccgaggtccgccatttcgccgagacgctggagaaggtcatcgtcgacaccgtcgaaggcggtcagatgaccaaggatctggccatgctggtgggaccagatcaggcgtggctcgacaccgagggcttcatgaacgcgctggacgagaacctttccaaggcgctgaccgcgtgaccggccgggcggggttctccggcggctcccgccaccggtgatcgccgccggcaatccatcgccatcaaggcccgcatcccatgtccccacacgagatgcgggccttgtgcgtatggtgaggctacaatcgaaagtcacagtattcgcatgactgaaagggcgtgaccatgtcaggacgacgcatggtgtcttgtctgaaactcatcgccgccgcgatggcgacgggtcttctgctcacgacggcgggatgcgcgtcaacggacgataccaacactccggacggcggcaccgtcacgcaatccaccggggcggtggcgatattcaccccatcggacggcatcaccctctcccagcacacgccgttgaacaagtgggcgaaactggtgcccgacatcacctccgagctcaagaagcaaggattcaaatccgcgaacatcaccacgaccacatccagtgacctcgccaagcagagccaggacattcaggattacgtcgtcaatcatgcggtgtcggcgcaaagcgggaaagacagcgccaacaagaaagacggtgctgacgagaaggaaataacgctgatcgtcgcgcccgcagccgaaacgcagacatccacccggcaatacggcgattacgtcagccaaacgagcggcacggcgacggataggaccggttcagacgaggccggttcaacggatgcatcggaatcgactgacacatccgaatcggcgaatgcatccagctcggataacgcatccgactcgacggccacgcaatcgatgccccgtatggcgaacgcattgcagctggccaaggactcgggcatgcacgtggtgctcgtggccaatccggtgaaggacttcacccccgacgctttcgtcgaactgtcgacagccgaacgcatcgggcagatccaggcgagcaagcttgccgacaaactgcaactcgacaccatcagcaaggacaatccgaaggccgtggagatcctgctgccctacaccgcatccgctgacggcagtgacgacgaattcgccaaggaggccttcgcaggcgcctggtccgtgctgcagccgtatttcaagaagggcacggcatacagtccgtccggactgctgacggccgacacgaccgacgggcagtgggagtcggtcgccttcaaaatcgacaaggattcgcgcatcaccgacgagatcaccaatcgtctcaaacagaaggattcggcctcgcacacccgaatcgacggcatcatcgccatgaacgattacgtggcttccggagtggtcgacgcgctcgaccatctcggatacaccggttcggcggccgacatcaacccctccatcacactgcccggaatcgtcggcaacatcaccggaaagcaggatctccaccgcaagaaggtgccggatccgatcaaggcgccggaaaacgacggcgacgccgccaacgacgggtcggcctcggaaaaggccagggacacgcagtggcccatcatcaccggatatggcgcgtacgtcgacgaactgccgcaactcgtcagcggccatcaatggatgaccgccgtcgaggaccgcaagggcgccgcgacgcagctcgcgcagatgtgcctgaaaatcaatcagggcacggcggtgaaatcgccgcagaacctgaccaaggggacgtatccgggcgtcgcggggaagaacatgccgacgctgcgccccgacctggtcgcggtcagcgcgtcgaacctcaagagcacgctgatcgaccccggctacatcactctggccgacgcggggatgtgacagacgcagggattgcgcgtcacagggaatgtagcaggcgcggcaataccgggatgtacgcgagtcggccgtcaccccaaccatccgtcatgatgacgggaaccggttgaggtgacggccgactcgttgcccggctggacttcctctcagcggcccttcggggcgtaaatgcgcgtgtcgatgagttcgccgaagtggtcgatcaccgcttgacggcgtgccttcatgctggcggtcagcaatccgttctcctcggtgaacggctccggcacgatctcgaatttgcgaatcgactctgcccgcgacaccagatcgttggcagcgttgaccgcgcgctcgacctcggcatagacgatcgggttgcgcacggcttcggcgaggtcggagacctgctccacaccctgcgcggccagccaggcgttggtctcatcgagatccaaggagacgatcgccgcgatgaacggcttacggtcaccgatgacgacgcactggtccaccaccggcgatgtcatcacgctggcctccaatatgcccggagacacgttcttgccgcctgccgtgatgatcaggtccttcttgcgtccggtgatggtgacaaacccgtcgtcgtcgatgtcgccgaggtcccccgtgtgcaaccatccgtcaacgatctggctctgggtgatttcaggatggttatggtatccgacgcagaccgcacggctcttgatgcatagttcgccgtcctcgccgagccctaccgacaccccctgcagcggcaggccgaccgtgccgatgcgatatcccttggttggattcaccatggccggggcgcaggtctccgtcatgccatacccctcaagcagcggcagtccgacaccgttgaagaagtgtgcgacggccccgtccaggggagcgcctccggacaccgcatattcgcagtggccgccgaacacgcccatgatcgtgcgatagatcaggcggtcgtacatggcgtggcgcatccgcagcgaggccgagaacccgttgccctcctgctgcgcgtgcgaccattcgcgtgcggtggccgcagccttggcgaagatgcgccctttcatgccggcacccgccttctgcgaggcggcgttgtacaccttctcgaagatgcgcggcacggccagtatgaaggacggcttgaactcgccgaaatcagacagaatggtcttgaggttgttggacagccccagctccacgtcaccggcaaagcagtacagcaccatgtaccgcgcgaatgcgtgagccagcggaaggaacagcagtagacggcggtcacgcccataggcgatgtcgggcatggattgcgtaccggcataggtgacgtacacgaagttgccgtgtgacagttcaatgcccttcggcatgccggtggagcccgacgtgtacacgatggttgccaggtcgtcacccttcaccagacgctcgcgctcccagaactcctcgtcactcactccgcgcccgtattcctccagcgtgttcagcgcaccgaaatcgatgacgtacacgtctttcagcgtgctgcagcgcgagcggacggactcgatcttgtcacgctgcgcatcgttctcggcgaacgccatcgtcacctgggagtcgttgaagatcgtggcgatctgagccggcgagttggtctcgtagacgggcacggtgagggagccgatggacatgatggccatgtccagcgcagcccattgccatgaggtggaagagatgatcgacaccgcgtcccctggcatgacgccacgggcgatcaggcccttggccagtgcgatgaccttgtcgcggaattcggcggccgtgaacgagcgccatgagccggtaccgtccttgtacgagaccagcggctcgtcgggcttgcgttcagcgcgttcgaccagcactgagaacacgtttttatcgccgtcaatgggcttggtgaccggttgcgtatattccttgagcatttcagcgctcccctcgactgtgggccggtcgttccggcgaacgggtggcatctacatcgccaccgttcaattgtacggcttttccatacgaattcggggcagcatcgccgtcaatcgggtttcaggccgatgcgcatgggtctcacacgggcgagcggatcaagatatgtcgtcgccgtcccctcgttttgcagtcgaaccctcctgactccccaatggaggcatcggccgtcgcaatggtcggacgcccctcccacttcgccgatgacgtcgccgcgtctcacggctgttccggcaacgccctcggtatgcgccggctcgaacgtcgacacaaggtcaccgtggttgacactgacgaccgacttaccgccgacactcccggcgaacgatatgatgccatccgcaggggcatacagttcatcgccgtcggatgcctgcagatccacgccgcgatgcccggaaagccatggccggtcaggtgggtcgaaatccgcgatgacggccggctgacccacaggccaaagccataccgtccgacacgccgcctgtcgccctgcgcataacgtcaccgcggtgaagacctcttccccggcggatgcggagggcacccgcaatagcgcccagttcatcatcgcagcgaacatcacggcaacggacatgcagcacagccggatcatggtccgtttgcaacgctccatgcggcgaagcgcgaattgcctgcgccgtatggcatggcggtcataccgcacccgaggatggtgccatgctccccgctgcccatctaaatcatcattcagcatcagtctctcccccattccgtcgtcggtcgccggaacgtccccgcgccccggcatccccagcatcgcacaccgatgcacggcggagggcgaaaaacgaccgatgtggtcgaaggctcgggagttatccacatttcggcgtgtcgcgccgatactgcacggcacttgctgctggaatcgcctgacaatgcccgatgattcgcgggcgaaaccgtcgataaaccgataatttgcttgtgtctgcggcatccgactgtcagttctcgtcatcaatcaaccattggaattacaggcgacacgccgaggcgagcactcaagttgcatccatgtgatttgtgtgtaatatattcatcttgtgcacagcagttagctcagcacaggaaatcattcctgcgtagctcagttggcagagcatccgactgttaatcggacggtcgctggttcaagcccagccgcaggagctcattggaagccatcggcgtgttgccggtggctttttctgtatttatatccatgagcatctgatcggctttcttgtttccgagcatcatgcgcataatcgcatcgttagacagttcgtccaccgtagtgtcaagatattccgcagccaaaagaacctcttcaaatcgccagtttgcgcgagagatcttgagggacataccggaaggctttatcccgagatagcttgccatctcagtttgatttttgccttctctcgcttgtgcggccagaagctgctgaacgttgaaagaaacgacttttaacttgtatgcggctcgcgccttggggctgacgcccggcattgtttcaatactggtcatttttaacctttacaacaatatgtttacctgttgcaaaatatattacctctcgatttgcgtttagtgcaagtttgtcgtacactttttgcaggtcgtaaaaagtattacaaaaatggaggctggaggtgtgtacgccgatgaatgattggttcaaagaacgcggtatcggccaagagcaggtcgccgccactcttaacgtttccgtctcgaccgtttcacgcatcgtcaactacaaaagagacctcagcatgaggcgtgcgatgattctgcacactgagtatgggattccttttgacgttatgtatccatctcaattgagcgagggtgagggggtgtttgtccgataaggaaatgcccggtctcgatctggaacatcgaaaccgggcgtatgcaacacatccaatgttgaacgattccctagtcgccaaacttttgaatcgttcgcattgccttttagattatggaggctgcacaaatgtctagtgtaaccgaagtcgctgtgccgacttctgattttgatggtaacgcccccgtgaatggttcgcggtgcatggcgtctacattttccgaatccctgtattggcgacgttctgcccggcgctacgagctggcgggtcttgccgcttcgatgctggccgcgttgtcgtgcgtggtttttctggcgattctgcttgccgcgaggaatctgcttctgccgggattcgctttggtgccggtggcctgcggcctggcttgtgtgggttgctggtgcgaccgtaactcgcgtgatgcctgggatttcgctttctggtcccttcacgcggaggtgaggcaatgaccatgaccgttggcgcgcgttccctcgataacgaggagcgctcgaatttccgggactacatgtccctgttgtccctgtccgtggatgcgtcgatgaccgtgagggaggtcatggcggtcgcctatctgatcggccggcatgacgcgcttcgtgacgtgcggaacgcttcgtcgccggctcggacggtgaaccgtcgtctgatccatggcggtccgtcggattgcgtgttcaaccgcggctacgaggccggtgcgggcatggtgtccgacgagatcgacgcgttgatgcgcgacgtggaggccctcagcggcgatgacgcggcgttctcgatgctcaggcatccttcggtgagcgggggtgatgagtggtggaattggtgatcctgctgttcgtggtgctcgcggtggcctgtttcggcctgttgctgccgttcctgcgtctggccgtcggcatcgtgcttctcgtggtccgtctgctggcctccctcgcgcgatcaatgggggcgggccgatgatgcacctcatactcgtgatcgccgtcgttttcgttctcgccgcgtcctatctgctgacgttcgccctgtgccgcgcggccacgcgccgcgacatgcttgaggcccgttggcgtgaggagtcggccggttccgtgagtgaggagagccatgagagcgcatgaaacgcttgagcgtgccgggcgtcatggcggcttcccggcccgtggttccgcttcgggcctgttggcggcctgcccgtcggacggcagccacgacttctacctgtcgatgatgctcgacgttcccgtgccgcgcgtgcccatgctgcgcgcacgtctgcaagactcccgccgagggggtgccgcatgagcgtgaacgcggtcgattgggcgctcaggttcgcgcccgtggacgccaggcacaacggtgccgctcgcgtgctgatgtgtctggcgaacgtggccgacgacgaggggcgcaacgcgcatccgacgcacaggaagctggccgcgtggtgcaagtgcagcgtgagcacggtcaaacgccacctgtcatggctggaagcgaacgggctgatccgtcgcggcgaccaacgccaggccgggcatttcagcgagtggcaccggcccgtcgtgtgggacctgtgcctagggaaccgtctggagctcgaccccgacttcttcgactcgaacgacatcgactcgacccgaggcggacggccttccacggaaaacagggcgaagggaaaccccggctcacatgtggaccgtggttatgtcgacggggacacgggaaaaccccagctcacgggtgaaccacggttcacagctgtgaccccacccccagctcacctggtgagctacagtacgtccctagtacgtaataacccctctgcccctacggggcatctccccgcaagcggagagacctccccggacgatgacggaatccgcgaggacggttcatgggccgacgccgccggagccgaacccccaagcagcgaatcctccggggccggttccgacgcggaggcggtgtgccgcacgatggcggacgggctgcgcgccatgccgccgatgccggtgcccgaaccgttggcccggcccggcaaacgcgaactcgacgccgcccgacggctgatcgcccgccacggcatgccactggtgctggccgtggccgaatgggtgtcgctgccgccttccaagaccgacaagggcgacgcttccggcaaaccgtatgacggtttctggcgtcgcacgctcaccggcccccgctccctcgcacggcactgggaccaggtatgcctccagatggccgacgacccccacgggcgtcgcctgctcgccgaacacggcatcctcgccgacaagggcgaaacggcgcagccgccgagcgcggaatccacgccgaaggtgccgaactacgggatccccgacaacctggaccggcgcgtgttgaaactgctcgacccttacgacttcgatgcgggcaatgacgggttcgaggcaccgcgcaccctgcgccggctgttgaagcgcgtccccgcgaacgatgccgaaggcgaacgcaatgccgtgctggaggcattgcgggcgggccgcgccttcctggacgcggtatccagggagaaggacgacggcttcgggcagcggaagccgtccgggaccgggccggcgtccgtccgtttcggcttcatcggcggccgtgggccgaaggaggtgccggcatgttcctgaagggagaatgcgcggatttccccgactcgtggtcggaccgcatgtgggggcccgacgacctgcccaaccagcgaacccaatacgagctgcgccgcgcggcggtgcggatctgcgaggcctgcccggtcagggccgaatgcctcgcgttcggcatcatggtccgggaccagtacggcatctacggcggactgccgttgagggcccgacgccaggtgctgaagaccgcgcgggaggccggattccggttcgaccccgacgacccgaccgccgaacggcggctcgcccggtacatccgcgcgaaccccgagatcgtggcggcggcacgcgaacgcgaatgcaaacgccgcaagaccgagcagcgcaacgcacgccagcaacgatggcgcgccaccacacgctcgaccggcaaggcgaaggccccggccgccgccacacacaccccgcccttgcaggacaccctcttctgaagacaatccgatacagataaccggtccggccccataaggacgaaccattccggaaacccgtatacgcggcaaaccgtggaaccgtgcacccgtggacacgggaagccggaaacccgaatgaaaggaacaatcccaatgaccacgaacacgaaaacggtggccttcgtcaacctcaagggcggggtcggcaagaccaccagcgccatcggcaccgccgaagcactcgcccgactgggccataccgtgacggtgcgcgacgccgacccgtccggcgcggcgaccctgtgggcgcacaaggccctatcggccggccgcccactgcccttcggggtggaggtcgtcaaccggttcaccgtcgccgcgcccgccgaggaggaatgggtgctgatcgacacgcctcccttgcagaccgatctggtggaggcggcggtggacgcggccgacctcgtgctgctcgtcaccaccaccggccccatcgacctggaacgcatgctggagaccatccggcagatcaacaagccctcctcggtgctgctgacccagacccgctacggcacgcgcagcctcaggcacgccgaggagttcctggccgagaacggactggcccattgcagggagaccatcccgtacaaggaggccatgcgtctcgcgccggacgagggccggttcccgtccgcctcgggctacgggcttatcgccaaggaactcagcgacgcattcaacgcctgacacccgcagaaccggaaacccggaaacccgtgtccacgcaaacccgtggacacggggacacggaaaggaacaacatcatggagatcaacaagccgatgaccacgaggaacatgctggcatcgaccctcaccgactacaagaaaccggtcaagctgcccaagatcacggtggagctcgaccccatgctcaagaaacggttcaaggccgaggccgtgcgacgcggcaccaccatccgcgacatgctcacggcatggatcgaacgcgactgccctcccctcgacgcggcggacgcaagggccgaggcgaagcaagacggaagaaggagtggatgatgacggatgacatcgaggagcgggccgcactggcccgtcgcgggatcatggaccattcggattgcgaggagtgcacggaggactggacgttcctgatgcgtcagggacgacgggagttcccgttgggattacgcacggtgctcgcgtgcctcgcgttcgccgaacgcgagggcgcggtgcccgagctgccggcggattggtgggttagaatcaacaggaggtatcgatgacgacgatgcgcggcgaggggagccgactatggatgcgttcaaggcatggccgggaagggcggaaagcatcgtgatcagccaggagtcatacatgaggtgcaccggcggcgtggccccgtggcgtcgtgacggcgacaaggggccgtcctactacgcggtgtgcccgctgtgcgacaatcccatccagatcgtcggcctgttccgccggcaggaggaaagccgtgcgcgccggccctacgggcgacaccaccggggcgacgtgccgggcctgtgccgctacgacgaggacgcctatctgcactgcccgtatgcggatccgaaccatcggacggacacccgagcgagacgtcatccgaaggaccagaccgggcgggccctgtatggtctcatgcgcggcgagttcgaccgggtgacgctggcgtgggaacggttctccggcatccatctggggccgggggccgcccgtgacatgcttcgcaaatggcgggacgaccagggatggcgctactacgacgcgacctacggcaatctgccgcagatgctgttcttcgcggccggcggacagaacctggtcaaacgctacatcgtgccggacagcccgttgcacgaacggctgaaaggcgtgccgcgggtgagattcacgccgacgcgctcccggtacgtgcaggtggacaaggccgggccggggttccttactctggatttcctgctgtacgcccggcgcatcgaatgggacggacagcacatgaacgagacgttcaggctgcgcggcctgctgggccgcgatgacgggcaacaggccttcgatgacctgaccctcgacgtcgatcaggactggctcccccacacagcggacgcccaacccggccgcgacgagcggctactcgacatcgcgcgggaaacgctgcaatccgacgcgggtatcccggcagatcaataaagcgttatcaatgcaaggagaacaatgatgaacgagaacgacaagacggaaatcctcgaacccgtcgaaacacccgccgagaacatcacagagccaagcaaggatggaaggaagtgtccgaagtggctgccgcccctggtcgcggccgtctgcgcggtgattctggtcgcggccggcatcatcggctggaacgcttacagcggcgcgaagctcgccgaggccaaggaggcgtgcgccaccgccgccgacaccgtgcgcaacaatgccaacgaatacaacgcgctgctcaacggcgatgccgccgctgccgccgccgtcaaggccgaacaggtcaaggactcgaagaccgtcgaatccttgggcaaggagctcacggccatggcacccgaatacgagggctgcgtggccgaaaacgcgcaaggactggatgccgccaccgtgaagctcaatgaacaggccgactggtacgagacccacgagaagagcctgtcgaaggcggtgagggccgtcgccgaatccaaggccgcgaagaggctggatgacgcgaaaacgaatctgacggcgaagctggacgaggcgtcgaagctgcttgcggattcggacggcaaggtcgcggacaacgccacccgcgacgcattgtcgaacgccatcgacgcggcgaacgggctgaaggacgggaacgatccggcgaagatcgacggagcgcgcaaaacgctggaggatgccatcaacggcgtgaacgcgagcgtccaggcaaagacggacgcggatgcgcaagccgccgcagcggccgcagcggcagcccaggctcaggcgcaggcccaatccacctacagcggcgtctcctcctactccggaggcgcgtacaggcgcacggaaggctccacttccggctccaacacataccgtggcaccacatcgggcggctccggcccggccgccgcctccgccccaaagccgaacctcaacggcgcttacggctgcggcaacagctgcaccggcaaggatgatggctattaccatcactgatcgatggatgactgattatggctcgtatcgggaaaccggtacgggcctttttcatggatttcgcaaaggaaagccatgtccctgtgaacctgtgtcccccgcattcccgtgtacccgtattgccgggaaatacttccggattttttgtagacgccatgctccgtggttcggcgtgtcgtctgtgaggcttgttggtggctgccgggccaaccggtggctacctcccgttattcctgcggtcggaagccccgccaccctttgaaaaaagaggcggcggggccatgaccggaacgattgagggaggggatgaacagacaaggttaacggaggttcatttacatgaactttggcaggaagatgatgaaggccggtgtcgcggcggtggctgcgatcgccacgcttggcgccggcggcgtcgtcgcatcgaccgcgttcgcgggcggtggcggcggcaaccagcccggcacgggcggcgacctggccgcggtgcagttctggcaatacaaggacgatgcttcgggcgcatggggtccggccacgagtcttgattcggtgcgcgccgccatgaacaatgccggcgtgacgttggagggcgatggcgtcacgaaggcgcaggccgcattggaccaagcccgtacggaatgcgagaccggtttccagcggcgtcaccccggcgagggcaacggcgactgccgagtggtcgcggtcggcgcggtgccagccgtcttcggcggcaactacatctacaacgggtccggcgtggcttcgccgaccgggaccggcggctggtacgacaactggaacacctacgtagctccaggaacataccagtatggcagcaccgtatataggacctcatatccgttcgatgatgatccgtcgaacagcgtggatgcgattatgcgtcgtaatgtggaggcttccagcaagccctcgatcgtggtgatcgtgctggacaagtaccagccggcaccaccgaactatcacttgagcgtgagcacgcaggctgcggagatgtcgggccagtcgggcgacaccaaggacgcctcggatgtgatcaccctgtccagcgacgggtcgaagaccgagaacgtgaacggcaccgcgaccctgcactggcgtggcatcgacggcaccgagaagacggtggcgaagcggttcaccgcatccaacaagggcagcgccacagtgagcgcgtccttcaaggacatggacgcctcgtgggagtcgtggcctgcgggcaagcgctggtgggacgttgacgtggcgaagcagggcaacatggccgaggcggtctcccacaagggagagcacgacggcaaggagtccggcgagaagaccaccaccccgcccgagaaatggctgaccaacgaggccggcgacacgctgacgcaccgtcatgacgtgcccgtgccgtcccatgacgtgccgtcccatgacgacaacgactacatcgacaactacatcgcctccggcagcctgtacacggctcacatcaaggcgcattccaacgcctccagcaagttctggatctatgacttcatcgtcacgaaggacgtggtgatcggcggcaccgacaaggacgacgtgagcaaggtcaacgtgaccgacgcgaacggcaacatcgtgccggcggacatttccatcgacgattccatcgatggcaagcgcgtggtcaaggcgcacgccaccgccccgcattccggcctctacacgctgaacgtgccacagtcggccaaacccaccggcggcgactacgagatcaacgacggttccgtggcgtgctggaacggagacaacggcaccggcagcctggccgactgccagaccggcaacagcgacagcgtgggcaaggtcacgccgaccccggacaaggtgtgggtgctggacgagtccggcgctctcgtggccgaggacaagcaatggaccaaccagcagggcgtcgatcagaagacgttcctcgtgggcgaccaggtgggcgtggtcgtcaacggcagcatccccgcgcacctgctcaacccgctggcatcctattccatcaccgatgatctgaccggttcgaaccagtggatcgactggaagtccggcaaggtgttcgtcgacggcaaggacgagaccgcgaacttcaccatcgcgatcgaccggaaggccgggaccgcgaccgccaccgcgaagtccgcctacatcgcgaagacgatgttcaggaacagcgcgagcaaggtcaggttctacctgacgggcaccatcaaaaagggtgccaccgagggcaagaagatccagctgaccaacaaggcgtacgagaagtggaacaacgagacccgaccgaccaacgagccgccggtgttcgtgtggacgcccaaccccaacaaggcgtgggccatgaaggtcggcggcaagtggcagctgaccgtcgatccgaccaagaccgacaaggtgggcggcgacgacaagtactaccgtccgcggccagcacaacgaccagcgcgaccgcacggcgacgacggtacatcgcccgtcgttgcgggctgacgacgcgcttgcgcggcttttgccgcgaaccgggtcgcggctgacgggtgggctgagtgggcatgccgtccagtctacctcaggcacgctctcaaaactcgcagatagaggggttttcggggataaacccctctatctgcgagttttgagagcgcacttattggggtaaccgcaacgaaccatccgggagcatgtcgaccaggccatcgtcgtcgagggaggcgatgcatttgtcgagctggacgtgatccggccacagggattccaggcgttcgcgggcgaggattggctcagcgcgcagcgcgtcgaggatgatgccgcgcacctgacggtcggtgccttggaaacgctggcgcgggcgggtgcgtcgctctcccagcccggggcggcccgccgcgaggaacgcgcaatgctcaccgatcgggcactggtcacacagcgggttcttggccgtgcacaccagcgcgccgagctccatcacggactggttccatatgaccgacgggcgggtgctgcgctgtgtcatctcgcggattgcggattcgggggcattcaccgtctcgcgggcattcgcggcttcgatggcatcacgaacgtccgtctcatcatcctgcggaaggaccctgccggcgagcgcccgctcggccggactggccgctcccccgcgcgattcgactccgaggaatacgcgcgacagcacccggcggatgttggtgtccaccaccgcgatgcgcacgccgaaggcgaagctcagcaccgccgaggcggtgtagtcgccgatgcccggcaacgcggtcagctcgtcgtaggtttgcggaagccggccgtggtattgctcgaacaccacgcgggcgcactcctgcagccgcaacgcccggcgcgggtagccaagccgcccccacgcggtgatgacctccgccgtggaggcccccgcgagcgcggtgacgtccggccacacgcgcatccagtcagtccagtacggcaccacccgactcatctgggtctgctggctcatcacctcgctcaccagcacgccccaaggcgtcgcgcgcccgaatcgccacggcaggtcgcgggcgttggcctcccaccatgcggacagcagcgcccgcacgcgaggcacagcgcactcgcccacaggttcggccggcgtatcgttccgtatctctggcatcgctccattgtgcacggcgaccgctacatcatcacggcgccgcgcgatttcgccgattcggcggcacaaccttacctgcaacgggtcgctcgctgcgggtaaaagcattcgcccggattcggcagagtgtttgtgggcccgcaagcgcagggcgaatcggccctgcatcaggggcacggcatgggaacggctggtctcataccgcggctgtccgccgtagtagaagttgttcttgttctgccaggcggcgtcgccgttgctcactgcggtcagcccctcggtccgtgaggcgggggcgatccggtacacgccgctctcggcgccgtccaggtcgtcgaaacgcgtcaccggctgcccctcggattggtacacgcgcacccagtcgacgaggaaattgctgtcctgcttcgtgtcctgcttcgtgtagtcgatgtcgccgacccagccgtcgccgacctgcgtctccagaatcgggaacatcggtcgcgaatgcatgccgtcgacgtccttgccggccgacgtgggcgtcgacgacacgcctatgcgggccagcggataggtgcccggcttgagccctcgtggatgcggcagcggttcttgtattcgaactgcagccgccgctcgccggtgctgttgtgcacggcgtagttgtcgtcctgcttgccgtcgctgatcgccgcgatgttggtcggggcgaggccgtacacatacggcaacttgccgagcgcgatgttgcgcgtctcctgcgcgtccggcagggtctcgccgtccttgagcttggcgatgacctcgatttcgcgcaagcccacgccgttgctgtatcccttccatgaggagttcgtgttctggatgcaatggcccttctgccagatgcgcacgtaccgcgcggtgacgggcgtggtcaggttgatggtctgcgcggcgagcttggtcgcggcggtttcctcgacgtcggcggtgccgaacagcacgttcgcgtcggagaagtcctcgttggaggacacttcgaccttgatgcgcttgaacgtgttcagcgcgttctcatacccattgcggtacaggttgatggagtgtatctctctcggctcgccgaaatcatattgcaggtatacgtcgtcccagctggcgtatccgttgttttccgcgctgccgttctcttctccggcgatgattttggtgatgttgctgtcggtcgggccgaatccggtgtcgccgtcgccgatcagatgcgtgctgttggtcgtgggcagtttgccggtaagtatgttgcctgtggtgggttcggcggccaccgcgactgcggctgcaaccgaaacggccaacgcgcatgtggcggatatggtcgtgatacggcggaataattgtctcatggtctctccttcgagcagctgttacgggtatgggctgttttaagctcgaaggtcgaagacaaccggcagagacaaggcgggatgatgagcgaaaccaagggtgcggaagaggccgaggcgaaggtcgagaagatgttcgagtacggctaccgcaagtcgaattatggtcccgacgagctggtgaccgacgcgcacggcaatccgatcagcgttgtggacgcgatgctgtcggccgagaaggctgccgcgacggagacggtcacgccgcatctgtgctattacagtccgcgcatccccggcaataccgggtcggcgattcgcctgtgtgcggtgaccggcaccatcctgcatctggtggagccgctggggttcaatcttcgcgataccaagctgcgtcgtgccgggcttgactatcatgacatggctcacgtggtgttgcatccgaacttcgacaatctggtcgagtcgatgccggattcgcgcatcatcgcgttcaccgcacatgcgacgaaactgtataccgaggtcgagtacaagccgaccgacattctgctgttcgggccggagccgggcgacattcccgacccgatggacatcatggccggcccgcacgtggccgagcaggtgcgactgccgatgcgcccgagcctgcgcagcctgaacctcaccaactgcgcctccatcgccatctacgaagcctggcgccaactagggttcaagggcggagcgtagggaggaagcccagtgggcttccgagtagcgacgccgagcgaacgccgacaggcgcgagcgaggaaaccatgagcctcgcgaggcaaaatcacaattgccggcagtgcgcgagcacgaagtgcgtcactgtgcgtggaagtcgtcactgtgcgtggacgcacactcagtgacgattcctgaaaaacattgcaatatcaagggtttgccggtacgtcactgtgcgtgggcacacgcacagtgacgctgcccacgcacagtgacgcgttgttagcgtatgtgtagccccttatacctcgcaatccatgacgatttccacgtcacgatgcatttcccggtcggcatgaagccctcggaggcgtggtttaaacagcgcaaccattccactcaccgcttgaatcaatatccgatatatcttgtctcgatccatgagacaagtcgcggattgcgtgccataccagggcaaaaacacccatttttgccttggtatggcacaggcgatttcggcatcaattatctacggcatacggtttcggccattttccaacaatatcgcgaaacagccaactgccacgacatggattctaagcgcttacatctcattctgtggcacaaattgtgccacactaggctcaaaacacccattttcgccctggtgtggcacacaatcgaggacgagaccgctccataaatcacgcccggccatctgcgaaccccagccgagcccacgaccatgtcagagccgcgcctggtacagggcaaagtcagcaaggcggcgtgacgacaacatctaccgatgcacgtcgaagacccacaaggcccacgtctcatggtcatacggccgcacgaacacacgatgtttgcgcaggctcttgcggccggaaaggcctctcatgaatccacccaatttgacctcgccattgcccggtctggcctctcccgcagggccggccggcaacgagcgaatcacaacgacttgcctggtatcagactgcacggccatatcccagctgtggcagacgcgaacccggtccagatacgccggcaaagcccgctgatcccaccatgcgtcttcagtccacaacgcgtagcgcagcggaatatcccggcgcccggatgcggcgagcacgccaagtatgcggggactgtctgagacgatgacggcattgcggtgcacgttcccgccgacggccttcacgatatagtcggcaggcatatcgtcgccggatcatagatgttccgcgcaccctcgcccatcagcggataatcgatcagccggatcaacgtcattgggaactcgaaatgaatccaataccccgacgacacactgcgcacctgcgacagcatctgcgcgatccacggcgcgtgcgcatacgacggcgagcacgatcgcattgatgatggtcacgacgagcaccgcatagtaatgcaggtacgcgccggcgagggagaacagcgcgaatccgatccactcgttcacgcgcacgggcccactgccgcgcgccttgatgcagatgcgcatcgcgaacaggaagcacatcgcgacggccagcaccgcccatgagtacatgcgaatctggaacgccatgcgcatgaacggcggggcgaagcacgccaacgccgcgaacagccgtgcggcgcgcgctccccagtcccggcgctcatcgcgtatccggcgacgaccagtgcacatgatgccgccgccgacatcagacggtacgccaccacatgttcgccgaacacgagccgcaccagattgagcagcatgtagtagccgatcggatgcacgtcaagcgagcccagattccatatgccgctccacccgtgcgaggtgagcgccaccgaatagatccgtcataccaaatcgcgtggccgaacgcaggaatcagtaggtacgcacaaccgacggccagcaacggaaccgcactacccgtcagcagacggcgcaggcgacacggaggcacggacggcacggcagcggagaacgggacggatgccctatgccggatgaggccaaatcggatgatgcttgtgtctgatgcacgtcatgcgccttctgccgacatcataaattcaacgtcgtttttctctattcccctacgctgcaagtgtatgcacagtaacctgatgcccagcaaattccccgccgatattcatcagtactccactgctggaatcggcgacggggaggggaagaaaacgtcaggcggcttggatggggataataatgaaagcggccgttcccgcgcacatgcggaaacggccgcttgagatatcggcactatcagctcagcgatatcgctgcgacaccggctcaccgaggagcgccgcgcagcccgtcagttcttgaagctgtggatcggggccgggatacggccgccgcgggtcacgaacgcctcgcagctcgtctggttcaccggcatgatcggagcgtagcccatcagaccgccgaagttggccatctcgccaacgcccttgcccgccacggggatcacgcgcacggcggtggtcttctggtttaccatgccgatggcggcctcgtcggcgatcatgccggagatcgtggcggcgctggtgtcgccggggatggcgatcatgtcaaggccgaccgagcacacgcaggtcatggcctccagcttctccagcgtcaggcagccggatgccgccgcgtcgatcatgttcttgtcctcggagacggggatgaacgcgccggacagaccgccgacgtagctcgacgccatgatgccgcccttcttgacctggtcgttgagcattgccaacgccgccgtggtgccgggagcgccgacctgctccaggccgatcttctccagcacttcgccgaccgaatcgccgaccgcgggcgtcggagccaacgacaggtcgatgatgccgaacgggatgccgaggcggcgcgaggcctcctgcgccacgagctggccgacgcgcgtgatcttgaacgcggtgcgcttgattgtctcgcacaggaactcgaaatcacggccgaccgccgcgtcgagcgcgcgagacaccacgccggggccagacacgccgacgttgatgaccgcatcgccttcggtcacgccgtggaaaccgcccgccatgaacgggttgtcgtcgggcacgttgcagaaggcgacgaacttgacgcatccgtaggagtcgttgtcggcggtgcgcgcggcgatgtccttgatgatgtggccgagcagttcgacggcgttcatgtcgatgccggtcttggtggagccgacgttgacggacgagcagacgatgtcggtctcgctcagcgccttgggcagcgagcggatcagcagctcctcggcgggggtcatggacttcgacaccagtgcggaatagccgccgatcaggtcgacgccgactttcttggcggcacgatcgagcgcgtgcgcgatcttgacgaaatcgtcctcgctcttgcatgagctcgcgccgaccagcgagatcggggtgacggtgatgcgcttgttgacgatcgggatgccgtagtcccgctcgatcgcctcgccggtggcgaccaggtccttggcgtaggtagtgatcttgtcgtagatgttgtcgcacaccttgtcgacgctgtccgccgcgcagtcaagcagcgagatgcccatcgtgatggtgcgcacgtcaagcttctcctgctcgatcatctggttggtctcacggacctccatgatattcagcatgattcgttcctttcgagactcagacgcggtgcatcttcgtgaagatctcctcgcgctggcagcggatgcgcacgccgatctgctcgccgagcttgtccaggtcctcgacgatcacgccgaactcgttgtccgcgccggagtagtcgacgatcatcatcatgttgaagaagccgtcgatgatggtctgtgagatatccagcacgttgaccttgtgatcggacaggtacgtgcacacgcgcgcgatgatgccgaccgtgtcctggccgacgacggtgatgattgccttgttcatgggactcccccgctcgaaaccgattactgcaagtagtgtcaagtatatggagcgggcgtgaaatactgccgaaccgtccatttgggcgtgtccgcaggccatcggccgaatccgacgtcggcattgttcacgcggggatcatccaggcgcaaacagacaatcgtccacaatgtgagcagtattaccatcgctttcataagtcgactacacctttacatcaagcacagcggtgtgtgagcgcatcgctggggccacaagctcgggcgacgacgcccacgcaccccgctacccgcgagcatatcgaccacgcaccgcacaatcggtcgcggcgtcggctcgtatcagagattgaatgaattagaggggttagactttcatgtctgctactgctaccgcggccgtgtccaaggccggcgcggtgaagaaggactcggttcccgagatcatcgccgcctccatggtcggcaccgccatcgagttctacgacaactactgctattccatcgcagccgccagctatttcggcactattttcttcccggccgcatcgaaggccaatccggcgctgggcacgatgtacgcgttcctgacgttcgccgtctcgttcctcgcccgcccgttcggctccatgctgttcggccacttcggcgacaagatcggccgcaagaccacactggtcgtcgccctgatgacgatgggtatctccacgttcgtcgtcggcctgctgcccggctatgagcagctgggcgccttgtccatcgtcatcctgtgcatctgccgcgcctgccagggcgtgggcctcgccggcgaatggtccggtgccgcgctggtcgctaccgagaacgccccggccaacaagcgcgccctgtacggctccttcccgaacctcggcgccccgatcggcttcttctgcgcctacggcctgaacctgctgctcgactccacgctcggatccacggccatgcaggcctggggctggcgtatcccgttcctgtgctccgcagtgctcgtcatcatcggcctgtacgtgcgtctgcgcatgaccgagaccccgatcttccgcaaggcagtcgagcaggaccgcgtggtgaagcacccgctgcgctcgctgctgccatactggaaggaagtgcttctcggcaccttcgccatgggcatcacatactcgctgttctacgtgctgggcacgtggtcgctgagctacgccgtcaaggtcatgaagccacccttcagccagaacgaatacctggccatgcagatggtttccgtggtgttcttcgcgatcttcatcttcgtgacctgcatctactccgacaagctcggccgcaagaccgtgctgatctccaccacgctcgcgacgctggtgttcagtctgttcgccatgcagtccctgcagcacaacgtcctgaccgtgatgctgttcctgtgcgtcggcttcgcgctgatgggcggcctgttcggcccctgcggcgcctacctgcccgagctgttcccgactcacgtgcgttactccggcgccggcctgagctacaacctcgccgccatcctcggcggtgcgttcgccccggccatctccaccgcactggtcaagtcgaccggcgccgtcgagtccgtcggctggtacctcgccgtgatgtccttgctcgccctgatcgccctgttcctgatcaaggaaagcaaggacgaggattacgagaagtgatctgagatagataaaaaagggagcggcgaaatccgctctcttttttggttgtcgcagcgaacggttctcaataagaaaggtgcgagcctcatcgcgcgcgaaacgaacaaaacaatcggcggaagtccggaattccgggcttccgccgattgttcatatgtgcgcttttgtgaggaatcctcgcacgtttcttattgagaaccgttcgctgcgataatcaggcctcgcgactggcgctgggcgcggcaaccgccggcagggcgcgcggcgcatggaagccacgagcctcgaactcgtcggcgatcttctgcgcgacttcctggctgcgacccttgtcgacgagcgcgatgatggagccgccgaagccgccgccggtcatgcgcgcaccgtaggcgccattcttgcgggccacatccaccgcgacatccagctcgggcacggtgacctcgtaatccgcggcgagcgaatcatgagaggcgttgaacagacggccggcggcctcgatgtcaccctgggcgaacgcacgcacgaaggagcgcacgcgctcgatctcggtgacgacgtggcgcacgcgcttcttcatcgtcacgtcgggcagggcatccagcgtctccttgagcgcctggaactggtcgtcggccttggagatgccatcggcggcgacgcgcagattggcgacaccgagaatgcgggcggcctcctcgcaggtggcgcgacgctgggcgtactggccgtcgttgagctggtgcggcgcctgggtgtcgaccaccagcagctccagaccgtacttgtcgaggtcgaaggcctgctgggagacgttctccagcggggtgagctccggacggcagtcgagcagcagcgcgtggccttcggtgcagcgcatcgaggcgttctggtcgaggccgccggtggaggcgccggccatgtcgttctcggacttgatcgcggcgttgatcagcgtcacgcggcccgcgtcggaggagccgtagccgagaccatacacgtcgtccagggccagcgcggtcgagcaggtcatggcggcggacgagctcaggcccgatcccagcggcacgcaggacacgaacgcggcgtcgaagcccttgacctgcgagaaaccggcctcgcgaagggcccaggccacgccggtcgggtaggcggaccagccgtccacgccacgggctttgaggccgtcgaggtcggcctcggcaaccttgtcgggcgccacgtcggagacgacgcggactttggtgtcctcgcgcggcttgagcgcgatgaacgtgcggtgcggcagcgcgatcggcaggcacaggcccgcgttgtaatcggtgtgctcgccgatcaggttcacgcggccgggagcggcccacacgccctcgggcgcggtggcatacgtatcgacgaacagctttgtcgcccgtgagacaccatcctcgcgggacaacggctcaatgaattcaacagcagtcattggtgctctttcttctgtgtgatggctatatatgcagtggatattgctagggggagcccggttcggccagactcccccatagaacgttgtcagtcggagatgtcgatctgtccaagctcatggaagcgcttggcgatgagctccggggtggtgtcggagatccaggcggccatgccggactcggagccggcgaggtacttgatcttgttggcggcacggcggaacgagaagaactgcaggttcaggcggtagttctcgcgacgcgcgtcgtggatcggggcctggtgccaggcggcgatgtacggcaggtccatgcccttgccgtcgcccttgtcgaagaaagcgttgccgcgcttcagaaggtgcgagtacatcgaggcgaggtcccagcgctcctggtcgttgagctggtcgagggtgagcacgtcgcgcaccggagccacatgaacctcaaggggccagcgggcggcggccggcacgtaggcgacccagctgtggttgcgcatcacgacgcgctcctcggcttcgagctcggcgttcatgatgtccttgagcaggttgccgccggtcttctcgtggtaggcctcggtgtgctggagttccttctccatcttcggggcgatgaacgggtagcagtagacctgtccgtgcgggtgggcgagggagacgccgatctcggcaccgtggttctcgaacgggaagatctgctcgatgccttccatcttggagatctcggcggtacggaaggcccatgcctcaacaaccgtgcgcaggcgggacaccggcaggtcggccggcaggccgtcctcgttcgggtcgaagcagatgacctcgcagcggccggcggcgagcttcttctcccacagcgggttgccgtcgacgtaggtgacgtcttcggagacaccgggcacacgcaccatcgacgggaaacggttctcgaacacgacgacgttgtagtcggtgtccggcacctcgccgtcctggtacgggtcgccgggcttgcgcgcggccagcgggttgcccttggcggtggcgccggggccggcggtgatcgggcggttcatgcgggcggtggccatcgggatccagtcgccggtcagcgggtcgcggcgcatctgcggggcggcgtacggcacttcgttgccgtcggcgtccaggtgcggggcgaagcggtagtccagcgggcgcgggtccttgagctcgcgggtcttggcgccggagacgtattccggatcgtcgtcgagatagaagaagtcgcgtccgtcggccagcgtggtcggtgtgatgcggatatgctccttcgcatactctcccggggtgtagttggtgatttctgccatggtgtcactcactttcttcggtgtgttcgctctggtgcgccagaacgagttcctttaccaaatcccttgtcttggcgatggactcgtggtcgaggccatcgtcggtgatgaccgtgtccacctggtcgaaccgggcgaacaacgatagtgatgtacagctccacttggtgtggtcggtcaggatgaccgtacggtcggcgatgcccatcatcgccatgtcggtggccgcctccagcgagttcggcatgaggaagccacggggaatcgacacggaatgggtgccgagaaacacggtgttgacgcgcagcgacgcgatgaccttgtcggcgatcggcccgaccagcgagttcgaccgcgtggtgacgccgcccgttacgatcacctccacatccttggattccaacgcctgcacgagctcggcgaccggaatcgagttggtgaggatggtgatgcccgacgcctgctggctttccagcagatgctgcgcgaacacgtaggccgtggtgccgcctcctatggcgatcacatcgccgggggccacatattgcaccgcttcacgtgcgatggcgtccttgagaccaatgtccatctgcgactttacagagaacagcggctcgctgagcaatgcgctggtgctgacggcaccgccatgcacgcgtttcagcagacctttgtcagagagatcggcgatgtcacgtcgaatggtcatcgcggaaacgccgagctccttagacaacgccgtgatgcgcactgcgccgcgcgtacgcagacggctcagtatcagatgttgacgttgtgaggatatcatgtgaacattatcgcacatgttcgcgcataaaccaaaccaatatgtgcatttcgtaatgtttgacatgcgtgttgcgcacattacttccataaaaacgaacaaaacatcacttttaccgcactctcccccacccgccggatccgaccgcacccacgcaaccgcatcgttgccgttttttcgcgtgcgtgacacaatggagggcatggcttatgtttcggaaaacttctggcacgacgcggtgaacaaagcaaccaccgacctgttcactttcggttacaagaacatcatcaaacccaatttcgtcttcaaccacacccccgatgtggcgcacgaccagatgatcgagttctgcaacgtcaccaaacgcatcccgccgctcatgtggctgcttcgcgagatgctcgactacaccgaccccgtgctggagaccacagtgatgggcgtcgacttcgccaacccgttcggcctgtccgccggcctcgacaagaactgcgacatgccggtgctcatggacaacgtcggcttcggcttcgagacggtcggctccacgacctcccgcgccagcgccggcaatccgaagccgtggttccaccgtcttccggaatacgattcgatgatggtgcacgtgggccttgccaacgacgggtccgacaaggtgatcgaccgcgcggagcaggcgtggacgaacgcgaagacgatgcaggtgtccgtctccatcgcacgcaccaacgacgacaagtgcggcgacctggacgaaggcatcgaggactactgcatctccatgcgccgcgcggccggacgcagcgccatggtcgaggtcaacgtgtcatgcccgaacacccatgccggcgagccgttcaccgccgacccggacgcgctcgaccgcctgttcaccgagctcgacaagatcgaacgcccgcagccgacgctggtcaagatgccgctcaacaagacgtggcccgagttcaaggacctgctcgacgtgcttgccgagcacaacgtgcaggggctgagcatcgccaacctccagaaggaccgcaccggcctggagattccgcagcagtgggagggcggcctgtccggcggcccgtgcacggtggccagcgaggagcgcatcgcgcaggtctaccgtgaatacggcgagcgtttcgccatcgccggcatcggcggtgtgttcaccccgcagcaggcatatcgcaagattcgcaacggcgccagcctggtcatgttcatcagcgcactgatgtaccgcggaccgcagcagatcaccgtactcaagcgcggcctcgcggcgctcctcaagcgcgacggcttcgaacacatcagcgacgccgtcggcatcgacgcctgatcgacacagccgtagaccacctccagtcatgcgtagcatgactggaggtggtctacgtttatctgccgctcagtcctcagggaaggcgccgcggatgtactgcggctggtagggtgccttggagacgggcacgccgagcttggcggcggcgcgcagcggccagtacgggtcacgcagcgcggcacggccgatctcgaccgcatcggcctgccccgcacgcagaatcttctccgcctgcttcggcttggtgatcaggccgacggtggtggtcggtattgcggcgcgttcgcgcacctgatcggagaacggcacctggtagttggccttgaccggaatgctcacgtcggcgatgatgccgccggtggacacatccatcaggtccacgccgtgctgcttcagcacgcacgcggtatcgaccgtctgatcgagatcccagccgcccgcggcccagtccgtggccgaaatgcgcaccagcagcggcaccgtgtcgggaatcacctcgcgaatcgcatcggcgacctccagcaggaaccgcatgcggccgtggatatcgccgccgtactcgtccgcgcgctcgttgcacagcgggtcaaggaactgcgagatcagatacccatgcgccgcatgaatctcaatcgcctcgaaaccggcccgcaccgcacgctgcgcggcatcccggaacgccgaaaccagaccgtgaatctcttcgacgctcaacgcgcgcggatcggtgagcccacagtacgcgatcgggctcggcgcgaccgtacgccatccgccggcatcctcgggcacactcttcccctcgaaaccgacgccgaagcagccggtcgaccccttgcgtccggcatggttgagctgcacggccgccaccgcgccggcctgcttgatgccgtcgacgatccaatgccaggcggcgacctgatcgtcgttccacagtcccacatcgcgcggcgagatacgcccgtcggccgtcaccgcggtggcctcggcgatgatcatgccgaatccgcccatcgcgcgggacacataatgctggtaatggaacggcgtgggcttgccgtcccgcgccaccgccgaatacgtgtccatcggcggcagccagatgcggttgcgcatggtaacgccgcgcaacgtcatcggctggaacagctgcactccccctttgccgcccttggccttcttcttcccctcagcgttcatggtcgtcctttcctcgacaattcgcatggctcccaatccgcgagccgggaagtcgggatgcttccaaaccacggcgaggcaaccaccggtctaatcatctcaccgcgcacagactcaagcacgactcgtgcaccgatgttctccgcctgcacaatgcgtcggaaatcgggcaggggccgtatgagcgttcatgctcatacggcccctgcctcacgcggcgaaccgccgctttcggtgcatcggcccgccggctcagctcaccggctcagctgccgaaccaccgcccgtcactgcccgccggtggtctggccgccctcggtctgattgccgccggtggtcgtgtcgttctgcgtctgcgtgtactggccgctggtatcgcccgttccgccggttccgctggtcgtcccgtctgtcgtgttggtactcgaccttgacgatttcgaggtcgaattcgaggtcgccgcgtacttgcttgacggcgtgccgtaatcgacgttgggcgcattgatcgcggtgagatacgtgtccatgaagttcttccacgtcggggtcgcgatataggaaccgaaccatgtgcggtggtatacgccgttaatggtcttgttgtcgaagtcgctgttgccgtcggcgttgcccacggcgacgaacgcggcgatctgcggcacgaatccgcctgtcagcatgtacgtgttctcgttggtaccggtcttggcgaacgtcttgcggttgttggcgagctgggcggtcctcgcctggccgttggggcgcacgacgccctggttcatcgcgtaggcgacggtttcggcgatatccgggtcgacggcctgatggcagttcgccttgggcacgtcaagctcggcaccggtggcgtcggtgaccttcttgatggcgatgggcgtgcattcgacgcccttcgcggcgatggtcgcgtacacgttcgccatggtcagcggtgcggcggacaccgtaccaccgatgaccagcggggcctgataggcgccgccgttcgcggtgtcgtccttcagatgcatgttcatcttctgcttggacgcctgatggaagcccatgtcctcggcggcctgcgcgatgggttcgaggccgatgaccttcgccatggcggcctgcgtggtgttgtgcgagttgaccagaccgtcgagcggggattccgcgtatccgggcgtgccgccggagttcttcacgtcccaggtattgacgccgcggaagccgggaatgtcacggtataggttcacgacgcccggagccggcagcacctcgttgatcgagtgccccttgcgcatccaggccaccaggttgatcggcttccatgtggagccgaccgggaagccgctaccgccgccgtctatctggtccacggcgaagttcatggcggttctggccggatcgttgttcgcttccggcgacgtgtcgtatatcttgttgatgccgaagccaagcacctcgccggtgccgggcttgatggccgccatcatcacttccatcttgctcgcgtcgtccgccgggatggccgcacgcgcggccttcatcgccgcagagttcgcattgacgtccatcgtcgtgtagatgtcgaggccgccctcatacagcagcttcttgcgctcttcgatggtcttgccgaactccttcgagttgaggatcttcttggtgacgtagtcgcagaagaacgccgcgtcgccggacgcgctgcaccccgcctgcgcatcctgcagtttcagcgtgtccttcagcggcttcgccttggcctcgtcacgctgcttttggctgatgtacttttcctgatacatcaggtcaagcacgatgttgcgctccctctgtgaggccttctggttgctctccaccgaggggtcgaaggccgccgggttcttcgtgattgcggcgatggtggccgcctgcacgatgtcaagcttgtcggccgtggtgctgaagtatcgtcgcgcggccatttccacgccgtaaatgccacggccgaactgcgcgatgttgaggtagccctgcagaatctccagtttcgaatacgtcttctccatctgcacggcgatgagcatttcgcgcagcttacgcgccacggtctcctcggatgcatggtattcggcgatcggatcgttgtcctcctgcgcctgcagcagcagcacgttcttgacgtactgctgggtcagcgaggaaccgccctgagtggcgcccttcttcacgtaggtcgccacgaacgcacgcatcacgccctggatatccacgccggcatgccggaagaaacgacggtcctcacgcgagaccaccgcctggcgcatcggcttggaaatcttcttcaatggcacgacgatacggttctgcgcatagaacgtaccgatctgcgtcgtaccgtccgacgcatacagacgcgactgctgcggcaggtcggtcacgttgaaatcgatgccctccacctgcagcgacggcacgatggcacgcaccacgttgttcgatgcgaacacggcgggaaggaagaacgcgctggtgacgacgcctccggcgagacagagcagcacatacgcgaggaacagcgacaacacacgttttgcggtcagggatttcttcttgggcatggttgccattctagaggggcgtctctaccgggcacgtcatccgaacgactgattcccaatccctcacagggtactcacaaaccggtcagaagactgtaaaacgaccggaaacaagccgaatcattctccaacggccgctggaacgccgggcgttcaccgcgctcggcgcagccgtcaccgttgcgagcgccgaatcagcatgcccggctggtagatgatgatcgaccggccctcgcgcgcgatccaccgacggttcgcgaaatccatcagcgccttgttcaccgtctcgcgcgaagaaccgaccaactgggcgagctcctcctgcgtcaggtcatgcggcaccttcagcccggcttccaccggctcgccgaaccgcgcgccgaggttgagcagtgtctttgccaggcgggcgggcacatccatgaacacaaggtcggatatgcgctcgttgttgccgcgcatgcgattcgccagcacctgcagcatgtcgatggcgacgcgcgggtgctcgttgagccacgcgaacaacgcgtcatgctccagccatgccacgtgcgtgccgtgggtcatcgccacggccgtggcggtacgggggccgccggacgggtcgaatacgggaatctcaccgagcagttcgccgtgcgcgtggatcgacagcagctgcacgcgcctgtccttggattcgcggatcagcttgacgcggccgcgctccagcagatacatgcggtggtccctgtcgccctcgcggaagatatagtcgcccttgtcgaatacggcctcgtgcaggtagggaatcagctcattggcctgctccggcgacacctgcttgaacaacggcgtatgcaacagctcgttgtcctcttcggggaacgaattcggcccgattgccctcatgacgcctcctggtcacgtttccgacataccggcacctcgacacggagcccctgcgatatcgcgacgacggcgcaccatccgccaccgcatccgcatcggcgtcctcgcgacggaatccaacccgtcgcgtctctgtcttcggtcggttctgtcatattgtagcctaatttgcaccgggatcgtccggttgcgtcagacagtccgccagacgcgcaatcagcccgtcgcggctcagaccggtctgggcccgcatcgggtccactcgcttcacggccgatttcacggccttgtcggacatcttctctccggagatgttcagcacgcgggtcatcttcacggcatcgatatcgtaggcgagcgtcacgtggtggagtatcgaaccggggccggagccgatgggcgggaacctgcgctgggccgcgccgccgatcttgccatggctggaggcgatgtcgttgagaccggagaagccgacgtcgaggccgaggccacgcagcgcggcgatcagccacatgtcgcacagacggtacgattcctcgatgtccaggtccgcggcgaaccagcgcggcgcgtacagcgagtacgtgatcgtgttgccgggctcgatgaacatcgcgccgccgcccgtgcagcgccgtacgaccgtgaaaccctccttcgcggcgacgtcttcgtgcacttcgtccggaatcgactggaaccggccgaccaccacggccggggacgcccactgccagaaccggatagtggcagggcgctcccccgcggccacctcacgggaccattgcacgtcgacatccatctgttcctgcggcctgcggggcttgtccacgacgattttcggcgcgagccgatgccagcggtcgtgccactcgccggggaatgtcggcggtgtgagaccgcgggacgcttgaggcgccgaggccgccggcgtaattgtgacagacgaggtcggaacagccgatgcggcggacggcgttgcacgcctgcgcgcgtcatgcgccgtcacggaggcgggcgaagcgaggcgcgaggatgccggtcgcgcggcgtcccggccgcaagccgacagcgcgcggcgcaacgcggtcagtatcgtttccgcattcgcgccggtaacggatacatgctcatcgcgtgcgatgcgttcaagataggagacggtatccggatcatcgggcggcgtatcgcactgtgttatatcacgctgcgctatatcgagaagcgccgcattcagacggcgcagatacctgtcgaccgcggcatcgtcaccttcaacgaaaaaatcaccgtccacgcgacagccgacgacgtggccgttatccggcgcgcacgccactgtcaccccgaccagcttgccgcccgggcgcttgcattccccacgactttcgatatccacccgatacacgttacacgccgaatctgtctgcgtggtcgtctcaaaccccgatacacgaagtctcgctttgctcgacagcccgccagcgggaccgagatataggcccccgctggcgggctgtcgagcaaagcgagactggggtggttcacgccaccgccgcgttacaggcgagcgagaatatcctcgccgacctgatcggtggagcgaacggtggagcccagctcctcgatatcagcctcgaccgccgtgtcgatgcgggccgcggcatcgtcgaagccaagatggcgcagcagcatcgcggccgacaggatggccgcggtcggattcgccttgccctgaccggcgatgtcgggcgcggaaccgtgaatcggctcgaacatcgacggatactcgttgctcgcgttgatgcagccggacgcggaatatccgacgccgccaacaacggcacctgcctcgtcggtgaggatgtcaccgaagaggttgtcggtcaggatcacgtcgaagcgcgacggatcggacacgaggaaaatcgtggccgcatcgatgtgctggtagtcgtgcgtgacctccgggtactcttcgccgacacggtcgacgatgcgctgccacatgtcgccggcgttgacgagcacgttcttcttgtgcaccagcgtgatgtgcctgcgacgcttcatcgccagctcataggcgtaccgcaccacgcgctccacgccgtacgcggtgttgatagagacctcggtggcgacctcggcaggagtgtcgcgacgaaccgctccgccggcaccgcagtacagtccctcggtaccctcacgcaccacgacgaaatcgatgtcgccggggtttgcgagcggcgaggtgacgcccttgtacagcttggacggacgcaggttcacgtactggtcgagcgcgaaacgcagcttcagcagcagaccacgctccaggatgccggccttgatgcgcgggtcaccgacagcaccgagcaggatcgcatcggtcttcttgatgcgctccagctcctcgtccggcaggatcgcgccatcacacagataacgctccgcacccaggtcgaaattctcgtattcgaaatcagccactccctcagcggccttttccagcgccttctgagcccagggggtgacttccttgccaatgccatcgccggggataacggcgattgtatacttctttgccatagccaacagggtatgtggccgtgctcgaaaacaatgcgcccagtccgtctagtggacagacggtggaggcgacgtgatcttcgcgcatggtctgtgcggcatggtctgtgccacagaatgccgaaaaacgctattttgaccgtggtgtggtacacgcccgatatggccgattccgggcttcacagcgaaatcggccattttgcaaggatctttgatattcctcttgtaccacaacagcgcatgtaaccgattaaaaccgattctgcggcaaggtcctgtaccacaccacgcgaaaaaacggtgtttttgacgtggtatggcacaggaaccatcattcattccactatccggcacagcaaagtccgaatgccggaacaaccatatgatccccacccgcgggccccaaaaacatatccccttgcaggcgggggcgcgatatggaagccccgcaatcagggacggacgtcggccgcggctagcgggtcaggcccatgacggagaggcaccaggcgttttcgtagctgacttcgcgccactgcttgtagcggcccgaggtcccgccatgaccggcctcgacttcgatcttgatgatcgcatcgatgccggcggcttgcagtcgggacacccacttgagcggctcgacgtacagcacgcgcgtatcgttcatcgacgtggtggcgaagatacgcgggaacggccgcaacgattgcctctgcaaagaccgcgtggacgccgcgcccgcaccggcctcgccgcccgcgccctccggcgcgttttcgtatggcgaatacgatttcatgtaccggtagacgtccgcgtcgtgcagcggatcgccccactcgtcccactcggtgacggtcagcggcagcgacggatcgaggatcgacgtcagcgcatccacgaacggcacatccgcctcgatgcccgcatacagttgcggcgccatgttcgcaatcgcacccatcagcaggccgccggcggagccgccgtacgccaccgtccgacgcgcatcggccaaccctgcgtcctgcagcgcggcggtcacgtcgatgaagtcctcgaacgtgtgccgcttgttcaggcgccgcccctgctcataccaggcgcgtcccatctcgccgccgccgcgcacgtgcggcacggcgtacagcacgccgcggtcgagcaggctcaggcgagcgactgagaagccggggtccgaactgatctcataagcaccgtacccggtgatgaacatcgcgccgtcagcggccggctcatggccgcgccgccacaccagtgacacgggtatgcgctcgccgtcacgagcggtgacccacacccgacgctccatgtactcgcgcggatcgaagtcgcccagcacccgcgcccgcttgagcagctcgtcatgcccggtcgccggatcatactcatgcagttcgcccggccgcgtgtagctggagaacgtgtaccgcatgcgcggcgcatcatacgaggggtttccgcccgttccgatggagtacagacgatgggtggctcccggcagcgttccgcccgcggcctcggctgcaccgtcatcggcccgcccgggcacgtcccagtcgccgtccagcgccggcggcatcagctcgcggaacgaccatggacgcccggcgaggaagtcttcggccgcctgcgtcttggtcatcgccgccacgtgcggcaacccgtccgtgcggtacgcgagcgtcacgaaatgccggtggatggcgatgccctcaatggccagcccgtgcgccccctgcaatatccgggggttggcgggattcgagtaggccgtcccggccggcttcgcgcccgcgcccgccttcatgtcgtcgccgcgcgcgcacccgtatggcgagccgaccgccacgcgcacgccttctcccagcgtatacggcggctgatgggttcgcatgtcgatcacgtcgatctcgaagttcggatcctgagcattgtggtacaccacggcaaccggaatatcggccccgtcagccccggcaccttcgaagcatgcgaagctcacgtcatattccacgtcgtccttgcgcgcgatgaacaccgagaactcgccttccggcgtcgcggtcgacagcatccacacttcggacgaagttttggacgcggagcagatcacgatgctgtgctcgtcgaaactcatgccgaccccgacccagaaccgctcgtcgtcctcgtggaagacgacttcgtcctgctcgaccggcgagccgacgcggtgccggcgcacctcgcacggccgccaggcatcatcaagcgtcacgtagaacacccaccgcgcgtccggcgtgaagcatgccgcgccgatgccctcaaggcgctctggcagctcatcgcccgtgtcaagatcacgaatgcggaagtcgtaccgctcgtcacctcgcgtatcgacgccgtacagcatccatcggccgtccttgctgacggacaggccgcccagcgcgaagaaatcatgcccctcggcctcgcggttcgcatcaaacaccacctgctcgcccggcagcgaaccggctccgacggcgctcccgccctcatcgccggctcccccgacttccggaggcgtccaatcgtcctcgccgcgcaccggcaaccggcactgcacggcgtactggctgccttcgcgggtacgcgcgaaataccagtatccgtccatgcgcaccggcaccgacatgtcggtctcctgcacatgcgccttcaactcgtcgaacagcgtgccgcgcagccccgccagccccgccatgcgggcgtcacagtacgcgttctgcgcggccacatagtcgcgcacctcgggtgactgcttgtctcgcatccattcatacgggtcaatcacggcgtccccgtggaacacgcgcttcaccggttcacgccgggcgatgggaggtcggcaagcggcgacgccgccgttcgtttcgtctgtcatgctcgtgattatacggcccgacttgagacagcggcgaacttcgctcttcgggaagtcactccgccaggtccgttcgtccgagtttctgcttgaggtacggcagcatggtcttcatgatgttcgaaccagtggtgccggtgaacaccggcacgtcggtgacgggcatcggctgcgtcgaggtcatgcccatcatcgacgacagacccgtggcctcgcggggcgacagctgccgtatgccgatcgccagcacacggccggggtatcgccgagcgatggtcgcatacgtggtcgggtccttctgcccgtcatcgccgatcaggatgaaccgcatgtcggggaagtccgccatgagctgttcggcgaactccagcttgtgctgcggaccggacggcacgaacgtcttcgggcgcgggtcgaggtcgcgcaacagcagcggcccttcggggaagccgtgatacgagatgaaatgccggatcgatccttccacgttccagggggacgtcgacaggtagaagaacggcgcgtcggggaacatgtcctgcagtttggtgaacagcacgctcatgcccggcacggagttgcgcttcttggggttcaggaacagcaggttgtatgcggccttccacaatatcggcgcctgcgtgaccataacggtgtcgtccacgtcggagatgatgccgaccttcgcgctggaggggatggtgaacaggctcgccgagacctccggccgccccttcacgcgataggtgacgcggtgaacgccggtctccagctgatgctcggccaccagatcgaggtatccgctttcgtcggacaccgcgtattcgctgccgagatctcgcacgggattgaattcgtcatatcgctcggattcgccgatctgcacggtttccagcggcgtcccgtctatgctgatacgcacctgcacgcgggacgcgggaatcgccagcatgcctttgatgccgcgcgtcagtgtgccggcgttgctgtgcttgggcgcgtacacggtgcggcagatcagcctagagtagacctcggtgccatagccgacgtacgggtccacgcgcgggaaccagtcgagcttgcgcgcgacggcggtggacagtcgcacccacaatccgaacgtgccggtgacggcccggcgcatgcggcgcaccagtaccggctgcacctcgatgcgctcgtgccgcgacgcggcgtcgaacgtggtgacgaccgggcgtgcgggaatcggcacggtgagcatgtcgtcctgcggggagccggtctgcccggacgggtcgtgagccgcgttgtccggatccgatccgtcatgtatcgggccgtcatgccgcagcccgtcatcccgcccgccgagagggcgcgctccgccccggcgtggtgtgttgtcgtgtgcgatgctcatgggttccgccatccgttatcacgttagctgtatgtcaaatatatccgtcggatatgtcgtcgtcatgcaccttcgtcaccgtcggccatcgccggcttgcgttgtcggtcgccgacggcggtgccggtcactgggcgatcttcgcgtaggattcggcgtcgagcagttccggctcgtcatcgtccagctcgatcttcagcagccatccttcgccgtacgggtcgttgttgacgacggaggggtcgtccgcggcgtcatggttgacatagcggatggtaccggcgaccgggcagaccagcggttcgacggccttggccgattcgagctcaaggacctcgtcgccggcctccacgcgcgtgccctcgtccggcaggtcgatgaagaccagctcgccaagctgctgctcggcgtacgcggtgatgccgacgatggccggggacaccgaatcgtccacccacacgtgctcttccgaatactgcaggtgatcggggatgtcaaggttcaacgggttgtcgattgcgttctcgtcactcatgcccccagtgtaccgcacagcgcttatcgatggggctgaccctgagccggccggagaggccccgaaaacgcagccggccccgccgatcggaaacaatgatcggcggggccggcatcagcggtatagtcagcgcaatcgcctgaaaatcagcgcacagcggaggtcggcgtggtccccacgatctgcaccatggcgccgatcggcaggaagtcatacacccacttggcgtcctcgacgtgcatgttggtgcatccgtgcgacttcggagtgccgctggcgatgcccgcggtgttccacggtgcgccgtggaagccttcgccctggttgtagtatgtgacccatggcacgttcggcgtgacgtagccttcgccgcgcatggtctgcgactggtacttggtgtgcacgaagaacgtgccgttgtcggtcggcgtggatggcttgccggtggagacgatgaaagtcttcaccagggtcgagcccttgtaggcgtacactttctgctcgctgagattgatgaccatgtgagggtcgccgttgggcgacgtgtagtccaccttgcggctttcggtcttgtggccggtcaccttcaccgtggctgtgagctccgcgcccctgccggcgttcagcgcgtcgagcacctgcgcggcggtctcgtcggtgctttggacggccacgccgtcgacgcccttctgcgtcacggtcagcacggtaccgtcggtgttggtgatgttcttctcgacgaccatgtcctggtcgagtttcttggcgaggttctgcgacaggtatgtcttgatggcgtcctgatcgtatgccagcgtgatggtgcccttctggatgtcgggcttgacctggatccacttggctatctcatcggcgggaagcgtgaacgtcttgcccttggagttgccgatgaccagcgacgacgtcagtcgcttgttggcgtcgttcgccgcgctcgtggcggtttcgacggtgatgggcatggcgacgtcggagtacataacgctcagtttttgtgcttcgccgggctgggagaccgccttcttgacggccgcgatcacgtccgacgggtcggcttccttgccctcgttgccttccgtgacgatgaacttcttggagttggcgtcgtagctgatgttcgaggcgaccgcgcgatcctgctcctcgacgagctgctcggtcaggtaggtgctcagcttgtagttgtcggtcgtggcggacagccggacgtcctgcttggcgaacgggttgatgcgggtgaacatgttgccggatttcgcgtccagcaggttgcgcacggtctgcttgacgttgacggtcacgccgagtttgtcgaggcccgccttgacattgttgccctcggaatcggtgacggtgatggccgaatcggacacggcctggttgacgatgccggtgagctcgctttcggtcttgcccatgacgctgacgttgccgaatcggacacccggggcgacgcggtcctggaaataccagttcgtgccgaagaatgcggccaccagcagcaccagcagtgcgccgatgatgctgaacgcgatgatcatgccgcgcttcgggttcttcgtcttggccgcggacacgcccttgcccagcgcggcgtcatcggccgggttcatggcgaccgcggcgaaggcgacggtcgcgacgtcgtccgcggcgggacgctgcggggcaaaggatgaagtcgcaggtgcggcgggctgcggctcaggagcggcctcatcgtccagctcggccaacgggtcgaaagcctgagtctcctgcgactcctgcgtctgtgcggaggccgcatccgcctgccgcttcgcctgagtctcctggaccagacccgccagaccggaaggctcagcgtcaaacgtcgacccgtcatgaagggcgggcatgttcagaggcgggatgttcatctgatcatccagcgggaagactgcctgcgtgcgctcatcttcctgattatcgtctcccgtgtattcgttagccattcctgttcctttacttcgactctctggcttcactataacacccggcagacatacgaatcattgtcgtgcggcgcatgtcacagttcgcggccgtaccactcctcaatcatgtaccgggcgattgtggatttgccgggagcttccatacggccctccgacaattcgatggtgtattcgtcacgggtcacccagcgcgcggtctccgtctcctcgccgtccaccaggatgtcggtgctcaacgcctgcgccttgaacgccatcatcagggacgcggggaacggccacggctgggagccgagatagcgcacctcgcccaggtcgatgccggtctcctccttggcctcgcgccgtgccgcgtgctcaaggttctcccccgcctcgacgaatcccgccgaaacggagtacagcagcggattgcgccaggcgctgttgtgctgcaagagcagccggtcctgactgtccacgatcgcggtgatgacagcgggctcgatgcgggggaacagcagacggttcccgtcgcccgcgttcgtgcaccgctgcgaccatccacccatcgccgccttgaccggagccccgcaggaggggcagaaccgctgcccggcgtaccatatgctcagggtcaccgcggtcgtggcctgtccggcctcgcgggcgttggcgtgcgcggcgaacccgcgcagatccacccagtcgaaccgttccacggcctgttccagcatgtccagtctgtcaggcgcgaccgcaccgggagcattgccgtcggcatcaaacgccgcgtcggcgccgagcgacggcgaaggaatcgccgaggccgcgccgggggtcgacatccgagtgatgtcgaacgccaccacatgctcgttgcgcagcgcgccatacgatcccaggaatatcggcaccacttcggggtggacagccagggcggagcccgcgtacgcgcccggcagcgtgctcagcctcatgttcgcggaggcatagttgacggcattgccctgaccgcgcggcacggccagcaggccgccccgcaccaggatgaccttggtgacggggtcggcgaacagcgtgtcgaacaggtccggatctccgcgccgggcgacctgataatcgatgtcgccctgcgccagcggcaggaacggcaacgtctgggtcaatgccaatggtgaaaacatcacttcacactcctcatgtatccatcgtcaatcatcgtcacggcaggtcacaccgccggcgccaccggccccaccgcaccgcggatgccgtgtccggccgactgcgcccgcaatcagtcgcgcagatgcacgcgtcgcaccagatcgagcaacgcgctcgccacctgatcgggatgctcgaccgcgctgaaatgcccgcaatcctcgatgaccgtgaaactcggcgacgtgccggtcatcgcatcggcgagcgcccgcatcgccggcctggggctgaacgggtccttgtcgccgcacagcaccgccgcgggagcggtgacgagcggcagctgatcgctgaggtcaggcctgccggcggccatgcgctgacgccaacccacgccctgcggcgtctgctcgccaatccagcgggcgaacagcgccctgccctcatcggactgcttgaagcttgaatcggacggcgtcgcatcggcgaaatgcatgaccggcttcacggtttgcgtcgcctcgcattcgctcgcgcacgccagccggttcgcgcgggcctcggggccatcggcgcccgctttcgtgtcgcacagcgcgagtcccgcgaccatgtccggatggcggcgctggatgtccagcaccacgtatccgcccatcgacagtccggcccatacggccttgtcgtagccggcggcacgcaccagatcgacataggcgtcggccatcaggtcgagcgcgtccgtgagcgccccgtcggccgccacccgcccgctgtcggccggctcgggaatcggaccggtcccggcgcccggcatgtccggcgcccacaccgtcaccgacgggtcgcccgtctcccgcgcctgccgggcaatctgctccgcgcagtcgtcccacatgcggtggtcaacggggaatgcgtgcaccagcaccagcggtgtcccttcccccgtcgcgtataccgtattgctcagcgtcatcatcgttgcgctcctatatcgtcatcgtttcatcgcccggtgtcggccactgtcgtcggccgccgtccgcgccccattcccaccgatcatgccgccgtccggccggcccgcgtcctctcgcggaccggccggacggagagacggcacgtcacaaatccagccaggccaacgcctgacggactatacggccatgtccgttcgtcatctgccggatgaacgtctccatcatctcaccgcgcggatcgacccactcgacgtccagtgtctcgtcctgcggcttgcagtcaccggcgatcggcaccacatagcacagcgttatcgcatgctgccgcggatcgtaatactcgcttagtcccggcgtcgggaagaactcggctacggtgaacggctgcaggctctgcggcagcatcggcagcgctatgtcgcccagatccttggcgacgttgcgcgcgatggcctcgcggatgctctcatggaacagcacgcggccggtgatcagcgtgcgctctatggatccgtcgtccgagacgtgcagcaaggagccgatccgggagaccctgcccaggtcgtcagtgcgaatcgggacgatctccacataagcgatcggcagctgccgacgggcacgactgatgtcggccggaccgagccagccgggcggattgccgtgaccggacccgcggatgaaatcctcgggcgtgatgtcatcgaattcgccgcgccggcggccggcgtcgaaatcgccctcgtcaggtacttcgtcattcaaaactggcatggtcttaattatcgcccaactcgcgtgacgacaacgtgtcgatttcgacaaggattcctgaatgcgatgtgaatcacggaaaacgcgcgatgcgggcgtccgcattcgtccgtcggcgtagtttgttgagtggtgctgggatgctgggggacgacaacggatgggaacatcaccatgacaacgagggaggaaacgatcatggcaaccgttcagctcaatgcacaggacttcgagaagaccatcaccgacaacaacctggtgttcgtggatttctgggccacatggtgcggcccgtgccgcgcgttcggccccacgttcgaggccgcgagtgaggagaaccccgacatcgtcttcggcaaggtcgacatcgacgcgaaccaggatctggccagcgcggccggcatccaggcagtgcccacgctgatgatcgcgaagcagggccagatcatcttcaagcaggccggcgcgctgcgcgccgaagaccttgacgacctgatcgcgcaggcgaaggcgctggacgtttccgccgccgcgcaggattcgtccgcttccgccgaataaccgacgattcccggcggattccgcgttcgtgcgccggcggccaggcgaaggtgccacgggcgcgggcggaatgcggaatccgccggctccaagatttcacaagatcgtcatagtggtctaaacttggatttggtgtgtactccggtgcggcgcccaccagcgtcgacgcatcacccgcccgtcgtgattgacggccggattcgccgaggattgtccgtcattcaaggagcataatggccagccatcgcaaaaccaatgcaccaacgctgctgtcgctaagcaaacgccagtggatccgcatcgtagcgatcgccgcggcgatcgtcatggtggttgcggccggcatcgtctcccgaaacttctacatcggtcgtggccgcggaaccacggtcaacgaatactcggccgccgacctcgccggaagcagcgtctcgcgaagcaacaaccgtgcggatctgcgtggcgccgacgccaacaccagctatgtgacggtgaagatcaacggcaagtcccgcttcgtgctgggcgacaatttcaccgatgtcaaatccgtactggacgcgggcaacatcacgttggagccggaagacagcgtcacgccggccctgaccacgaaggtggacgagtccacggtcatctccatctcgcgtgccgacacgcaggccgagacctcggagaccgccatcgcgttcaacacggtcaagaaggagaccaccagcctgccgcagggtcagcagaaggtgcagaccgaaggtcaggaaggcgtgctgcagaccaccagcatggtcactcgctccgcgggcaaggtcatctcgtccaccgtcttcgccaagtacgtcaagaaagcccctgtcgacaaggtgatcttggtcggcaccggttccgccgaagaggcggccgcgaacacactcggtgacaccgtcccctccggcgagaagcagaagtgggcgcatgactggctgctggcgaacggttacaccgaggccgacttcaccgccgccaacttcatcatcaatcatgagtccggctggcagacgaacgccacgaacccgagctcgggcgcatacggtctgccgcaggcgctccccggcaacaagatggcatccgcgggtgcggattggcgcaccaactaccagacgcagttcaagtggttcgtgaactactgcaaccagcgctacggctccatcaccggcgcctacgcctactggaaggccaacagcaactactgacggcggcgcgctatcgtttcttcaaccggctcctgcgggggccggtttttgttgtcgcaagactcacctataaagccgatcgcaatgcgagaaggcctgacaactacgaattggctgcaattgcgtcgttatgtgcgcgccgaaacgacgagtagggggtgcggatgaaaagttggacgctttggtgtccggattggagttcgcatgttttcgatggaggatcggcgcaggtgcgttgtgtttcgttgtcttctgtcgccgccgtcttccgccgtttcctgccgtgctgtcccctcgtcccgccgtttccgtcatcgtcagagcggccctgccgtctgccgcgccctgcgggaatcgtaccgcttcgattcaagttcgcggcatggcttcgcgattcctccagattgctccagccttccccacggtacacgcaatcatgccgcttcgcagccgcgctcatgcccacagcgcaacaattcacgcacatgtcaccggtgattcaactgttacccggtgcccgccgcagccttcgtgccgccctgcaggcgtacaatgacgccatgcgattgaaggtgaactgccgggtggatttcggcgacgaaggcgatctgttcctcatgttccacggctacggcaatgacgagcacgagatgatccgcatcatcgacgccgtcgatgccgaagccgactattattcgttccgcggtacgtatgcgcggcgttacatgggtggcaattactggtatccggacggctgcgacgtggagtcgcgccggcacgaatgccgtgtggtcggcgatgccgtcgtcgcgctgaccggctctgcggcctttgccgggcgccgtaagatcctgatcggcttctcgcagggcgggtacctgtcataccgtatggcggtggaacatccgggcgtgttcgatgcagcgatactgctcagcccgtcgttccgtggcgagcaggacgctgaggcggactgcggaacgcgcttccttctggcatatggcgaccaggaccgcacgatacccgtcgaggatcaggatacggcccgacgggtgatatccggaacccgcggcgcgcggctgtgcacgtacccaggcatggcgcatgcgatctgcgaccgcgagatcgacgacatccgtgatttcctgagataggggctccatgccctcaaatacgtcagcgggctgaaacggaggctcccaggccgggagcgcccatttcagcccgctggcaacgcgatgtcgggaatcagaagaacagcacggcgacgccggcagcgaacagcatcagcaggatcgacacgaggaagctcgcgaggaacggcttgcggcccttgaccgcgatggccttgaagttcacgttgatgccgagcgcggccatggccatgccgagcacgatgtacgcgaagtccacgagctgcggggtgatggtggcgatgaacggcacgaaggtgccgatcacggacgcgccgatgaagccgagcatgaaccaggggaacgcgacggagcgtttgccggtgggcgcgacctcggaatgcttcttctcccaccagatggcgatgatgatggcggcgaacacgagcatcagtacgcgcgacagcttcatgatggtggcgatgttgaccgcgttgaaggcgtcgccggcggcgaccgcgtgggcgatctcgtgcagggacgcgccggcggtgatgccgagctggtcctgcgtcatgccggtcagggggccgagcgcgatctcaagcaacgcgaagatcgtgcccatgatggcgacgatggcgacggccatggttacgtcgtcgtccttctcctgctccttctcgggcggcaccttgatggagccggacaggcccatgacggcggcggcgccgcagatgcccgtgccgccggcggtcaggatcgcgagcatcgggtcgacgcccatcttgcgcgccacccagtaggtcacgacgatagtgagcgtcaccacgaccgcggcgatgggcaggcacttgatgccctgcgtgaacagcacttgcaggttgagcttgaagccgagcaggatgatgccgaggcgcagcagcttgttggagatcagcccggccgcgtccttgacgccggccttgcgcttgtcgctggcaccgacgtaccacttgcggatcgggaactggatgatcatgccgatcagcagcgcgatgatcagcgcgccgaacagtttgaatccggggtattgcttgagccatgagccgatcagtgaagcgatcagggtcaggacggcgatgaacagcatatcgacggtggcgatgcgtttccaccatttcgtacagaactctctcatgatgtccattgaactaccgtcatatgccatcggtcaaatcagtgatagtgatggatggtattgatatttttgatgccagattgcagcgaatcgttctcaataagaaaggtgcgagccagatgcgggcggaaacgaacacaaacacctccgaaagcccggaattccgggcttcgtcggcttgttcacttgtgcgaaaatgtgaggaatcctcgcacgtttcttattgagaaccattcgctgcgacacagtcagccgcgcagggccgcaatgactctgccggcaagttcccgctgccccggcgtcagaccggaacgcggcaccaacgcatagaaccgccgcacgaactcgtcgcccagctcccgtgtcggcacgccggccggcacggcggccgccgacaccagggagcagccgaaaccggccgcgagcgccgcgccgatggccgcgttattggcgacctcgatcatgcgagacggcatggagccgaccgtcttgaagtacagatccgtgtaatagcgcacgccggagccgtgctcgcgcaccatccacacgccatgcggatcaccggccagcaccagcctgtcctcgcgcagcgtgacacgatcgaccgagtcgttgacgatgggcttctccaccacacccaactgcacggctttcataccggcctgttccaggatcgcgtcggaattgagcacccgaatcgagcagtcgaagccgctcagcgccttggccatcaccggcagtgcgactggcagcagcacggccgccgtggtgtgcgagaatgcgacggacaacggctcacggctctcgcgcatgcgggcgatctgctcgcaggcgttgcgccacgtgccatcgatgccggtcgccgcacggtacagcaaccgcccagcctcggtcggcgtcacatcgcttttggcattgcggacgaacagcggcgccccgaccatgcgctccagttgggcgatgcgcgacgacaccgtggactgcgagaccttgagctcgtcggcggccaacgtgaactggccgatctcgtagaccgcgaccagagtgtccagcaaggggaacatgaaccgctcctttccgtcgtgttcggcaacgcctgccggaacgtcagtgcgtccgttccggcaggcgttgccgatcggcttgcatcatttgacctgcgtgatccggttgccgctgaccatgaacgccgttctcgccatgtcgatcatcggctggtcgaaccggctgtcggtgtagaactcgtcgatgaccgtgtccgggccgacgacttcgcggaaccgtttcggcttgttcgtattgaaattcagacaggtgacccgcatcgtccgcggatccacggtggatgagaccagacggttcaatccgagacgccggcatgcctcccccacggtcacgtcgaacgacgccgtcaggatcacgtcatccggacgcggctcataccacggcttgatgtggtccatatgccggttccagaactcgttcaccaacgcggatacgccctctgcgatcgcggtctccccggcgagaccggcatcgggagccgcgccgtccagtcgcagtatccgtcgggaagccgcgacatcgtgcaggtaatcgcacgtcacgccgcccacgccgcgttccatttgcgcaagcgtggcccgccccatcttgtactgcaccgcgtatcgcagcaccggagccagatgccgcagcaccttcggctcgtatcgggcactgaacatatacaggtcgaacaggctttcgccgtcatatatcgtgccgtcgaaatcgaacaccctcatcgcgtctcgttccctctcaccctcgcgccgctcccggcccgtcagaactgcgcatagtccgcatccttatgttcccccgtctcaaggtaccgtgcaagatcgtcggacgacgagaacacagcgcgcaccgactgggcgatcatcaggttgatgctgtcgccgtcgcgcaggccctcgcgatatgcgtacacggggatgcctagagagtgggcgaatccgatctcgaacatcgtgccggaatcctcgtccatcagattggctatcaccgccttggaagcgcagatgccgttcacgtcgtcgtcgaagcagcccgcgggaccgacctcggcgatgtcactggcgaaccgcggcctgaacatcgtcttgccgtgggtgtcgagcacatgctccaagcattccatcgacgcgacctgctcgggattgaagaacgggccagcgacgtagaaatcgtagcggcggcgtttgcgcgaataggctttctcgcgcttgcggccgggctcgcgatcgggctctcgcccgtccgccgcttggcccgcctctgcgcccacatccggctccaccatctcgacgaacgtctgcttcatcgtatccagcagcgactgcgtgctttccggaacctcgtcgcccgctccggcgacgtccttggtgagtccctcgatgcggcgacgaatccggtcggcgtcctgcgggtcgatgctgaacttcgccacgagcgactgccgtatcgtctcataatcaaggttgacgaagaagataagctgctgcagcttcatgaagttcttcagctcggggaaccgctcgacgatgtacgtctcgcgatcatccgtggccctcacccagtcgcgggtcagctgcatgctccagtcgccggtgatggatccgcggcgcatgcggtaatggtacagcgcttcgggaatgcgcacgacgcgatgcgactcgccgatcacattgcagatacgggccatgtcctcaatcttgcgcccgacggggaaggagaacccgtgattacggtagatcgacgccgccgcgacgaacgaccagaaatacccgtcgatctcggccttgacctgcgccttgatcgcctcgatcggggtcatgatgatcacgtcgtcataatggttgtgcttgtacgaggatgtcagcggcttgccatcttcgctgatcgtgtcgaactggaacatcaccaaatcggcgtcgtagtcgcgcatcgtcgccatcgcacgttcaatgagattgcgctcgaccatgtcatcggaatcgacgaagtagatatagtcgccagtggccttcgccagtccgacattgcgcgcatcggacaggccgccattggccttgtggatcacgcggatccgctcatccctcgccgtccacgcatcgcacatcgcagggcagcggtcgggcgacccgtcgtcaacgagcaggatctcaagattgcggtacgtctggccgaccagtccttccacgcacgcgtcgagataccgctcgactccgtacaccggcacgatgaccgacacgagcggcgtggccccgtcaccattcatggcctccgccgtcacattcgacgatgtttccgattccgctgacatgcccctcctcgatgctccccggtccgttcggctccactcactgctgacgcacggcggcacgtgcgtcgccttccattgtccatgataggccagggcttgcgcagggcggacgactccatcctgttgtttgccatatcttaaccgcgccgctcaaccgtgccttttacccgcgcggaaacggcggcagaacgccatgccggcgtgcgtcggccaccggattttccatccgccctgaggtcgcgtagacccctcccatcagtcttttgacaccatgcagcattttgccgaaccccgcaaccgatcaccgtggcgggatgcttcttgccgtatatggccgtcagcggcgacagcgcggcgatcaagcagatgctcaacaacatgtccagcgaagagctcctcaaatactatgacggggacagctcgatcagcgcatcgctgttcaacgatcgcacatttcccgctctgggcgttcctcgtgctggcggcgttcatcctgttgttcgcgctgcttcgtctgcacgccgccacgctgacgttctccatcctcaacctgctctgatgcgctttgtacgcgggaatactcatcttcattctcgtctccgcctcccacgagatggatgtcgtacgctcgacggcatctcagcctgggctgaatctcgccaatgacctgtccttttcactcgttccgtcgtatgggatgtatgcgatcatcgcgggaacgttgttcatgttcgtgggagccatcgtttccgtggtgaatcgcagccatgcgcgcagggcggcattcgccagtccggctccggcgaatccgcccgcagtcgcgtacggtggcatgccggcgcaaaactacggagccgcgccgggcgccggagcggcgtatcagcagcctgccgtgccatatagcgcgcaaccacagaatccggccggaggaacgccgaacacaatgcgtcccatgccactgccgccgcaacactaatccgcacagcccgcagactccgctgacatccacaccgaatcagcggagttcttttatgccgccagacgccgactggcgcaacggcgcgactcgccgaactatggttccgatacgggccgcactggaatatcatggtgtatatagcaacgctgcgagagaggtgggagatcatggaatattgtccgcattgcggtgccccatatgacgagggcagtcggttctgcttccagtgcggcgctccgcggcaatccgccgctggagcgccgggtgctcctgcgataccgaccgctccgatacccgtgtcgggctatggcaacatggcggcgcagccaccggttccatcgcctccgagagcatccgagacggcatccgacgatggttttgccgcattcgcagcgaatgcgggcgatgccggcacacctccgaccgtccccgccggaaactccgccacgccaccggtcaatcccaccggatccgccaccgcgcagccgtccgccaagcgcccacgcatgaaactcatcgcggcgatcatcgccgtactggtggttctcgctggaaccgggttcggtctcgccgcgaggaaactggaatggatcggcccgcgcaccgtgccgacggtccgataccgcacggcagccggagtgtcacgtgagctggagaccaaaggctttctcgtcaagaagaagcagatgttcaacgccctgggcaagggcaagtgcctcggtctggtaggagtcaaggcgggcgaccgtctgcccaagggcacgacggtgacggtcatcgaatcgatgggacccggtgtacccgaaggcacagtcggctctgaaccgagcaaggccgaaaccgcgctactgaaaatgggcgtcagagtcgtcgagcacgaagtcgtctcggagcatcccggcaaagtcgccgtcaccatgcccgcggacggtgagccggtgcgcgacaccgacgacggcatccatatcggagtcgggatcacaggtgacggcatacccgtcgaaatcgccggaatggacaaggacgaggcgaaaacaaagctccagcaacagggcttcgacgtcacgctcaagccgcgtttctccagccgaaagaatctcggcaaaatcgtccgagccgatcccggcatcggcgtgcggaccagcgagaccaacgtgcccctgtattacggcgtggatgccagcaaacgctacgacgtggtcggcacgtccattcccgacaggggatcggacaagatcatgacgaacaccgtggctctggcagggaagtattgcaccgatggcggcaactgcctgacattggaacccggtcagaccgatccaaacccgagtggtctggtgctcgacggcaaaggttcctcggatttcttcgaccagctgaccctctgcacgtattcgcaggacatcagcggctgcaacccgtcctccggcggctactacaacgcaatgaaggacttcctgatccagggcgataccggcgccatggagctgtatgcaggcttcggactacccgtatgcggcaccacatcttacgtgggcgacgggccgacatactgtgacggcacatcggagaaacaagtcgaggatggctcggatggaaccgccgaacaggccatgagcgaaaaatatctcaaatacgtggctcgtgatttcttcgtggtgatgccggtcggagccaacctcgaccagctggaatccaacggatatttcgacggctcgactacgtacaagccctatgcggaccgcccgtatctcatccgccgcgacaactccgcatacccggaaatcaaggcgacgaatgacaccttccaccggaagcccaacccgtacgcgcccggcaccaacatgcagccgttcaagaaggcgcccaacgcccacaacgtgtactatctggtcgagcagccggtcgatttcagccagttcgaggaggccactgtatccggcgggcggcagggagacggctccgactcgtcgcctgacgacggcacctcttccgacggcaacggcgatgataccactgaatccgatgactcatcgcaatcccagtcatcgcaatccggtgcgagaacctacacgaacgcgcggttctcgtaccgtgtcgacgtgcctgccggttacaagtggcagcaggagtccgacaacggcgacggtcgcaagttcgacgcgacgtccggctccacgcagatcagcgtgtggggcagcaacaacgcgctgtctcgctccccgcaggaggagctcgactggctcaaggagaatctcggcggcaacgcgaacatatcgctcgcgcaggtggccggccaatcggtgtacctcagctatgagcagaacggaaccatcacgtatatccgcgaagtcgtcaccggagggaagatcgcggccatcgaaatcacgtatccgaccagcgaacgctcgagcggagacaaactcgcggagacggttccgctgaccttgaagttcgtggggtgatggggctatcgtcaccaaatgcgaggccgtacgaaaccgttgtgttccaagaacgcggcgacgtcacgcagctccggcatgttgatgctgtgcgtcatgccggggtagattttctcggtgagcgtggtgtgcgaggcatagaacgcgctcatcgcgtcgagttcggacttggggaagatgtcgtccgcagagccgtggccgtagaacattggcggcttcagtcgcgcaagctcgtcgtcgccaggcaactcgccatgtgcgaggaacccggagaaactgactgcggcggcgtaccgtttcgggttgacgcgcagcatctcgccggcgagtagaccgccttgggagaagcccatgaccacgatggggcgctccggggcgatgctgtcggccacccatgcgtcgatggcctcgccggcttggcgtgattgccgatcgagcgattcgccggtcgggacgccttcgtaatcccatgagccgaaccacgtgtagcccgggccgtacgaaatcggcgcacgcaacgacgtgtaatcggcgccgggcgcacaataatccagcaatcccggcaggtcatgctcgttcgacccccagccgtgcaacagcaagaacaccgggccgcttccattggccggcagattggccaccgcatgttcgatcctcatcgcgctcactcccctcttgtgtgttcgtgttttgcgttcgccaccggcttcagagcggccggcgaatcacgtttcaatgtcatgttccgtcacccatggtagtcgcacgggcgccggcagtcacaccatcgcgcatccgcccccctccatttcatcatctcatctcgccaaagtcccatctcaaggtcgtcacatgggactttcgccggatgaggggtcacgccgcggcacggacatccgctcatagtcccgcgggaaagtcagccaatgggactacgcgcggaatggaggctgcgggattgcatggcgtaccatataactcgacatcgaatccggcgccgcaacaccggcatccaccgacgacacgggagtatcaatgcaacaaccgatcatgacctccgtcgcttttctgtcgcaggcatcggctcctgccgacccgtcgaacgacgaggaccgcgccaccgcgaccgacctgcgtgacacgctggcggcgcatcgcggcgaatgtgtgggcatggccgcgaacatgataggcgtggcaaagcggatcatcgtgttccaagacaaggaaaacaaccgcaacgcaatcatgttcaacccgcgcatcattgctgggagcgacccattcgataccgccgaaggatgtctgtcactggatggcgaacgtccgacaacacgctaccagagcatcaccgtcacctatcaggctcgcagcgggcgcgaatacacgactgccttcgacggattcaccgcgcaaatcatccaacacgaaatcgatcacgtcaacggcatcatcatctgacgaataatgacggtcatcgcgtcatatcgccgaaatcgacaatgtgacgcgtcacaaagcacaccacacactcagcccaactggtccttgatgccggacggcagatgcgtggtgacttcctgctgaatgcggtcaaacgcgctggacagcagcagattacccggaaccgtactgatcaggaatgccagaatcgcggcgatgaccgccgtcaccagacctttgacaagacgggcgacgatcttgaacaccagataggagacaatcgcgccgacgacgacggtgatcgcggtttgagccagctgcggcagattgccataccacaggacgaactggtcgaatccggaccgcacggtctgtgatgtttgagagatctgcgagttttgagcaatatgcaaggacaacacggcgtgcacgaactgcatgtgcgaggtcagtctcctttgccggtgagtatggtggttgtttgatgatatcagcctgatcaggcctcccgtcatgtgccggcccccgatcgggccgggatgcgggaggtcccctatgccgtcatgacgtcagccgacgaggaagtcgaggacgttcatgccggtgccggtctgcgcgcgatacaactcggtgtatccgcactggcggcaggagatggtgacgaacttcttgttctgcacgttgaacagtttggcgaaatcgccgccggtcgcctggaactggtcgctgtcgtatgaccggcatccgcatttaacgcaaacgtactgaatctgctgcataatgaattcctttcatcggaacctaacatcccccgatagtggttcaccctatcagacaggattcgcccgattgccggttatcccatatccgcacgtaacgcgcatacaatcaacaaaaacgtccgcgctccttcgcgatgcgggcgccccatatcggcatcagtgcgcatcggagaagaaatcacgctgaaaaacgccaacagccgacaaatccagaggctatcttcgtttcgaggggttgattcggatgcgtcaaaacatctatctgcgtttcgagggggtggtgctcaagtataaacgctcccaaaaccgcatgattccagcaacatacagcttcgaataccctgcatatcgtgttttggcaaccccttgaaacgcagatagatgttcggagagccccgaatcaaccccccaaagttcatataccgtacaaatcggcgggtcggatgtcctcagtagccgtgcgcgtgcagataatcgtcgtcaaaaccgaaataatggccgagctcatgcagcactgtcttgcgaatctgccggcgcaggtcgtcgcgcgtggcgcagacgcgctcgtgcgggcccttgtatatggtgatgatatcgggcatgacgccactgtatccggtgaagcgccgcgtgattggcacaccttcgtacaggccgagcagctcatcgcactggcgctgcatcgtcgcccgctcacgctcgttcggctcgtcggcgaccgcgataccgacattgtccagcgcgcgtttgaaccggtccggaagactgtcgatggccgtttcgacctcgtgctcgaactcctcgtcgctgatgcgcattccacagccttccttgtcattgaacagtcgccttgcccgccacgatcaggcggatgccccggcacaatcgggagcaggctgactccatgttccaagcataggacggcgtggaccgatgagccacatagaccgtacgccacacgaccggtatacgcttcagccattcgtaacgtacactagtgactgtgcgaaaggaggtgcgcattggcgacgtcggaaatcgaacagttgtggatcagccagtttcaggagaatctgggggcgcttcgcaaagtggcgggatggaccacccagcagttggccaacgagctaggagtcgcacggcagaccatctccaatctggagaccggccgaagtcccatgaccaaattgcagtacctcgccctgcgcaccgtgttcagcgccgaaatcgccgaatgcggcaaccgcgaactggcgaagatcatcaagacccttgttgacgatccgattgaactgcgcatcaaggagcttgggacggccggttcgtccgacgatgccaaagagccgaccgatgagacggccaacaataccaaagcaaacagcgctaccgagcctgacgctcccagcgaagcagacgatgcacgaccggtcgcaccggcatccaagccggctgccggcagacgggcacgcaaaaacaaggaacgaccgctgagcacggccatgcaggcacttgccgtcatcaccgcggctctggccagcggcaccgccgccggcgttctcacctatctgctgtttcccaacggcaagcccggcaaaaacggcagacgttgacagagcggaccgcgctgcagaccgcaacaaggccgatcatcgacagtcgtactgattcggcatgacgattcgtgtctatttccgctgccacgaacaatgcctcatctcgatcaacttccggaaaagtccgggattctcttcgcgcatcagcgcggctgcgactgcatcatgtggcggcgcgtttgaacagaaaaatataaatctcccggcatatgaaggcaaggctcttcatgcaccgggagatttgacgattcgttacggcagaaaaaacgttacaggcctaggacttcatgcttcttcatgtcgaactcctcttgggagaggatgccgatgtcgacgagttccttgagcttcttcaacgtttccacctgttctgcgacgctcatggaggcggcgtgcgagggcgctgccgcgccggctccggaggttgccgtatcggcaccgcccgtgctttcggctgcaagtgcggtttgaggctgcggctgttgcggttgcggttgcgcggccatcggcatcggcgctgccggcgccgcggtcatcggattgatggcctgagccatgttcatgccgaggagcatgccgccgccatcaccgaaaccgttgttctggatgccttgggcgatctgctgctgcgcggccatgttgccggccgtctgcgagacgccctcgtacgcagagacattcatcttgttcgaagcgaattggcgcacgagctggcgagactcctcatcgaactcgatgctctcgatgccgacgccggacacctcgaatccgaagcgattcctccacgtccccgcattcgtctcatcgttgcgcacgcgtgtggcgatatcgttcgcatgggcaggcagctgcgaaattcgatactgatcggacaacgagttgatggcgacgatgaacgactggacgaattcggaaagaatctgttccctagccttgggattgtcgaacgcgtacgacgttacgttggcgggaacgtaattgcgcacgaagcgaaccgggtcggtgactttcagtgacatcgtgccccgcgcccgtatctccaaatccacgccatagaatttgtcattgtagaccagcggcgctggagtgccgaacttaatgctgcggatctcacgcaggttgacgaacgccacatacttcgtctccaccggctgcccgccgaatgtgaatcgactggcgaccgaactgaacagcgatccgatgccgtcaccggcgagcacgcttttctcgccgtcgcggtactcgtaaccgcccggctcggtaatcacgttctcgatgccggattcagagaagatgaaggccgccgtgttttcgggcacataaatgtgggaaccgttgctgatgacgccttcagaaccgtactcgttcgacccgcgtccgttgttcgtgcctcttgggactcccggcgcgaccactacatactcgtcgaaccgaccggcagtgatgatgtctttccatagatccgcgaacgttccgccgagcgcgcccgcgaacgccttgatgattgccatgtgctttctcctcgtcttctcgcgcaagcgcggatgcgccgccatgcgtgttgcctgcatgacggcgcatccgcccagcgcacaggttcggtcggttagttcagctgcgtctcgcgattgcagtattcgcagcgaaccgcctcgcgcttatggccggacagcggcgcgccgcatccctcacaggttcccgacgaccgcgtctcggcgatgccaagcccgttgcgaaacgcgccgaacgtgtccttcaacgtaccggccagcgcctccgtgccgggtatggccttgctgaacgcctgttgcttgttttggatctgatcgagaaaacccattgctgtccttcttccttatgtggattggcggagtgccgaataccgcgtcactggctgacggacgcaagtttctgcgtgcatcgagccatgacctcgttgtagtacgcgagatcgctggcgctgagcgagccggaatcgatggaaaattacttgaattactcgcagatgtatcagagcttgtgctggtatctgatgtagatgaatcatcaggaccgcgcaggcttatcgacatgatgtccttattcgactcatcatgtgaaatccttacggaatagccatccttggtctcacctctaaaccatccgcccctgcgtctgtaatctacagtgaagcccttctcaagaacagcatcattatacgcggcatactgttcatcattggtatcacacacatcaatagagagcatgtcatcatgttcaatgagattgccaccagtcgtagatttcggggttggaagtttggtgccaatattggtttttggccaagagaaagcttcgcgctcaatttccggtgcggcggccggagcggccttttcgagagctccggagacaacaatgcctacactgccaatgacaaaacccaacactgtaagtactgcggcaatccaagcaaacagctgaccagtcaccttgccgccgggacgtgttacatacaacgcagcaaatgtcagcaacaaggatatgaacgccatggagaacaacattccccattccaatgccgccggcgcgaacgtgctcagcaccatcaggatgctgtatgcaagtgccgcaatggcgagtttagagcggttaccggaagcgccggtgaactgaggattattcaaaatcttccaaatcttctgggcctttgttctccttcttcggggcttcgccgcatcggtgggtgccgctgtgggcagaagtgccggatcaagaacagacaggaattcagcggtccgagtgccaccatcatcaccggtcacgtccagtttgatggccgtcccgtcagcaccctgagcgctggccttcagcgtgaattgtgctccgtcatatgcgtggaatgtcaccgttccctcagcgacgttctcttcatccgcggtgaacgtggcgctggtggacagctggtcgtggacggcctgcattacctgctgcagactggtcgcatacacacgatcgttgtacgacggagtctgggcgggaacatcttgaactggcggcattgtctgcgtcggcggcacagactgttcggtcggaggaatgaattgggtgggcgcatcattactgcccgaagtcgttggctgattgccgccggcggggaagggtgccggctgttgactatcgtttgtcatgattttcttcttcctctttctttgccagcgatatcgccagcgcgcaaacggcgagacatgtgagcatgaccgccagtccgacctcgatggcaaaccggctgcgttcgttcattgtcacatccttctctcgtcaaccacttgatgtcgctgtactcatcacttagtgtatgtcgctgtgaatatgtacgcaaattagcattatgtaattagtttagctagtcaaactgagttgaatccaccctttccgccacgtgcccttacggcagtggcaacgtcaattttcaggatggcgacatggccccgcatcagttgccaactgattttttctccggcgtttcgccgggcgagtctcgctacgctgaatcatcagaatcacacgacatagcaagaggagcgcaacatggcagacacccccgaagagcatctgaccgaagagctgcttgaccggctgcttcacagtgccaagatcgaaacgtatctcgacgaggagcacatcacagatcgtgcgttgcccgattatctgaacgaactgctcgacagaagcggaatcaagcgcaaccctctcgcagaaaaaacaggcatgaatcagacgttcatctacgatattttcgccggcaaatcccggccgggaaggaacaacgccatcagactcgcgttcgggctcgggtgcgacctgcgcgagacccagcggctgctgcggcttgccggcgtgagcgagctctactgcaagcagcggcgcgacgcaatcatcatctggtgcattcagaacggccgggaccttcccgctaccgacgatgaactgtatcggatgggcgaggataccttggtgccgaaggactagtgcggggaggtagctggcgacgcccccacccgcttcgcgggagcccccgccagcgggggcgagattcttagcacatcactcgtgcgcttgtctccgccagcgggggcggaatcttaggccatagagcatgtcgatcgggaacgggttagggtagcgggtaacgaccaggactggggagcaagatggacgataagcagaccgcgcacgcgatggggatcgacgacacctaccgcgtcgagcgcacgctcgctcgcggtcagggcggcgtcaccgaactggtcagcatcgacggcatcggtccgttcgtgcgcaagaagatcccatcccagctggcccaacgcaacgtatgggcggctctcagcgcctgcacgaacccacgcctgccacacgtcgaggcaacatacgagttgcccgatcatttcgtggtggtgtatgactacgtatcggggcggcctctggagcacgtcgttcagcaacaggaaaaacttcctgagcgcacggcgacacaactgatctgccaactgtgcgatgccgtgaccgagctgcaccggcatggcatcatccatcgggacatcaccccatccaacgtgattgtcgccgacgacggagcgcatctggtcgacttcggcatcgccaggaccgtcgcagcgaatgcgacgcacgacaccaaggcattgggcacctacggcttcgcttccccagagcagttcgggttcacacagaccgacgcccgatcggacgtgtactcgctgggacggctgcttggatacatgctgaccggcgtctaccctgacgacaagcgatacggccagctgctcgccgacccccatgtggtgccatcccagctgaagtcggtcatcgaccgggcatgctcattcgaaccgagcgcccgtattcaaagcgccgacgaactgcgccgcgcgatactgggacagcctgcacagcaaaatgagaacatcgccaggcccgccatcgtgaacgtcgcgccgcaatcggcccggaagcgctccaagcgcaaggcgattatcatcggtgccatctctgcgattctgatcgccacgctcatagccggcatgctggttctcggtaatgtgttcaaaaccggcaaacagtccacgccgaacagcagcactacgtcatcatctcacagcaatacgtcagacgcacaacagccgggcaaggatggcacgaacgacagcaatcagttcaacggctccgcgaacgggcagacaacggatggaaacagcactgacaatacgcagagcgatacaacggagaacccgctgaaaatcacggaatcagggtggtcggcggacagtgccggctatatccattatgccgtcgcggtaaagaacaccagtagcaccttgcaggtcgagtttcctgcgattagcatcaccgggcgcgcgaaagacggctcgatactgttcgctgaggataacctcagggcagtatcgttcccgaagcagaccatatatcttgtcggacaagctggcaatggccccggaagcgaaactccggaaagtgtggaattctccataaaccaacgtggcggcaccgatatccggcaatcgcatggtgtcgtcaccttcacaacgtcaaatctctcggtgtcgcatgatagttttagcaataccttattcaatggagagatcaaagccaaaaacaccggctacgattccattctaaatggggcgtatgtgacagtcgtgctacgcaacaagaaaggcgacatcatctacggggatggccagcctatcgattcgatttttgacggaaaaacgcattccttctcaatccctatagacgattgtcccgattatgcctcgtatgagattcatgcgtcaatttgatttttgatttgccggaaattcgacgccgcccattgcgtatcacggtcatctcaccactatgccgcttgccgctccggcgatgtaatcggagcggcaagcggctacgcaacaatacaggtggcccgaattatcctcagccgcggttgtcgaacatcgacaggagcatcttgctgggttcgacggcgtagacggtgtgcggcaggcgggcgctcaggtagacgacgccgccgggtacgagttcgacctcgcggccttcgccgccgacgcgcagtttgccctcaagcacctgaatggtcaccggcatggcggccgtatgctcgctcagcgcctgatccttgtcgaaaccgaacagcacgacacgcaggccgtcctcacgcatcaccacacgcgagacggtggattccggctggatctcgatcagcgatgcaagatcggccacatagcccaggtgtggttccgtggaaatggcgtggccttcggcatcgtgcttgcacgcgcagtgcttgggctgctcatcaccggcttccgcggcgccgtcgtgcttgcacgtgcaatggtgggcggctggctgctgagcggccgaagcgttcgctgcggctgcctcggccgcggccctgcgctgacggcacttgcagtgctgctcgtcacgtcccgcctcacatgcggactgctgttcgttctcatctgccatgatgttctccttcgttacgttgccgtatctttttgttgcgcgttcgcgccgtatattgctgcgcggacgcgcatccacgtatatcagtgcatatcaatgtcggacgccgtaccgggcatcgaaccgcggctgatcttccgacaccatccaccatcattatctgtcagcacggccgccggcggaatcatccgcccggctgtcggccggcgcatcgtcacttcgcaggcttgcgcaccatgaacgcaatgccgttgagctccttgctgtacttgtggaacgtggatttcatgttcatcacgcgggcgcggatgtccttgttccccaacatattacgcaggatgcgcaacacgccgccaagcccctcatcggcgagattgcggcgcatatccagcagcgccatcggctccttgccgctccacagcacttcaaagccctcggattccagcagctcgcgccactctttctcggtgagaggacgggcgttgaccttgatgctgcgggcgagtgccttgcgcacctcgtccttgaccggctcaggcagatcgtccggctgcagcccaagctcgtgaatcgaataggtgccgccagcgcgcagcagacggtaggcttctgcgatgatggcccgcttgccacgctcagtctgcatggtgagcatcgcctcaccgatcacggcgtcggcgctttcggattccaaccccgtgtccgctgcgtcgtgcagagcgcagctcgtcggaatggacggtgcattctcggccgtcagcttggtgatgatgtccaccacctgcgggtcgcggtcgacgccgcgatagcttttcggcttgtgctcaagaatgagctgcgtggtacggccaaggccgggcgcgaattcgacgacgtccttgccttccaactcggttttcgccagcatgcgcccggtcagcttcttgccgccagggcgcagaacgcgcttaccgatgcgggcgagcagccagtgtccctgcagatgctccacatcacgatctgactgaggcagcggaaggccgccgttcccctgcgcattggtcgtggattgtggcgctgtattcgtagtctgagttcccatatcacgcgacactatcggcgatgcgccccatgcacaagggttttcggtcttttatcagcgtaatgtgattgaactcactccgaccggcggaatcggccgagcagtatttccgacatgccgacggctacgtcttgtgtgaagaaccggtcatacaggcactcgtcagtgagccatcctgttgacaatatgccacaatgaaaccagtgcgacgatgcgcggcagatcattcaccagtcacgtcatccgcgcaccgcacgacaacaatcggagacaatcgaggacaggaagaatgagagttatcagcaatattctgtggattatcctaggcggtctgatcatcgccatcggctgggcgctgatcgggctcgtgctgtgcgtgacgatcatcggcattccgctgggcctccaggcattcaagatggcggggctcactctgacgccgttcggcaaaaccgtccgctatggcggcggtgtcggctcgacgctggccaacatcatttgggtcgtgctcgtcggcttttggatggcgctcagttacgtgggcgccggcctgctgaactgcatcacgattatcggcatcccgttcggcatccagtcgttcaagatggcgaaactggcgctctggccgttcggcgcggacatcgtcagcctgtgagcgtccggctcgcaggcctcatacggcggtctgcctataccattccttcctcaagataaaaaacggtcgagccgccgtcatcccattcgaccttctcctcgcgcctgtgcgtcaggccgcgacgcgtataaaaactgacattgcagccggtgtcggtaaacagatagtaccgccggacgccaacgcggcggaaccgttccagcagatcatcgaacaggaagccgcccactcccccgccacggattcgctcgtcgaccaggaagagcgtcacctcggcgtcgtatcggttctttgcccctcgtatcagccgtctgtcgacacggttgatacgcagcatttcagcaatgccggagcggcctgcggtcgaaaacagcaacgggaacaatgccctgatgatatgacgatggtgccggttcggcaggaggcacaatcgtttcggaacattgatgtcgacccgcgccaatatcacgcccaccggccggccgtgcagcaccgcgacggtcgcctcggaagagcgcgccagacatgaatggaagtccgcctccgccagccgacgggaacaatcgctgtccgctttttggccgcctgaccattcgctgtaccatgtacgccgcaggatctcgatcagcgcaggataatcgtcgcgccgcagggtgcgcagacgcactgcggggcgacgcggggtcgctgctgtcgatgacgatgctgtcgaaaccgcggcgaccgaggtcacatccgcaatcgtgctcgaggaatcgttcataccgcaatggtgacgtggcaccgagacgttgacggagcaaagtgagacacggcgaggcgggacggacggaaacgcagcacaacgactctcctgccgagacacgcctggatgtgtcacaaagccgtcagagccaatcgccaagaatgacggaacagagccccgttctttcaaaagtcacacgacaagcttgcgactacgcctccgtaaaggtcatcgatgccctaatccgaagcagcggatacggaaacagagaaatcgaccgtctctgcgatggaacgatcacatacggacgcatccgagacattcgcaatggccttaaggctccggtgcgtttgtctgagtttctgcaggcgcggtgatctcgacttcgcggcgcatgaggatgagcataagtacgatggcgatgaagacgatccggcgtaaagccggatgtggtgccgtgcggggcttcgtccttcgtgtctaatcgcgattaaattgatattaattatgcaatcggctacttttatttgacttatttctcgtcttatcttatagtttctacaattaagagcctaacccggaaagagaggcggaacaatgggtatgaaatataggagtttggcgcggtcgttccataccgacagatccaatgacgccttcaacaaccatgcgaagcttgcccggcaacggctcgaggcggactccacattcaggaccggggtcgtcacccctctgggcgaactgttcgccgccacaccacgcgagacatccatgctcacggaaaagatacttctcgcggaacggcgggtatcccggctctggaaccaaatccctggcgtcatgcgctgggactacatacggcactccatcagcgaggaattgttcgccaccaacgagatggaaggcgtacgcagcacccgcaaggaaacccaggaagccgtggaagcggccgacaaggcgaggaaggacggcgacgaccccaaggctcggttcagcgaattcgccaagctgtacctgaacctcaccgacaaggactccgcactgccggcgggaatcgccgacatccgcgacatctacgacaaggtcgtgctcgacgaaatcaacgagagcgacaagccggacggcgaactgttccggaaaggcgacgtggaaatacaaggcccgcacggcctcgcgatccacaacggagtcaaaggcgaaggcaacatcggcgcactcctcaccgacatgatccatctcgcgacctccgacgagattccccggctgcagtcggccatcatgtcgcacttcctgttcgaatacgtccacccgttctacgacggcaacggcagaaccggtcggtatctcctggccctgtacctgaaccacgacctaaccatgcccaccgtgctgtcgttgtcccgcaccatcgcggagaacaagaacgcctactacaaggcattcatggaggcggaggacaagctgaactgtggcgaactcacgctcttcgtgaacaccatcctcggattcatccggaaggcccaggacgagctgatcgacgaactcgaagttagagtcgaccagctcgacaagggccgggcggtctgcgaccagctcgaacggaagcacggtctgtccgcgaaggcggtctcgatactatatggcgtgatccaggaggagatgttcgactcgaccaagtccatgacgctgaacgatgccgcataccatatcagactatccaagcaaagcgcgagaaagtacgtgggagagctcatggacgcgggcctcgccatccagtccgggaagcgcccactgaaaatacgggcatcggaatcgttgaagggcatccttgaggccggaatgggcgaggacgccggagagcatggcggcaaaacccaacaagaagaaacagaaaccgcccacgagggcgatcccgcataactcaactatccggaaattccggatagttgagttttcattaaccatcgcggccggatggatggtcaaggtttatccgctgcgtgaaacgtcgagtgagacgtgtttcacgcggcggaactcccacgtcccgtccgcgcgatggacgatgctgccagatcccttcgtacgtcgtctgccattggccgccatgatgttcctccctgtcgggagcgccttcgggcatctgccgcaagcgccctcccaagggcactctattggcactctatccgggccacaaacggccagatacgtggcaaaaacggccatttcccagtaatcgaaaaacggcggaatccgcacgtgtccggagaccggaaacgttgggattccgccgtttctcagggctgcaaccccctacttgctcacattgaacttgaactcgacgatgtcgccgtcctgcatgacgtagtcgcgtccctcctgacggagcttgccttcctccttgatcttgaccatggagccttcggcggccacgaagtcgtcgtaggagacgatgtcggccttgatgaagcccctttcaaaatcggtgtggatgacgccggccgcctgcggggcagtccagcccttgtggatttgccaggcgcgcacctccttgactccagcggtcaggaaggtctgcaagccgaggatgtcgaagccgacgcgggcgagctggtcgagaccggattcggacaacccggcgtcctccagcatctcgcgggcgtccgcctcgtcgaggtcggtcaggtcggattcgaactgggcgttgaggaacacggccggcgccggcgccacggatgcggcgagcttggcctgcaactccttgttggcgagctcgttatcgtccacgttgaacacgtagatgaacggcttggcggtcatcaggtgcaggtcgtagatgtcgcccttgttgatcttgcctgcggcggcggcatggtcgatggtctcgccggcttcaaggatctccttggccttcttgaccgcgtccatgtacgcctgctcgatcttcttgccgcgcaggtccttttcgagcttcggcagcgcgttctcgatggtctgcatgtcggcgaggatcagctcggtgttgatcgtgtcgatgtcgtcggccggatccaccttgccgttgacatgcacgatgtcgtcgtcctcgaacgcgcgcacgacctcgcagatcgcgtcggcctcgcggatgttggccaggaacttgttgcccaggccttcgccttcggaggcgcccttgacgatgccggcgatgtcgacgaaggtgacggtcgcgggcacgatcttctcggtgtgcaccagctcggcgagcacgggaaggcgcttgtccggcagcggaacgatgccggtgttcggctcgatggtggcgaacgggtagttttcggcgaggacattattgcgcgtcagcgcgttgaacatggtggacttgccgacattcggcaggccaacgattccgatagttagagacatagtatccagtattggtgtcaaggtggacgttggccgcgccgatgacgcaattcgttgcagcgaatcgttctcaataacaaaagtgcgagtctcacgctcggcaaaacgaacatgaacaccgtatattgcccggaatataaggattccggacaatgtgcggttgagtggttttgttcgttttcctcacacgtttcttattgagaacgattcgctgcgattggcagacagcaaaaacgtcacagctcagccgcgccgatgcgccgcactgcctcgcgcagcagcgattcgtccttcagcaggctgagccgcacccaatccttgccgacgcggccgaagcacgtgcccggcagcccggccacctgcgccacgtcaagcaacgcgtcggcgaaacgttgcccgctccacccctcaggcgccttgaaccacacgtagataccgccgacggagtcgaacacgtcgaatccgagcgagcgcagtcccccggtgacgatctcgcgccgcccggcataccgccgggccagttcgtcgacgcacgactggtcgctgttcagtgccacggcgccggcatcctggatcatgccggcgaccatcgaacccatctgataatggtattgcttgagccgtgcgaccacgtcccggtttccggcgacgaacccggccctccacccggccatcgcgtacatcttcgacagtgaatccacttcaacggacacgtcggacgcgcccggcaccgtcagcaggctgacctgctggtcgctcacgccgagtcccgtgtatgcgaagtcatgcacgatgaggaagccgtaccgcttggcgagctccaccgcgtgctcgaagaatgacgccggcgcctgcgcgcccgtggggttgttcggatagttgagtatcagcatgcgcagccggcgccacaccgattcgtccaccgcgtccaggtcgggcagccagccgagttcggcgcgggcgggcagcagtatctcctccgccccgtgcatgacggacatgcaatggtacgacggatagtaggggtcggcgaacgcgacggcgtcaccgcggtcgatcaggatcgcgaacagtccggcgagcccgtcgaccgcgccttccacggcgaacagctgggaacgccagtccagttcgacaccatgcacgttgcggtaccagttcgcggcggcctgcaggaacgccggcttaccatcgaacggcgtgtatcgcgcgttgagcgggtcgtcgaccgacgatttggcgacgtcgcggatgaattcggccgggtatgcgtcggggttgcccttcgccaggtcgatcacgtcggcgccggacgccacggctgcggcgaccttcacgtccatgtcggcgaacacgttcggcgggatgatctgggcgaccggcgcgaaccggggcgcccatacgccatcgcgggtgtcgtcgtcttgtgcggcgctcattgcggtattgctcctttgggatggggttatataggaacggaaaaagaggggacatgtggcaaggaccgccctccggcgttacgcgccatctcccgccagcgggaggtggcatgccgtcgccccgctggcgaaggactgtcggcgtagccgacttcgggcggtccgaggaggaagcgaatctcagtgctgcagccgcttggcgagcaggttgcagatcagctggctgacgaacacgatgacgagaatgatcagtgtagccaccagcgtcacgtcgctctggaaccggttgtaaccgcggatgatcgcgaggttacccaaaccacctccaccgaccacgccagccatggcggagaaggcgaccacgttgatgaacgacagcgccgacactcggatgatcggcacgcgcccttcgcgcaggtacacgcgccatatgatgtcgagcgtgcccaggccggatgccttggccgcttcgaccaggccggggtctatctccagcagcgcgttctcgacctgccgggcgtagaacggcacggtcgcgcccacgatcggcacgatcatcgcctcggtgccgatggaggtgccgacgatcactcgcgtcacgccgaccagcagggccatgagaatgatgaacgggatggatcgcacgatgttgacgatcttgtcgaggatgttgtagacgatcacgttctgcgtgagcccgccgcgtctggtaagcaacagcagcagaccgagcacaaggccgatcgcgtatccgatcaccgcgccgacgatcaccatgtacagggtctcgtaggtcgcgtcccagacctccggccagatcatcgacacattcggcagccatgtctccagcagatcattcattgtcgttctcctccacctcgttcacatgcaggtcggcgagcggcgtcgcgctcaccccgaccgtcgggaaatacgcgagcgccttgctgaccgcctcggccggaccatccagactgaccaggatcatgccgaccggcgtgccgtgaatcacgtccacgttgccgaacatgatgttgcctctcacgccgaaccgttcgcgtatgtcggccatcagcgtctcctccgcaccggagccgaccgagaacagcaggtacacgctgccgctctcccgctccttgctgaacagcgggtgctcctggacgagcgtgatgcccttgttcatgttgccggacgtgtagatgaactcgcgggtcagttcgttggacgggtggtcgaacacgtcgaggatggacccgtcgtcgacgaccttgccgtggctcatgaccgccaggtcggtgcagatgtccttgacgacctgcatctggtgagtgatgagcacgatggtcaggccgagccgtgcattgaggtccttgagcagggcgaggatcgaccgggtggtgcgcgggtcgagcgcgctggtcgcctcgtcgcacagcagcacctccgggtcgccgatcagcgcacgcgcgatggcgacgcgctgctgctggccaccggagagctgccgcggatacgccttggccttgtcggcgataccgacgagttccagcagatgcatggccttcgcgcgggcgtccttgcgggataccttctcgtggatgagcggcagggtgacattgtcaagcacggttctggatggcatcaggttgaagtgctggaagatcatcgcaatcttgcggcgcagcggtagcagccggccctcgccgagcgtgctgatggtggttccgttgaaggtcacggtgccgctggtcggacgctgcaggacgttcatcgtgcgcaccagcgtcgattttccggcgccggagaaaccgatgatgccgtatatggagcccttgttgatggtcagggacacgtcgtcgacggcgcggaagcggtttttgccgcggccgaattcgacggtgacgtggtcaagcgagatcagaggggcgccggcggcgacggaatccgaagcctccgccgctgcggctgcggttgcgttgacggttgcatcgctcacgcggcctcacccgcccgacccgcagcaccatccgccccatcgacggcggacttgccggccgccgcgagcacggcgtcgaggatctccttctcgccggacagcacgaagtcctccatcaccgggctgaacggcagcggcgtgaaccgcgcgccgacgcgcagcaccggcccgcgcagataatcgaaatggttctcggccacgcgcgccgcgatctcgccgcccacgccgccgatcttgatggcctcgtgcgcgacgaccagatgaccggtcttcttcaccgacgcgtagatggtcggcatgtcgagcggcgtgatggaccgcaggtcgatgacctccacgctcacgccgtattcgcgccgtgcaacatccgcggcagcgagcgccttggtgagcatcagaccgtaggagaccagcgtcacgtcggcgccttcgcgcacgacctgcgcacggctcaggtcgatgggcggcaggccctcgggcacgtcgcccttgaccgggaacagtcccttgttctcgaagtagatgaccgggttaggatccttgatggccgccttgagcagctgcttgccgttggccggcgtcgagggcacgaccacgcggatgccggggatgttggtgaaccacgtctccagcgactgggaatgctgggcggcgccgtgcttcatcaggccgtcgggcgcgcgcagcaccagcgacatggtggcctgtccgccgaacatgtagtgcgccttggccatctggttgagcacctcgtccatggcgatgccgatgaaatccgcgaaatgcaggtcgatgaccggcttggcgccggcgatggccgcgccgacgcccgcgccgacgagcgccgtctcggagatcggcgtgtcaagcacgcgctcggggaattcgtccttcatgccggcgaactggccgaagatgccgccctgcttggcgatgtcctcgccgtagacgaacacacgttcgtcggctcgcatctcttcgagcatggcctcgcgagtcgcctcgccgaatgtgatgattcgctcactcatacaggttcacctcatcgctgaatacgtcgtccaaggcgtcctcggccttggggaatggactgtttaccgcaaattccagagcctgtgcgaactcctggtcgagccgctcctccgcggcgtcgaggtcgtcctgcgcgacgacgccttcgagcaggatcttgcgccggaaccggtcaatcgggtcgttgtagagtttccattcctcgacctcctcctgggaacggtacttctgcgggtcggtgatgaagtggccgtcgcgccggtaggtcttgcattccaggatggaggggccgtcgccgcggcgggcgcggtcgatgagcttggcggaggcgtctcgcacggattcgacgtcgttgccgtcgacggtgacaccggggatgccgtatccctgagcgcgttccgacaggtagtccacgttcttgatgtcgtcgaagcgggtggtggatgcccacgcgttgttctcgcacacgtagatgaccggcagtttccagctggcggcgaggttcacggcctcgtggaaggtgcctcggctagatgcgccgtcgccgaagaagcacacggccacgtcgctgccgtgccgctgcttgatggcgagcgccgcgccggtggcgatgttgaagccgccgccgaccacgccgttcgcgcccagcatgccgacgctgaagtctgcgagatgcatggagccgcctttgcccttgcagtatccggtggtgcggccgtagagctcggcgagcgaacggtcgacgcgggcgcctttggcgagggtgtggccgtggccgcggtgggtgctggtcacgtaatcgtggtgggtgaggttgctgcatacgccggtggcgacggcctcctcgccgatgtacaggtgggcgggtccgacgatccccttgccgatgtgcgccttgacggtttcctcgaaccggcggatcttgcgcatggtggtgtagaggtcaacggcctgctgcgtggtcaatggtgtgctcatgatgtgcgggctttcgtatgttccttggtttgtttcctgttggatgtgggcggcgcgtgggcccgtcccgacttgtgccgggccttgcgcgggaatcgtcgcggcatggccgtctcctgcatggtccgtctgacgacctgtgcggccgtccttcacggatgccatgccgggccatatggccgacctgccatgatgccggccggagggccgccacggcgcggaccgtccccttggtccgcgccatcccgtccggctggcatcatgtcttctcggcgagcactccccttcagccgagatgcgtcgacgttccccgttcgcgtcgcttgtcgtgtgtgttgttatgttgcgtgctgcggttgcggcggcattcgccgcatgtcaccacagcggaatgacggcccccttgtacagcttgtcgatcagtttcttgacgtcgtcgctgcggtaggcgtccacgatcttcttgtaggtggcgttgtccttatccttggcgcgggagacgatgatgttgtagtacggcttggactgctcgttgaccggctcgatgtagatggcgtccgacttggggttgagtcccgcgtcgagggccatgaacacgttgatgacgctggctccgacgtcgggcagcgaacgggcggtctgcgaggcttccagctcggtgatcttcaggttcttcgggttggacacgatgtcgtccggcgtggggttcgcaccttccttgtagtcgagcttgatcaggccggcggactggagcagcagcaggccgcgggccgcgttgacggagtcgttggcgatggtgacttcggagccttccggaatgtcttcgaccttcttggccttgtcggagtacaggctgatcgggttgagcaccgtctcgccgactgcggcgagcgcgttgtcgtgcgtcttgttgaagtcgtccatgaggatgtagccctggtaggcgttgaggtcgatgtctcccttggcgagcgcctcgttcggctggatgtagtcggagaacttcaccagttcgacgttgatgccctccttcttcaggttcgggatgacgacctgatcccagacctcgttgctgtcgccgaccacgccgaccttgacggtggtgccggagtctgccgagctgctgttcccgcacgccgtcagaccgccgacaagcgatgtacgcccgtcggatcgtgggatgggcgtgcgccatgaccatgaacacgcaggagccgccgttgcaggcgttggggcaggcgatctcatgggccgcgtcccgcggcggcacggatggtcttatccaccacggcgaccatggcacgcagtacatcagcacggtgtacaccaccggggttatggaatatgggatgctgccgtcgaccggcaccgtcggcgactcgtacgacaacgccatggccgaaagcgccgacggcgcgtacaagaccgagctggtatggcgcagacccttcgcggatctgaagacctggaattggcgacgttccggtgggtctcgtggtggaactcgaagcgcctgcaccagtccctgggctacaggacaccgcaggcggtggaaaccgagtattatcaacatcaagcggcacaagccgcctcactataaggacggaacaaaaatcaggccacttcatacattttagtgttcagctgtggacgaacgagtatctagcggatgtctgaaaggtggctggaaggttaactgggtgacgggcggcaaacagatgtgttcaaggtggacaacatatgcgcgcgcaagtgttgggcgtcattcgctggtagtgcaccaaaaagcgctgtctgcatgaagccttctacagcagtcccgccatgtagatcggcagtttgaccacgtcattttccacaaccagcggtttcggatgcagcacgtatctggtgccgaccttcttatcgaattttgccttgaatttgtctaacgagaccgtgcggtagcgtttcgatgacttgacctcgatggggctgaccctgtacttcattgccgcgttctcgtacggttcgacgatgaggaagtcgatctccatgcggttcgacgggtcgtcgcgatcgctgcgcgaatagaagaacagccggtgcccgttgacccggagaagctgtgcaacgacgttctccgcgagcatgccctcgttgatctcgatgcgttctaggaggatgtcccggtacaggttgcttccggtctgttccgagtcggccagggcgagcgtagtgagaagccctgtatcggcggcgtagcatttgaccgtcgaatggtcctcgctaatgctcaagcccacgctcggatcggtggaattgaaacagtcgttggtaatgaacgcatcggaaagccagaagaaggcgtcctcgtaatcgcgggttttcgctttctctcccagcgatgtgatgttgaacttcttctccttcttggaaagctgacccaccaggttgtcgaagatgcgcgtgatgcgtatccggtcgctgccgccatgcttggagatgtcctgcttgtacagtcggaggatgttccgtttgacgttgtcgactttgctgaaatcatgggtctcgacgtacttcgacacagcctggggcatgcctccgaccagcatgtattcacggaatagccgcatggctttcctgtgcagcgaatcggggagcggcctgcgcttcttgaacgagtccgcgatgagcgcggacagtggcttttctcccaaagcccagaggaattcatcgaaatccatgggattcaggcggatcgactcctcctctgatggaatgaggatgtccttgacgttctcgcggatggagacgagcgagcctgtctcgatgtagtcgtaacgtccgtcagccaccagctgcttgatggcctcgcgggccttcgggtacagctgcacctcgtcgaaaatgatgaggctatccctcctgtgcagttccactccgtagaaggatgacaggtacatgaagaacgcgtcgaggtcgttgcgcaggtcgacgaagtagcccagcacgtcatcgggggctttcgagaagtcgacgagcatatacgacgcatagttccgtcgtccgaattcctccgcgatggtgcttttcccgacgcgccatgcgccctcgatgagcagggctgtgcttccttgggaagaatccttccaggaagccagtttttcgtacgcttttcgttcgaaagtttccatgtctcaccgccgtagatacaccaaatcaaggataactaaggtgttgtatgtacaccaaatcaagggtaatgtaatggtgggttgctgatcggcttgaattagatttctgacaggtggtcttatatatggtagattctggcgttcgtccggacgtatttcgcttatatgtggcagctcgtttttgtgacagaccggttagggggtaattgtgtaccctctaactgcggtctttctggaatgaactgccatacataggcgagatgcctccggtcagccttccgaatctgccatctataagccagtttgtggaatcgctttatggctatgcacccctgcgatgcgattgaatatccgcggcaaggcaggacgaagaagaccggtaagacgccgagttcaagttcaacatctcgaagtaagtgtttctctggctcccctctttgaggggagctgtcgctacaagcgactgaggagcggcacggataaggcctgagaagtcgtcttctcgggcctttgtcatgacattgttctgcaaggactggctgctgcagcagcataatgtgtgttttattattcggccttggcggcttgctgatcaatccaattgttgacgtcggtgaccgcctcgtcaagggttgctttggcggctttgttgtatttggaatctacaggttggcgatttccgctccgaatggccagagcgcaagcttggccatcttgaacgcttgaatgccgagcgggatgccgatgatggagatgcatagaatcagtcccaccaatgcccatccgattgcgatggccaacccgccaagaatgatccacaggatattgccgagaactcgcatgatttgcccctttccgattccggtcgatgcctcgcatgtccggcttcacttttttgccagacatcatgacggaaacacgagacgcaacccttggctcgcccctgattcatcctcggaccgctacccaggcggatcgtatgcggtaggcccaatccttttgtaaagattttgtgtattgtcgggcatgcgtgggtttcaccgtcgatctgaatgatgataggcttctcgatgtctgccgtacgaagacccatcaaggagatgccatgaacctgtatcgctacgcgatgttcatcgcacacgcctgccgtgggtcgttcgtcggcaatattctgtttgccaatccacaaatggccctattctcgatgctggtgtagcggggacacgccttatgccgggatgtaccgatggcccatccgcagtcgacgtcgcatgaatcgctcaccatagccatcaacttacgcaaagccgcgaatcgtttgccgtatatgaatgcggaacggatggcggcttttcctttaccccggactcatcggtgtccccgcatcttgacacaagtatgaggccggatcgcccacacatgccgttaccaacagaaggaaatgctgtgacctcacagaaaaccgcggaatccgggtccgccgccagttccgtaaagcctattgattcgcacgcccgattcatcgtcgtgggcgtgatcgtcgtcggctcgttcatcgcgctgctcaaccagaccgtcatgtcaccggccttgccggcactgatgcgtgatttcaatatcaccaccggcaccgtgcagtgggtgaccagcgtctacatgctggtctcgggcatcatggtgccgatttcaggctatctgattgataaattctccacccgaaagctcttcgccggagcccttgccactttcatgatcggcacactgctgtgtgccgttgcgccgaatttcgtgctgttgctcatcggacgcgtattgcaatccgccggctccggcgtgctgttgccattggtcgccgtagtgccgatgctcgtctatccgccggataagcgcggcaccgccatgggcatggccggtatcgtcatggccgccggcccggctatcggcccggttgtcggtggtctggtgattgacagtttcggatggcgcctgatgttcattggcattgcagtcgtggcactggtcatccttgtcggaggcacgatgatgctcaagaacgtcagcgagttgaagaacccaaagctcaacgtcctgtccgtgatcctttcgaccatcgcgttcggtggcctgctctatggcttctcgtccgcttccacgatgggatgggccagtccggtcgtcattacctcaatcgtcgttggtcttgtggccttcgtcgcattcgtatacaagcaagtcaagctcgatgagccattgttgcgcgttgacacccttgccacccgcaacttccgcaactccgcgattctggtcactctgatcaacgccgcagtcgccgcaaccaacgtgacgttgcctatcttcatccagaatgtgctcggccaatccgccaccgtcaccggcatggtcatgctgcccgctgcggcggtcggcatcatcctgagtccggtcgccggtgccgcattcgacaaattcggcccgcgcggcgtgggcatcggcggccttgcgctcatgaccatctctcttggtcttctcggcaccatcaacaccaagacatcagtgctgtttgtcgccgtgttctgcgcattgcaggcatctggtcaggctatcgccaacatgccgatcaacacttggggcgtcaacgctttgccgaacgacatgatcgcccatggcaacgctatcgccaacaccggccgccagatcgcggcagccattgcgacctcgcttctggtcaccgcagaaacatccgtgaccgcctcgcacatgtcccagggtgtgaagtccgccacggccagcggcattgcgttctcctacctgctgtgcgccgccatctcgctggtcgccctgatcatctgcatcttcaccgtcaccagccgtgccaaggagaaggccgcacgcaacgccaaggcctacgaggcgcaagcctccgccgaagtcgcggccgaaaccactgaaggccagcccgccgagcatcactacgccggcgcatacgtggcccccgcctcctccctgttcaagcaggcccaggaacagtccatcggcgggatcatggacgatcagccctacagctgcttggacagcgatgacatcacgcatgtggtgcgcgagttcatccgcctcaacgtttccagccttcccgtggtgaacggcgatggcaggctcgtcggcttcgtcagcgacggcgatgtcatgaaatcgattgccacctatgaatcccgtacggtttccaccggcaccggttcgacgatggtggtgttcgacgacgaaaccgtggcctccaaggtgcaggcgctctccggcaagaaggtgatggacatcgccacgcgtaaggtcgttgccgccacgcccgaccagcatgttggagaggtggcccgaatcctcgccaagaagcagttcaagaaactgccggtggtggatggtgatggcagactcgtcggtgtgatccgccgtaagtccgtgatggaacatgccttcgacgcgctgttcccaaaggatgatcggtgattcggcatcatcatcgctgaatagaatgaatggaatatgaggcttcccttctcgcgggggaagcctcattgctttgtccgcggagtcttacggcacctgcgcaagggcaacgtcacgctttcatgatgcacttgaatagtgtgttcctatcgttgcatggtgacgctaatgcatggcgtcacgatactgaagcctgccatctaacggcgggtacggctcgttgctggagtcgtgcacgcatacgcgcgtcggcgtgcgtatgccgtgatgtgacctttgtagtggaattgaagagttgagaggcttctgctgttttcgtgggttaggttcttggttgtggtaggtgtatgtcgagtccgtcgcagcggagcatgacgagcgcgatgaggctgccgacgtggcctgatttctgttccccttttattgtgagacggtttgtgccgcttggtttgcatgatactcggtttcgatctgttccggtgtcctgcagcccagcgactggtggagacgcttcgagttccaccacgagacccaccggaacgtcgccaattctggctcggccaggtcggcgaatggcttgcgccgccacaccagctcggtcttgtacgcgccgttgacgctttcggccatggcgttgtcgtacgagtcgccgaccgtgccggtcgagggaagcatgccgtgttccctgacctgggtggtgtacaccgtgctgatgtgtgttttgccaaattgaagtagtccagaatggcgtgtcaattcaatctcgtactctacgggcccgtcggcgccggcaagacgcatctcgcagtcgcgttgggcaggctcgcgtgcatgcgcgcgataccggtcgggttcttcaccgcgaccgggctgctcatgcggctgcgccgcgcgaaacgggggcggctcgacgcggagcctcggcagatcgccagggcgaggctcccggtcatcgacgagttcggctacatgccgatcgacgaggagggctccgggctcctgttccaggtcatatcggattcccacgagacccggagcgtggtctacaccacgaacatcgagtgctccggctgggggggggcgtgctcggcgacaagaacatggccgccgcgttgatcgaccgcaccgtgcaccacggaagactcaccggattcgagggaggctcctaccgtagcgagcacgccctcatgaccagatagccaggaagaaaagggcggcgggttccgacggcgcagtttctgttggaaaccagccgcctacactgctgaaaaatagtgcccatactgtggacgccaacttgcagaaacacacaacttgaccaccgagaagcgcgccgaccgccagtacgacgtggagttccgcgacgtctcgttccgctacccaaacgcgctcgaggacgcgtggggcgttgcggcacgtcaacctgaagttcaaagtcggctcccgtcttgcggtagtgggcatgaacggcagcggcaagaccacgttcatcaatctgctgtgccggctctacgacccgatcgaagggcaaatcctgctcaacggcatcgacatccgcaaataccgttacgacgaatacatgcgcatcttcgccgtggtgttccaggactttcggctgttcgccctgccgctcggccagaacgtggcggccggtgcgcactacggcagtgagcgcgtgatggactgcctgagtaaggccgacttcggcgaccggttgaagacgctgccggacggacttgacacgcccctgtacaaggagctcgacaagaacggcgtggaagtctcgggcggcgaggctcagaagatcgacatcgccggcgacaagacggccgtgtatatcagccaccggttgtcgtcgtgcaagttctgcgacgacatcgccgtgttcgaccatggcgcgatcgtccagtatggcacgcacgaccagctcgtggccgacgaaaacggcaagtactacgagttgtggcatgcgcaggcgcagtattacgtcaaggagtaggcgccgcgggtggcggatgcattgtcgtgcgtcggcatgggcggcagcccgacggtgccgcccatgccggaaggccggtaagtacgggcgcccgcggccggtcagagcggcagcaggtcgctcaggtcgtcgcgctcgccgacggcggtgatgcgtcccgcgtccttctcttgggaccatgtggtgatgccggcggcgagacggagccacacctcggggtcgagctcgatgacatcgggcggtgtgagattgtgagggtcggacgccgggccatccaggatcttcacggctccccatggtgcgactcgcacttccacgccggggccgggcgccttgcgctccagcagatataaggtgtatcgcaccgccatcgcccatgtcggtcggggcagcgccggcatcagggactccgagtccgccccgtcctcgcgcagtcgctgcgctgcgtcgttccactgctgccacgcgcgctcgcccgcgggtatgtctcgttctcgaattgcggccatgactccattgtgcctctaggggtgacgattgccttttcgcatcggccggcggttctaggtgtggtttcggatgcttgcatttctgcaaaagtgtttcatcgggcttgcatcaggtgttgcaatacgttgttttccaacgtggcaacgttttctgtcgtctcaaaatgtggttgatatatagccgatttggcgtatttatggcaaatcctgtatgatattccatgtttctgcaaacgattgcataacgttacgcagcgttcaccggaacttattggcgtggtcaccaagccgtcgcataataacacaggaagcataatccggaaagagagtcagacatgactgaaatcactgcacccaagtcacctgtcacgaccgccgagttcgcggacggcatccgcgaacagctgaagtacagccaaggcgtcaccgtcgagcaggccacccccgccgacgtgtacgtcgcctcctcgctggtggtccgccactacctgcaggacgcatggttcaagacccagcaggacatggtcaatggcaacaccaaggccgtcggatacctgtccgccgagttcctcatgggcaagcagctgcgtaacgcactgctcaacgccggcatgatcgaccagttcgacgaagccgtcaaggacctgggcttcgagccgcaggacgtcatcgacgtcgaacacgagccgggcctcggcaacggcggcctcggccgtctcgccgcctgcttcatcgactcgctcgcgtccctcggcgtacccgcgttcggctacggcatccagtacaagtacggcatcttcgagcaggccttcgacaaggacggcaagcagatcgagaagcctgactactggctgaccaacgaagagccctggggccacatcgactacaaccgttcccagaaggtctccttcggcggcgaagtcgtcgaagagaacggcaagaaggtctggaagccggcctggtccgtgcgcgccgtgcccgtcgactacatggtccccggctacgcatccggccgcgtcaacacgctgcgcctgtggagcgccaagagctacgacgaattcgacctgctcaccttcaacaagtccgaatacctcgacgccgtcaagccgcaggtcaaggccgagaacatctccaagattctctacccggaggattccaccccgcagggcaaggcgctgcgtctcgaacagcagtacttcttcgtggccgcgtccctgcacgacgccatccgcgtgttctaccccggccagagcaagcccgacctgaccaccttcccgagcaagatcaccttccagctcaacgacacccaccccgtcatcggcatccccgagctcatgcgcatcctcatcgacgagtacggctacgactgggacaccgcctggtccatcaccaccaagaccttcaactacacctgccacaccctgctgcccgaggcgctggaagtctggccggccaagctgatctccgaactgctgccccgccacatggaaatcatcaacgagatcaacgagcacttcctcgccgaactcaagaccaagacccgtgacaaggccaagatcgagcgcatgcgcatcgtcaccgacgaggagaaccccaaggtccgcatggcatacctcgccaccgccggtggctcccacgtcaacggcgtcgccgaactgcactccgaactgctcaaggacgtcacccttcgtgacttctccgacctctacggcgacaagttcaccaacgtcaccaacggcgtcaccccccgtcgcttcatccgcctcgccaacccgcgcctgtccgccctcatcaccgaaggcctcggcaccgacaagtggctgagcgacctcgaactgctcaagggcctcgaacccctcgccaaggacgacgaattcgtcaagaagttcgccgccgtcaagcaggccaacaaggaggacttcaccgcctacgccaagcgcgaatacggcttcgacctcgaccccaacaccatgttcaacaccatggtcaagcgcctgcacgagtacaagcgccagtccctcaagatcctcgcgctgatcgccaagtacgccgacatcaagtccggtcgcgtctccgccgacgatgtgcttccccgcaccgtcatcttcggcgccaagtccgccccgggctactacctcgccaagatgaccatccagctcatcaacaacgtcgcccgcgtcgtcaacaacgaccccgacgtcaagggcaagctgcacgtcttcttcccctggaactacaacgtccgcctcgcccagcacctcatcccagccaccgacctcgacgagcaaatctcccaggccggcaaggaggcgtccggcaccggcaacatgaagttcgccctcaacggcgccctcaccgtcggtacgttggacggtgcgaacgtcgaaatccgtgagcgtgtcggcgccgagaacttcttcctcttcggcatgaccgtcgacgaggtcgacaagctctacgaagatggctactcgccggccaagtactacgaggccgacccccgcctgaaggccgccatcgacatggtctccgacggcaccttctccaacggtgaccgcaacacctacgcccccctcgtcgccgactggctcaccaaggactggttcatgaccctcgcggacttcaccgcctactccagcatccaaagtgagatcgaagccctctaccgcgaccccctcgagtggaaccgcaaggccgtcctcaacgtcgcgaactcgggctacttcagctccgacaggtcgatccaggattatctcgacaacatctggcacacctccccgttggcctgattacggagcgtcctcgtcgttgctcctcagtcgcggtacctttgtaccgtttccttcggtgcgcctagaggacgcacacgtaatcagtccaacgggctgcgcccgcttgccgactgacggcgtgtaacgtgattcgcccccgctggcgggggcgaattttgttttacatcactgcgcagcgcggcgaatggcgaacacggcgactgcggcgattggcagcaggaagccgcttgcaagcatcgccatcaccgggcttgctcggcgtggtcggctgctggccaccattcgacgcgatcgcgaccgcgaacgacgcggatacgcctgagtctcgatgttcaatgatccggaaagatcgtaatccaaggtcttcgcctcatcgaacgtccagctcacccaaggctcgggcttcacactgcccttggactgccagtcgccccacgcggtgtcggtattgccatcgcataggttcgaaaccggcgtcttgctttgcgaatacgacgcttcgagcttgccggcaccgcatacgttgctgccgtttttcgatcgtggcggcggtggggcatgtctcgacgaagaggggcaaggttggaatcgccatgcagtgagccatccagaacccttgtctgccgcattggggctctcaaaactcgcagatacaccgcaatacttgctgaaaatggtctataactgcgagttttgagagccccaatgcggcacaacatgcgagaagagcctgcctgcgaaatgcagacaggctcttctcgcggacacatgtgtgcctacgacgattgactgttagatgaactcaggcggcttccggggctgcttcggcctcatcggcgtcgcccttgtcggcgtccttggtcaggccaaggtcgaccggggacgagctgttctcccaaggctcctcccacggatcataatccgggttctgctgcttgtagatgtacagaccaaccacggcggccagcagcgcaccaaagaacaacgcaaagaacttccaaccgtttgaagacttgttctccatgacggctcctttcccaatcctggttggcttgcccgttcaaaaccaactctgggttccatcttaattccaaaaatgtggcgattgcgtgcgggaatgcttttgctttgccggcggtgcgcacgacgagccgggagcgtgttgtttcaccgtccggcgaggagatgcgattccgctacagtagatgacatgagtaatggccgattcagtttgtttcccggtgcgccgtcggcgcacaacctgttctccaagcgtgcgattcaatatcagtggcggtcgaacggccccgtgttcaccagcgcgatcatcatcgcgtgcgtcgccgtgtgggttgtcgagatggtgttcagcctgttctggcctcttggactcgcaaccatgatctattacggccggttcgacccgatgacggcggtcgcacaaccgtggatgttcctcacgtcgatgtttctgcattcgccgaagtcggtgctgcatatcctgttcaacatgctggcgttgtggagcgtggggccggtgctggagaagatgatggggcattggccgtttctcgcgctgtacgtgctttccggtttgggcggcggtcttgggctgatgtcctgggccgcgctgtggccgggtggcaccgggtggcttggtggtgcctatggcgcgtccggcgcgttgttcggcctgttcgcggcgatgctggttgtgtaccggcgcatcggagaggatatccgttcgatgctggtctggatggcggtcaacttcctgatgccgttcctggtgggcggcatcgcatggcaggctcatgtaggcgggttcatcgtcggcggcgtattcacgtggctgctgatttccggcgtgcacgcgttgcgtggcaagagcctgacgttccggacgatggtgtacggggcggtggtgttggcgctgatcgtggcaggcgtgctggtctgtaatctgagcaatccagctctgacgtacatcatgtgattggcctcttacccggtgaaagtcccacctggcgcggcgtgttcgagaacagcaggcgccgttacgggtacaggcgcgtccacctggaattgaggggcgcgggcgtcgtcgtgtccgccaaacgggtcatgcgcctgatggcccggcacgggctcgtgcccgtgtccaggagcgcgaggcgctactcctcgtacaggggtgagatcggcgaggcgcccgtcatccactcggaccgcggctgccactaccggtggccggaatggatacgcatctgcaagggccacgggctgacccgctcgatgagcgcgaagggctgcagcccgggcaacgcggccgcggaggggttcttcggccgtctcaagcaggagttcttccacaagcgcgacttcacgggcgtcacggtcgacgggttcgccgacgatgctcgacgagtacatgacatggtaccgcgacgaacgcatcaagaccgagtacgggatgagcatcatggacaggcgcatcaagctggggctcgtcggctgaacacatgtgataacctgccagacaaccatacagacaacgaagtccaacaaaacgtcaccgcccccgagcttgtgatgggacttttgtggggtgggcggggcgctggagaatggctcggggtggaggcgtcgcaccaatgtgaattacatgcgtgtagttttccacatgatgtggagaactttgtggacaacttgggtataagttgggtataactcgtggataactatggtgaataagtccgtgtgagctctaacaatgttggaaatactgggttttgacacattgtggacaatgtgcacaatgcgaataagagttatccacaattgtgtataagtatgtgaataatgtggataacatggggaaaaccggtggatagacagtgcacaacttgatttgcggagcatccgttacgggtctcgaagccagggcgcgatgacgctgccgggataccatggcactatggatatttcgtctcagaccagtcggttcattgcggcgcaccgcaatcaggatgtgcgcgacctggcgctcagcgccaaacgcgtggacgggcttgacctgccattcgcgctcgaccagatcgccggctggcagactgcgtgccgcaagctgccgcaatgggccgagaccgacggcatcgtctatccgccgcacatctccatggaacagtgctcttcccagttcgccgcgcagtacaaggccggcatcgcaaggcgcgtagcgggcgccggcggtgcgatggtcgatctgaccggcggattcggcgtcgattgctcgtatatcgcgcgtggattcagccgggcggtctatgtggagcgccagcctcacctgtgcgagctcgcggctcataatttccgggcgctggggctcccgcacatggatgtgatcaacggcgatgcggaggattggctgcgcggcgtcgttgacgcccgcgccgcctccgcagactcggccgcagtcgattcagctacagccgttcccatcgcgctgatctacctcgaccccgcgcgacgtgacgcgcatggcggccgaacctatgccatcgccgactgcacgccggacgtactcgcgctgaaagaccgtctgctggccgtctcgccgcacgtcatggtcaagctgtctccgatgctggattggcgaaagacggttgcggacttcaacggttcggtcggcgaagtgcatatcgtctccacaggcaacgaatgcaaggaactgctgctggtgctcgaccgcggttcgcacgacgccgtacgcgtgatctgcgtcaacgatggcgacgtattcggatacgtccatgacatgaagaccggcgcggattctgacggcgtggtcctcgccgccgcaggagaaaaaggcagtcagggcgggtctgcagagccgccacacgccgctccggaacagcccaggtatctgtacgagccgaacgcttcgctgatgaagggcggctgtttcgcgctgctggaagaccattatggtatgcgccagatcggcccgaacagccacctgctgatatcgggcacgccggcgccgcagtttcccggccggggatttgtcattgaaaccatcgcgggtatgggcaagaaagagctgaaacgggctctagcgggcgtcgacggggcgaatatcgcagtgcgcaacttcccgttgaccgctgtccagctgcgcaggaaactcaagctggcagacggcggcgatgtgtatctgttcggcacgacgtccgtcgatggccgtcatgtcatcgtccgcaccgtgaagcagtgaaaccgcgaaaagggtatgacaacaacacagtttggcggtggcgcagcaccatgccgcgccaccgccaaaccgtaacgtcgcttaccgtcgatatggagctggctaccgcgaggggatctcgccgctcagcgccaccacatcgtcatgatgaatccgaccataatgatcgcgaaggcgattgccaggttccaagcaccgatacccgggatcggccacgtgccgttcggcgacaggtagtagaccacggcccagatcaggccgatgatcatcagcgcgcagaacagcgggacgaaccagcgcgggttcgacttggtgcccttgatggtctcctcgacgcggcgcgtgttctccgcctgccgcgacatcatgcgctgcatctgcggggtcatctctgacttgtcggcggtggcgttgagcaccgcctgcaccttgtccatggagacgccgtaatcgtcatcggcctcgtcggtctcgttggtgtccgtgtccttgacgtcggcgtcggtctcggcctgccagtccttctggtcttccgagtcggtttcgtgcagctctgtgtcagccataagcgtagtctccattcaataggctaaaaaatcataatagcggttacactcgaaagttgaacacactgggaggaatcatggccagacacaccagcaggcacgccgcccggcgcacgtggctcggcggcttcgcggtgtgcctgatcgtggctttttccgggtatctgctggtgacgaacgtgcgcgtgaaccgcacggcaacggtcacttccgacacggcggatctggtggagcagcgcgtggagcatgtcgaccagctgcagaaggacatcaccgacctgagcgcgcagatcaacacgctgaaggatttcgccaacaacagtggctcctccgagcagccctcgggcacgagcgaccccaagcccagcgacaccgaggacgcgggctccggcaccatactgccggcggtgcacggtcccggcatcaccgtgaccctgaacgactccccgttgtgggagaacatggtggacagctcgggctcggccgcgaacatcaacgattacgtcgtgcatcaggaggatgtggaggctgttgtcaacgccctgtgggcgggcggcgcggagtcgatgatgatcatggaccagcgcgtgttgttcaattccgcagtgatctgccaagggaatgtgcttctattacagggcaagaaatactcgccgccgttcaccgtgtcggcgatcggccccgcagatgctatgattcgggctttggacgactcgaacgcggtcaagttgtataaagagtatgtcagcgcattcggattgggctggaaagtggaaaaaaaggacgatctcgtgttcgggcagtctgcggcgacgctgcagccgttgcggtatgcgtccgtggtcaaggacgggagcgaggaatgaagcattcgcgcaactctcaacagattcaaggcgattttcaggatttcgaggcgcctgcccctgctgaaccggagtacgccggggaagtgaccatggcgctgcctccggtgccgatgcccgatccgaacgcccggcgcggcctcgcgcagccggcggccaagcgcagcgttctgtggtcggtgctggggatcctcggcgaggtgctgatgacgctggcggccgtctgcgcgctgtacgtggtatggcagatgtggtggaccggcgtccagtccgagcacacgcaggtcgagacccgccagtcggcgtcatggtccgatccggccggcggcgacagctcgaaggtcgccaaggcgcaaagcggcgacgtgccggtccagccgacgagcgcaagcgatggcgagctcatcgcgcaggtgtacgtgccccggttcggccaggggtgggtgcgtaacgtggtcgaaggcacggacgaggccgaattgtcgctgcatggtctgggacattatccgtccacgcagatgcccggttcagtcggcaatttcgcggtcgccggccaccgcaacggctatggtcgaccgctgggagacgtcgacctgctgcaggagggcgacgcgatcattgtgcgtaccaaggactactggtacgtgtacaagtacacgacatacaagatcgtcaccccggagcactccgaggtcatcgccgctaacccggaggatctcaacacgcctcccagcaagcgcatgatcacactgaccacgtgcgagccgaaatacaccacggccacgcatcgttggatcagctatggcgagctgagctattgggccaaggtctcggatggcgtgccgcaggagctcgccacgtcgtcgaactcggcgaaggtggcgttctccagcagcaacacgagccagtcgttcgtgtccaagctgggcacgctgcagcccatcgtgctgtgggcgctggtggcgtacctggtgctgtacatcgcggccctggtggcctggcggtacccggtgctgcgcgagattcgcgccggcaagcgccgccgtccggacgcgagcatctacggatggctgctgcgtcaccagcccggtccgctggtaatcaggtgggcgctgctgatactgctgctgttcatcgtcagcgtgtcgctgattcagtgggcgtgcccatgggcggcaagcaacatccccatcctgcaaagcatgtcgaattacgcggtcgattagcggcatggccggttggcggcgataatgggaacgcatgggatggcggtcggcgctcgccggtgccatcccataatcagaacgagacgaggagcgtcatgacggattcggcacgcattgtggtggtggacaattacgattctttcgtatacaccatcgttggatatctgaaaaccttgggagcgacggtcgatgtggtgcgcaacgacgcaatagacccctcagatgcctctgtgctggacgaatatgacggtgtgcttatttcccccggtccgggcgctccggcggattctggggccagcgaggacgttattcggctatgtgccaagctcggcaagcccatgttcggtgtgtgccttggcctgcaggcgctcgccgaggtgttcggctgcacggtcagccacgcgcccaccatcatgcacggcaaaaccagtctcgtcgagcatatcgatgatgagatcttcgccggcgtcgccaatccgatgaccgcgacccgatatcattcgctggccgtcgagcccgacaccgtgcccgatgacctggtcgtgacggcgtggacgaaggatgaccatatcgttcagggcatcaagcaccggtcgttgccgatgtatgcggtgcagttccatcctgaatcggtgatgacgcaggacggctaccggctgctcgccaactggctcgccgtctgcgggcagaccaacgccgtggccaagtccatcggtctgcagcccaaggtcaaccgctgacacgcacgtgtgtgtggcgccgcgcgtgacgcgtgacgcgcatgacaacgatgatggcccgtggcatgaggaatgccacgggccatcatgtgttctgggccgatgtgtgtagaccgcgcggctgggccgcccgtcttgccgatcgacccgccgcgattgccggttgcgcttaccggccgtcaggcggccgatcggtcacaccgcaatggcaatcacggccattcccggcggttcagttcccacctgtcgtcgtgccgccgttgccgttgttgtcgggatcctcggtggtgggcttcttggcggtgaccgagatggtgctgcccttgtcgacctgcgtgccggccgcgggatcctgcgtttcgatgaccgcatcatcggtcgcgtcgccggtgaccttcagcgtgaagtcgctgcccagcgtggccttggccttggcgatcgtgttgccgaggagattgggcacgctgacctgcggcttgccggtggacacgtagaccgtgatctgcgagccctgcagcaccagttctccggaaccggggctgactcgcgtcaccgagcccttctccaccttgtccgaggcctcctgctcgacgaccggcaggaacttcatggacgagagcttgtccagcaccgtgtccttgggctggccgaccagaccgtccggcaccttggtcatgcccgaggagatgtacagcgtgatcgtcgtgcccttgggctgcgacgtgccggaggccgggtcggtgctcacgaccttgtccttctcgatggtggcgctgtcggcggtcttcgtgacggacgacaccttgaagcccagtttctccagcgcgttgcgcgcatcctcctgggtgtagtcgctcaggtcgggcacggtcaccgacttggggcctacggagaaccagaccttcacgtccgagcccttgacggcctgagtgtcgcccttgggggactgcttggtgaacgtgccggcgggttcaccggaatccgaatcctgcatctcaacgaagttgaacccggccgaggtaaccttctccttcgcctgcgccttggtcatcgtcgccgtgatggtgggcacggtgcccatctccgtggcggatttgcggctcatggtgtagatcacgccgaagatgatcgccagcagcaccacgccgctgatgatcgacgcgatgatgatcttcttcttgcgcttctgcctggccgcctccgcgcgttgctcggcgcgagacttgaccgccagggcctcgttcgggttctgcgccggaggcaccatctcgaactggccggtcgccgggttgtacgcctgcgtgggctgacccgcgccgacagcactcatcggcacggtagcgccgccgtcctgctgctccgcggccttgcgggccttcacgttggccagatcggtcagcgggttgaacgccgccgcgaccggcacgccgccgttcatgaacgtcaggatatcgttcttgaattcggccgccgtcgcgtaacggttctgccgatccttcgccatcgccttcgcgcagatcgaatcccacatgcgcggcaggccgggcacgagcgtgctgggcggcgtcgccacctccgacacgtgctgataggcgatcgccacagccgagtcgccggtgaacggcggacggccggtgagcatctcatacagcacgcagccggccgagtacaggtcggagcgcatgtcgacggtctcgccgcgagcctgctcgggcgagaggtactgcgcggtgccgactacgccctgggactgggtcatcgtcgcagcggagtcgtcgagcgcgcgggcgatgccgaagtccatgaccttgaccacgccctgctcggagatcatgatgttgccgggcttgatgtcgcggtggacgatgcccatgtgatgcgagtattcgagcgcgttgagcacgccgagcatcacctgttcggcgtctcgctggctgagcgggccgttcgccttgatcacgtcacgcagcgtctggcccttgacgaactccatcaccaggtacggcagccgctccgtgccgccgctgtcggtcatcacggtctcctcgccggagtcgtagatgttgacgatgttcgggttgttcatctgcgccacggagtgcgcttcgcggcggaatcgggacaggaagatcttgtcgttggccaggtcggcgcgcatgatcttgatcgccaccgtacgtcccaggcgcgtgtccaatgccacgcgcacttcggccatgcctccacgccctacaagttggccgagctgatagcggccgttcgccagcgatgccggcatattgctgctcatagctattcctctcgattcttcgggtcggtcgtcgccgtatgcccgccaaattggttacggttcatggtgatcagcgtcgccgtgtgcggtgtgctggatacgcggcggggcatgcgcccgccaagtcccatgatggtctcatccatctgcgcggtctcctgatcgagcagacgtcgttctatgcgcgacagcgtgcgcgaaacggtcagcgcgtccttcggacggtcaagcggatccttggacagcatcgacatgacgaactgccgaagctgcacatctatggaatccggcagcgggggcaccgggtcgttgacgtgtgcggcggcgatgtcgaccggcgtggtgccggtgaacggccgatgcccgcacagcccttcgtacgcgacgacgcccagcgagtagatgtcggattgcggcgtggcctgtttgccttgcgcctgctcgggggagatgtactgcgcggtgccgacgaccatgccatcctgcgtgatctgctcctggttcgtggagtaggagacgccgaaatcggtgattttcacctcgcccgtagtggagaccatgatgttggccggcttgacgtcgcggtggatcacgccgtggctgtgcgccacgaacaggccgcgcgcggtctggatcagtatcggcagcagttccgtcgcgggcagcgtgccacggtcgcggtagatgtcggccagcgagtcgctgggcacgtactccatgatgaggaagccgatgctgtcgtgctcgtaatactcgaacagcgcggcgatgttggggtgcgccagattggcggaattgtgcgcttccgcccgcagacggtgcagcttggcctcgacgttgccctgatcgtcgcgcagcgccttgatggcgacgggacggttgagctggatgtcgtggcctttccacacctctcccatgccgccctgcgccagtcggcgatccaggcggtaacggcggtggatgagttgtccttcgacgagtttcattgtttcagggcctcctccatcagtgaacgcatgatcggtccggcggcttccacaccgtactgattgacattatggataacaacggagaccgcgatcttcgggttgtcggcgggggcgaacccgataacccatgcgtcgttggtctggttggagctgccgatctgcgcggttccggtcttcgccgcgaccttgatgccgctcagctgcaggctgggcgcgtcatgctcgaccaccgactgcatcatctggttgagcttggacgccgtgctggagctgaacgcggtggacatcacttcgggcgtggcttcggacagcgtactcaggtcgctggcccgcacgcggtccaccagcgtcggcctcatgagcttgccgtcgttcgcgatggccgcggcgaccatcgcgttctgcaatggcgtggacagcacgtcgccctggccgatggacgccagcgccaccttgtcgtcggacagcgtgtcggggaacttggcggcgacggacttcatcgggcgcccggacgacgaggtgccgtcgatggtgatcgagcttccgtagccgagcttcttcgcctgctcggcgatcttgtcctggccgagtttcacgccgagctgggcgaacgcggtgttggacgagtatgtcagcgcgtcctgcagcgtgatcttgccgtcgatgccgttcgccgcggtggtggtgttggtcaggttcgtcgaggttccgggcagcgtatagctcgctccggcgggaatctgagtatcggtgtcgtagtcgccggattccagcgccgtcgcggcgacgatggtcttgaacgtggatccgggcgggtacagctgcgaggtcgcacggttgatcatcgggctgttggcctgcgcggcgagtttcgaatagttcgcggtggctttcttcgtgtcgtgcgtggcgagagcgttcggatcgtagctgggggcgctcgccagggtcaggatgcggccggtcttgacctcgatgaccactgcggcgccgtcgttgctgccgagttgctggtaggcgagctgctgcagcttgggattgatggacgtctcgatggacgcgcccttgttctcgacgccggtgaacagcgatttcagctgatcccagaacagcgcgtccgccttgccgctcagcagcttgttgcgggatgattcgatgccgcggtcgccgcgctgggtgaccgagaagaagccggtcaccggggcgtacaccggcccgttcgtgtaggaacgctggtatgagaacacgtcgttgaccggggtcgactgcgcgaggatcgtcccgtcggacgcgagtatggcgcctcggggagcgccgtattcctgatacagcgcccttgcgttgcgcgggtcggagctcagcgagttggcgcggatggcggtgatgatcgtggtggacatgccgagtaccacgaacaaggcgatgacggcggtgaacagctgcctgaggtatttgttcatcgcgcacctgcctcgatgatttccgtggtctggttgttcgccgccgcgtggcggggttccggtggccgctcggcctgcggttcgcgttcgggtgcggactccttgtcagtgcgttccttcagctcgcggtcacgcagcaccgccagcgcctcgtattggaacgtgtcggacagtgtgtccggctccgggcggttcgccgcgttcgagatgatcatcagcagcgcggcgagcaggtagttcgcgatcagcgatgagccgccggcggccatgtacggcatggtcatgccggtcagcgggattaccagcgtgatgccgccgaccacggtgaatacctggaaggccatcgtgaacaccagtccggaggccagcagcttgccgaacccgtccttgatcttcatggcggtgatgaacccggacgcgatgatcagcaggtacagcaccagaacggccatcagaccggtcaagcccagctcctcgccgaccgacgaatagatgaagtcggaattcgcgaacgtggtcagacccggctgcccgtgacccaggccggtgccggtcatgccgccggaggccatgccgaagatgcccgtgaccagctgccacgagccgcctatgcggttgtactgctcgtcgctgaacgggtgcagccatgagtccacgcgctggccgacgtggctgaacacgctggccgcggcgaccgcgcctacggcgaacgcgatgaagccgatgacgatccagcttctgcgcccggtggccgcgtacagcatcgcgacgaacatcgcgaagaacatcagcgacgtgcccagatcgcgctgcatgatgagcacgcccatcgagatcagccacaccatgatgatcggaccgaggtccttgatgcggggcagctggagtcccagcaccttcttgcctcccacggcgagctggtcgcggtggtcgaacaggtaggcggcgaagaagaacgcgaggaacagcttggcgaattcggcgggctgcagcgaatatccgccgatgcggatccagatcttggcgccgttgatgttgcgccccagaccggggatcatgggcgacagcagcagtatcaggcctatcaccatgttcacgtacgagtatttgcgcagcacacgatagtcgcgcatgaccgccacgaggatgccacacagcgtcagggctatgcacaaccagatcagctgccttgagccgaccgaggaattaccggacttgtcgatgcgcgcgatcatcaccacgccgatcgcggtcagcatcagcacgcatggcagaatcgcctggctggcgtacggcttgaaccgcagcagcagtccccacagcacgaggaacagcgcgccgaccacggccagcaggccgatgtagttggcggggaagtggccgtagacgcgcaggaacatctggtagaaggcgacgacgctgatcagcatggcgaacagcagcagcgacgcctgacggagacgtatggggatcattgggcgtcaccgccgtctgtgccggtggacgatgcgtccgtgccggtatcgcccgcggtgccatccgcagtgccgccgtcggtctggctgctgccggcgcttgagtcgccgtccgtgccgttcgacccggatgagtcggatgagtcggatgagtcggacgtgccgttgcccgcgttgccggacgacttggacgtgttggaattgtcgttgaagttgcttttctcctgacggatgacctgcacgtgctggatggcctcgtcatagctgttgaaggtgatgccgtcctgcagctggtcgcgccacgcctgcggcagcgagtcgatgtcgatgttcgtgcgcttgacctcgtgcgacagcgccaggccgaacacgttggtgttcacgccttggtacacggccaccacgccgtctgcgttgccgatgaagtatttcgtctggctccagcggtaggcgccgaaagcgccgcccgtggcaagcgcgagcgcggcgatcacgatgaggattgcgatcagacgattgcggcggccgcgcttgcgcgtctccttgcgctgcgtctgccgctcgtgatggatggccttggcgacgtcgggatcgttgggatcgtcggtgacatggccgtcacgcttctggatgaccggtatctcgccggtgtcggggttggcgcgttcgccgttctcctcgcgcacggccgacggctgcgcgacgcgcggcgacggctgcgaggcgggctggctctgtatcagcgcggcggcgcgttgcgctggcgatgcgttcgcgtcgcgcagcatgggcgcggtggcgacaggctcgttgaggatgtctgcgatgggctccaggctggcgctcgccgctccggcgaccagtggggtctggtggggcaggtcgaaggcatccgcgtcgagagccagcgtggcgtcggcgatgaccgcggtcacgttgtcggtgctgccggccttcaaggccatcgaaaccagctgctgggcgcattcctcctgatcggagtaggcggtgagcgtctgctcgatggtggaatcctccagcacgccgcacaggccgtcggagcacagcatccaacggtcggttggatgggcggcccgaatggcgatgtcggggtgcggatcgatgtcgaagtcgccgagcacgcgcatgacgacgttgcgctgcggatggttgcgcgcctccgcggggctgatgcggcctgtgtcgatgagatgctgaacgtagctgtggtcctgcgtcatgcgggtcaggcgaccgtcgcgcagcaggtacgcgcgcgagtcgccgatgtgcgcgagcacccagtagcccgcgaccagcgccacggcggtcatcgtggtgcccatgccggcgagcttgcgctcgcgcttcgccttgccgacgatcgcgtcgtgagcggccatgacggacgtttccatcatccgggcgacggtgctcacgtcgccgttgacgtcatcgtgctcgatgtgggcgagtgaacggatggcgatggtcgaggcggtgtcgccgccggcatggccacccatgccgtcgcagatcgcgatgaggtgctccccggcgaacgcggaatcctggttgttggagcgcacggtgccgacgtcggacaccgtggtcgagtacaggaacaaggtctgtgatgcaacggaatttggcatgagccgtcacctcaattcgaaggtggtggcgccaatgcgcaccggcatgcgcgggggcagcagcatgggcatgttcagccgctgctggttgacgatggtgccgttggtgcttcccaaatcctcgatcgcccattgaccggaggcgggatccttatatatgcgggcgtgatgcgaggagacgaattcgtcgtcgagcaccacggtgttggacgcggcgcgtcccagcgtgatggattcgctggtcagcggcacggaggcgccggccttcgggccatcgatgatgaccagcagcgtgggaccggattgcggcgtgcgctgctggctttggcgcggcggcgtaacgggcgcggtctgtgcggcggccgggccggacggtgccgggccgtcagaggatttcatcgcgcgcttgtctcggcggcgtcgggcccgcgacggctgcgggctgaacgcttcgatgtctttgtgcagcgatcgcaccgcaagccagacaaagacccacagcaggatcaggaatccatacttgaggatcgcaaatgtcagttcggtcataacggaaagtcgactcctggctcggggtcactcctgctctcgtgaggaagcccagaacaggatgcgggtgcggccgatggtgatggtattgccgtccagcagcgtcgcggccggcacctgatggccttcgacgtacgtgccgttggtcgagcccagatcgcgcgcgatgacgccgttgggggtcaggtcaatttccaggtgcttgcgggagatgccgggatcgtcgatgacgatgtcgcagccggagccgcggccgatcaccgtcttgctctcggtgagcaggtaggggttgccgttgatgtcaagcatcggatggtcctcggcctggtcggtggtggtcacggggaccgcgttgccctgcacggattcggagctcaggttgaagctgcccttgggcaggtcgaggtcctcctcgaagatgaccatcacggggccgacgaacgcataatgctggctcttggcgtattgcgtgaggttgtccgccagctcgttggcgagcacttcgctgccccactgttcgatgcgatcgaagtcggccgtgctgagcttgaaacggtattcgttcggggctaccgtgcggtcgcggccgaccggcatggcttcggcgtcgatctcgcgctccagggcgctggaaaggtcgacaggcttcaggtctttggagccgaacttggaaaagactccgttgaccgcgccttctacacttttctcaaaacggtcgagaacgctcatggtgatccctttctatatccttacccatcctatacgtcagtggggaagtcaattgtgatttctgaggaaaaagcctgtttgagcgcaaaatttccacttctgacacggcgttgtggggcgtgagacctatttggaccgatgccgtccgcctgatgcgccagcccgcggggcgatcatggggaggcaagggggagggcggccggcgtggtttgcccagtgcggtggctaccgtggtgggcatgaacgatatgacgactcttcatgatgcaatcggcgattttccccgccgcaaggcgcagacgttgcggttctcctgcggtgccccgcgttccgcgaccgcgattggcgacggttcccgcgtgctgttcctgcgttccgacggccctgaggacctggtgacctcgctgtggctgagcgtgttcgacgcggacggcacacatcgggaggtgctgctggccgacccgcgtgtgctgcttgcggacgctgatgacgaggacgtgcctgccgaggagaaggcccgtcgcgagcgcgcccgtgaaggcggctcgggcattgtctcgtattcggtggatgcggctggccgccgtgtggtcttcacgatcaacggtcagctgttcctgaccgagatcgccgaagacggcagcggtcgcacccgtatgctggcggcggatgacatcgccgcaggagagggtgccacgccggtgcttaatccgcgcatatcgccggacggcaggcatgtggcgtacacgaccggcgaacatctgatgctggtcgacatcgcgccgcagtggccgtctgacagtcgtcatgatgacgccaccgacgacgactgcgacggccagccggcgccgcacgcgcacggccaccgctgcggcgacgaggagtcgggcgccccctacgacccctccgccgacaagctcagcacgctgtggagcgtgtatccggacgatgacgccgacgagaacacatggaagatcggtctggccgaattcgtcgccggcgaggagatggaccgttacgacggcttctggtgggggccggactcccgtcacatcatcttcgagacgttcaacgcggcacctgagccgatgtggtacatcagcgacccggcgaacccgcagacgccggcctccggccgtcgatacgcgcgtgcgctcaccagcaacgccgatgtgcgcctgacgctggcggagctcgcgtacgacgggcacgacgagtatgcgggactgggcatccagcagatctcctggaaccgcaaggactatgaatatgtcgccgcggtgcactggtccgccggccatgagccattgctgctggtgcagaaccgccgacagacgcgtgaccaggtgctctcggtgcatctcggctccgaggcctctgcgggctcggcgccggtcggctccacgaccgtgctggaggagcatgccaacgaccagtggctcgacatcatccagggcacgccggccttcacgccggacggacgcctggtctgcgcgctcaacgacatggacgccgacaccaaccggctgacggtggacggccgcccgttcacgcccgccggctggcaggtgcgagaggtgctcgacgtcaccgatgaggacgtgctggcggtcgtgcagcgcaccccggaactggacggatacgaggcgcccgacggactgagcccgtggcgaggcaacgccgatggccatgacgcccgcagcttcgacgtggtgagcttcgattatgatggcaatgtgctgccgatgaccgcacggcccggctcctggtcggccagccggcgcggcgagggcctggtggtctccgggcgcgacatggactcggcgaaatccgtgatgtcgcactccttcacgatgcgcccggtcgacgggggagccgcgccggaaaacgatggcgatggctccgccgcgatgagcacgctcgtctgcccgatcgacaaccatgccgccgaacccggtttcgcgccgaacgtgcgcttcgcccggctcggcgagcatcgcctgtacacggccatcatcgcgccgagcgccgatagcccgtacgcgaaggccgacaagctgccggtgctgctcaagccgtacggcggccccggattccagcaggtcgtgttcaaccaggcgtactactgggacgcgcagtggtgggccgaccagggcttcctggtcgtcaccgccgatggccgcggcaccacaggccgcgggccgcgatgggaccgtgagatcttcgagaacatgaaggacgtcacgcttgccgaccaggtggaggcggtgcatgcgttggcccagaccgtcgaggagctgaaccgcggcaccgcgcaggacggcgacgcgtcgcgcatccccgccccggacctcgacaaggtgtgcatgatcggctggtcgtacggcggtttcctgtcggcgctcgcggtgctggacgccccggacgtggtcaaggcggcatgcgccggcgccccgcccaccgattggacgctgtacgacacgcattacaccgagcgctacctcgggctcgacccggcggcgtacgagcgcaacagcatcatcgccgacgcgccgaagctcgcccgcccgctgatgctgattcacggcttcgccgacgacaacgtgaccatcgcgcacggggaagtgacggctcatgatggccgtgcggtcggcgtgcaccgcggcgcattcgaagtcgaatgcgcgggcgagctcgtccggtgcggtgacgaagcaggcggtggcgagtccatccgccagcgcggtggggtagggtcggccagccgccgatggcacatagacccaactcgcggcgacatcgcgcacgggacggccgtcgaccgcgttgagcagatgatgcagctgacggcctgcctcctcaccccaatggcgtcggctgggggcgctcgcgcagaacgccccgtcaacgatgcttgcgatgccgatcgcctcggttccggggttggcgggatcctccagggcgatggtgacggtgtcgccggtgtcgtgtcctgacccctcggcgagtggggccggttgagcaggctcgcccgtgcggatcagcagatcgccgcccgcgtcgatgatgtagggcgcgtgagagccggggccggtggcggattgccggacggtttcatcgcccgcgtgcccgtccaatatcgcgccgatcagatcggcgcaatatcccttgccgaaagccccgaaatccaagtgaaccgcgcgctgcgtcaccagcgttgtgccatgacgctccacatcgttgcgccatgtcgggcgcccgtggacggcaccgagatgatgctccgcatcgggttccattgtcatcgaataccgtgcgtcatagccaagccggatcagatcctcgcccacacacgggtcaagcgccccgtcggtcgcggtgcagaacgcatcggccagatcgaacagcccggaggcccaatcgggaaaatcaaacgagccgccatgcgaggattcgcccattgcggtcaccagcgaatcggcgcggaaccgcgacagcacggactcgtacccgtcgatgaacgcgtcgagtttcgagcggaagccgtcgtcgagggccgtcgccgactgaatgatcattccggtgcccatcgcgcgttcaaacgcagtcgtatacggcatccgcccatgcaatccgctcatgcccctcagcgtagcatttcgccagcgggggcagtcgccttagcctacgttgatgccggagattttgaggcctccgggtgagatgggacggtaagggttccgctggaggatgcggtgtccagccgttgcacgctgccgtcgctcaacaccacatgatgatgggccagacggctggcgttcgcgatgaagatgggccgatgctgctgttcaccggcgtctccgcgatcggcgtggcctcgggcgcgggctaccgcatcgccgcggtgtgcgcggccgtgctgtgcggcatcggaggcatcgtcttcgcgttctacaacgagcggaaggtgttgaatcgtcttgatggctgaagcaggctctcaaaactcacagatacaaggggaaaaacccgaaaaacgtcttgtatctgcgagttttgagagcggcccctaatgggccacccatacgatgaccacaatatgagacatttcggcctcaggggccgctctattaccgcataaaaattcaaaagtcaagactgttctttcaggttttttttctctatattgcatagatggtttagaaagcgttgatatggagaggaatccaatatgcgatgtcgtgcggtagcgcatcttcgggcggttggatgtcgttcgctggccgtcgtcgcggcgctgttcacggtgatggccgtcatgttcgccccgcaggcgatggccgccgacggttccgcggattacgacacatgggccgacgtcgccgccgcgatggacaagcagctacagcaggggcagaaggaatacgaggacggcaacaccgccggttccacgtccgacttcatggccgcatacaacgagatctatgtggcgtccaacttcacccaggtcgtgaccgacaacatcggctccgacaagcaggcctcccagcagcaggcgttccaagacattcaggacctgtcatatgtgacgggcaacgaggtgaagatcgaacagagcgtgaccgcgctcgtctccgacctcgacagcaccgccaagcagctcgacgcgaacaccaagctcgccaatccccgcgactacgacaaggcgctgcaggagcagatcgccaaggagcgcaaggttctgcagtccaagcagaagaagaaccccggcaagggcgaccgcagctggaccgacgtggccaacgagatgatgccgatcctcgacaaggcctacaagtcgtacgcgggcggcgacggcgcgaagggcgctaccctcgtcaacgacgcctactaccagtactacgagaagctcggcttcgagaagaacgtgatgaacgccatcagcggcgaccgcgtctcgcaggtcgagtaccagttcaagatgtgccgcaagtcgatgaacacaggcgcctcgctcaaagacaccaagaagctcgtcgacgatttgaaggccatgctggtcgaggacgccggcaagctcgacggcggtgccgccgacaaggaaggcagcttcaccaagttcatcaccagctcggtcggccaggcgttcctgattctgattcgtgagggtcttgaggcgctgctggtggtcgcggccgtggtggcgtacctcgtcaagtccggcaacaagcgtttcaccaagtggatctatgtgggcgtgctcgccggtcttgccggcgcaggcgtggtcgcggtcatcttcgtgctcgcgttcggtgggtccggcccgattcaggagatcatggaaggcgtgtgcgccctgattgccatggccatgctgctatggaccagcaattggatgctcaacaagtccagcgtcgaggcatggaaccggtacatcaaggagaagaccgaagccgcggtggcctccgtctcctcacaggtcgatgccggcgaaaaggtcgcgtcccgtacggtgatctcgctcgccatgctgagcttcctcgccgtgttccgtgaaggcgccgagacggtgatcttctaccagtcgatttacacgatgagccgcgatgcgcatggcatggtgattggtgccgtcgccgccgcggtggtgctgctgatcatcttcttcgtgattcgcttcacgtcggtgaagattccgatcggaccgttcttcctggtcacgtcgatcctgatgtcggtgctggtggtcgtgttcgccggcggcggcgtgcactcgctgatcgagggcgacgcactcccggcaacgtatctgcaaggcgttccgacgaacgactggctcggcttctacccgtacgtcgaatgcatcatcgcccaggtgattgcggccatcgcggtgatcgccctgttcgtggtcggcttcatcaagcagcgcaaggcgaaggccaaggctgccgtgacggccggtgccccgaacaatcaacccaacaatctgtgaataccattcactacacaacaaaggaaatagagaaatgatgaagaacaagaagatcgccgccctgctcggcgtgctgctggccggttccatggccttctcgctgtccgcgtgcggttccaccaacaatgcttccgacaacaagtcttcgggcagctcctctcagtccagcgacaagaaggacaactccagctccggcgcaggctttgaagaggtcccggtcggcccgtccggcaccgccgaggagcaggacaaggacgccggcccgctgaccgtcggcgccgtgtacttccagccgattgacatggagcccgcctccatgggcctgaaggccgctgattcgagcttccacctcgaagccgacatccacgccaaccagaagggtaccgagctgggctacggcaagggcgacttcgtccccgagctgaccgtgaactacacgatcatcgacaagtccaccggcaaggaagtcgaaggcggcaaggccacctccggtaccttcatgcagatgaacgcctccgacggcccgcactacggcgccaacgtcaagctcgacaaggccggcacctaccagctgaagctgtcgatcgaatccccggccaagaagggctggatgctgcacgtcgatcccgagaccggcgtcaagggtcgcttctggaccgagccgatcgaggtcaccttcgacaactgggaatacaccccgcgtcagtggtgattgacattgcctgagtgaaatgctcctctctgcccgagaggagctttcgctgtttttatgacggaatgaacggaacataatagacggaacaaggaaagggtgcgaatgctcgaacagttcgtagcggtgatgccgggcacgctggggcccgcgttgctggtcatgtgcatgagtgtgatgctgaccgtcggcgaggggcgtgacaagccgatcagctcccgatggcgtctgtggggaatcctcatcggattggtggcggcgatcgtgttcgccggactgcgtgcatccgcggtgattaatcagcgtacattcatcaactacccggtgctgtggtgctgcgtggtcatcgacctcctgctgatcgtgttggtgttcgtgaaccgactgatcacccgcaattggcgtcggcacgccgcggtgatgcatctcgccaatctggtggcggcgttgggcatcgcgctcaccgtgttctatgcgctgccggacgtgatcctgcagctgaccatctgggtcgagccgggagacccgatcttcacgtccgatatgctgctgcgtgcgctcggctttgtgctgggcatcatcgcgtccgcggtcatcgccgcgatcttccgcacgatgcgttcgacggcggtccgtccggcgttcctgtccgcggtgctggtggtgctggtgatccagctgatgcaacatctgaccggcctgctgcagatcatgcaggcccgcacgctgcggttcccgcacatcgcgttcgtgatgctcgcctggctgatcaacaacaagtccggtttgattatggcccaagcgttcatattcctgattcccgccgtcgcctcggtggtggccggcttgcgtatgccggtttctgcgaagcgactcgcggccgacgtcaatgcggccacggtgcgcaagcacaaggcgttccggcgccgtgcgatcgccgccgccgcatggagcatggtggcgatgatcggcgttaccgcgacgctgaccttgggcgtggccgcaatcagccagcagccgactctctcgccgccggaagcgtattcgctcaaggacggcgtggccacgatcccgttcagccaggtcgaggacggccatttgcaccgcttcgaatacaaggccaaggacggcaccgtgatgcgcttcatcatcatcaagaagaacggcggcgcgtacggcatcggcctcgacgcctgcgagaactgcggcgacgccggatactacgagaaggacggcaagatcatctgcaagaagtgtgaggtggccatcaacctggcgaccatcggcttcaagggcgggtgcaacccgatcccgttcccgtacaagaccggtagcggcaagatcaccattcagaccgccgacctggacgcgctgagcgcccacttccagtaaggcaggaaggggtttagaccatgttctttctgagaatgatcaggcgctcgttcacccgccagttacgcaggcgcctgctgatcgcgctgaccgtgtgcctgtcggccacggtgtcggtgtcgatgctgggcgtcgtgttcgacgtgggcgacaagctcaacgccgagctgagcacgtatggctcgaacatcaccgtgcagccgaagtccgatgcggtggtgtccgacctgtacaacatggagggcggcccgcagtccgacgcggacccgacctcgttcctgaaggagtccgacgcggcgaagatcaagacgattttctgggcgttcaacatcacgaatttcgcgccgcaactcaacgtccacgcgcaggtgaacggcacggcggcggcggtagtcggcacgtggttcaacaagacgctgaagctcgcgtcgggcgagaccaccgtcgtgggcgtcgacggcatgcgctcatggtggaagcttgacggcagctggccgaaggatgacaccgatcagggcgtgatcggcacgacgctcgcgcagcagctcggcgtgggacgcggcgatacggtcaccttgcgcaagaccacggcggccgggaacacgcacgagcagaagattcgcatcaccggcgtctacgattccggcgacgacgacaacagtgccatctacatctcctcgtcggtggcacaggtgctgtcggacctgccggactccgtcgacaagatcgaggtgaaggcgctgacaacgccggagaacgatctggcgcgcaaggcggcccagaaccccgccgcgctcagccaagacgagtgggagacctggtattgcacggcataccccagctcaatcgcctatcagatcgaggaggtcattcccggcgcggtcgccaagcaggtgcggcaggtcgccgcgctgcagggcaacgtgctgcagaagacccaggccgtgatgatcctgatgacggtgctgagcctgctcgccgcggccgtggcagtggccaacctgatggtcgcctcgatcggcgagcggtcgagcgaactggccctgctcaaggcgatcggtgcgaccgatggcgcggtatcgcgcctgatgatggcggagaccgcggcgatctcgcttctgggagccatcgtcggcgccgctttgggctcgggcgtggcgcagatcatcgggcaggtggtgttcggttcgggcatcaccatgcgcccgatggtgttcgtgctggtgttcgtgctgctggcgctgaccgtgctgctggcatcggcgtcgtcgattcgctcgattctgagcctcaagccggcggaggtgctgcatggacgctgatcgtaagacgatgatgaaggaggcgtgctgagatgaccaataccggtatgttcttcaggatgctgttgagtgcggtgttccgcaggcggtctcgcgcggtcatggccgtggtggcgtcgctggtcggcgccgctacgctgtcctgtctggcgatgatctgcatcgccgtgccgcagcagatgaatcaggagatgcgagcctatggcgccaacctgatcgtgacgccgctcgccgattcggagaacggcaagtccggcatcgatgacgcgatggtcgagcacaccacggagatggtgagcgccaagggctcggaaaagcacgccacgtaccgttacgagaacgtgcgcgtcaacgcggccccgtacgtgatggccggcgtcaaccccgcgcaggtcaggaacctcaaccatcattgggtcgtcgacggctcctggccgtccgcgggcaaggtgctggtcggccgggacgtcgccgatgcgatgggcttgaaggtcggcggcagcatcaccatcggctaccgcgcatcagacaacgccgcgtcctcgggacaggcgagccagcccggtactgacggcaccgatggcacggcgcagtccggcactggtggcacgtcagacggccagacctcgtccggctccaccggcgcccagcagacccagaacggccacgtctccagcgacatcatggacacgtccggtaccgagttccgtgtggccggcatcgttgacaccggcggcagcgaggattcgatcatctacgcgctggccggcgacgtggacaagctcaccggctccacgcgcggcgtggacgtcatcgaatactcgtcgggcgcctcggacctcaccgcgctggtcaacagcatcaacgatatgacgtcgatgcatgtcaaggcgcagcaggtcaccaagatcaccgcttccgacacgcgcgtcatcacgatgctgcagacgctgttctggatcgtgtcgctggttgtgctggtgttcacgctggtcggcgtcggcaccacgatcagctccatcgtctcgcagcggcgcaacgagatcggtctgcgcaaggcgctcggcgcgagctcgcatgccatcggcgtcgagttctatgtggaatcggcggtgtatggcctgctcggcggcctgcttggcacggcgacaggctatggcatggctcgctggctgtgcgccaccgtgtttgagcgttccatcggtttcaactggtggctcgccgtcgtgtcggtggtgttcagcgcgctggtcgccgttgtcgcatccatccccccggtgcatcgcgccacgcgcatcgaccccgcggtcgtgctgcgcgaggaatagttggaatagttaaggaataatcatggatatgctgcttgaactcgatcatatttccaagatctacggcgacctgcatgcggtcgatgatctgagcctgaccgttccgcagggcgaatggctggccatcgtcggctcgtcgggttccggcaagacgacgctgatgaacatgatcggctgcatggacacgccgagcaagggctccgtttcgctggagggccgcaagctggaggatctgaacgccggccagctcgccgacgtgcgcaagaacctgatcggcctggtgttccagaagttctatctggtgccgcacctgacggccgtcgagaacgtgatggtcgcgcagtactaccattcggtcgtcgacgagaagcaggcccttgaggcgttgaagaaggtcggtctgaaggaccgcgctcaccatctgccgagccagctgtccggcggcgagcagcagcgcgtgtgcgtcgcgcgtgcgctgatcaacaacccgaagctgattctcgccgatgagcccaccggcaacctggacgagaagaacgagaagatcgtcctcgacctgttccgccagctgcatgaccagggcaccacggtcatcgtggtcacccatgacgctctcgtggcgagttgcgcccagcgtgaaatcatgctcaaccacggcgtgctcgtgggcgagaagtggaatgataaaaatgcacatgatgcgtacgtagcggccggtggcaagcctgcgtccaccggttctgacgccgaaggtgcgcagcatggcgattcttccattgatttcattgatcctaccaaggcggcgaagacaggtggtgaccatgagtgacggcagcgctctgcagcatgacgggcttgcggacggcggttccccgtcgaaatcccgcacgctgaagagcgtgacggtggcggccgcgggactgatcgcggcgaccacgctgctggccggttgcggcgagcccaaggccgcgccgatgaacgacgagtatgccggcaattccggcgagaccgagaagtcgcaggagagcgagtcccagtcatcgagcggctccgacagctcctccaagcgcaagtccacgacctccgacaagaaggacaccggcaactacaaggacggcacctattcgatcaacggccagtacgggccggtcggagaggattccatcgacgtgcacctgaccatcgccgaccagaaggtcgagaaggtcgagatcgtggggcatccgttcacgacgatctccaagaaccaccagaatgacttcgccgaggcaatcaatggcgtggtcgatggcaagccgctcaaggacctaaaggtcgacaaggtggccggagccagctggacgtcggacgccttcaacaaggcgttgggagtcgcgcggcaggaggcctcgattcaataatcgcatgtcggttcgtatggcgcttgggtggcatggcatgtcgcccaagcgccattgtcgtataaggggtgccaggcgcgcacgatattacgattattatgtatgattgtacataacgttattcgaataaccgtgtgttgtgcgataaaatcatgatgtcatgggatgcggcgtctctgccggtgagttccggcagaccgggaagctgcccaccaaggaccagctgattgaggagtaccagaccacgaggtaccgcgtgcgcaatgccatcgcggtgctcgccgacacggtggcgatcggcgacagcgacaatgacctgaccatgatcgaggtggccggcatcggcatcgcgatgggcaacggggagcagtgcgccaaagacgccgccgattgggtcgccgatgcggtggacgcgagcggcctcgcgcacgccttcgagcggctgggcgtggtgtagcagccccagcccgcgcacggcacggctttccggcaaggagcgtaatccatctgactgtattacgatggaacatgattcgtacaccgacgtcggaggtatcgccgttatgacatccaagcagaacaactatctgcgcgagcgtgaaaaagccaatgcgcgctcgccattctccaaacgaacgccggaacgtgtgatcatgtgcgccggtgccgtgtattcggtcggcatggccatcttcttcgcgctgtcgtacttcggcgtgatttccagtacgtccgaggccgcccggacgtcggctcaggccgtgaccgcgctgagccgcaacagcagcaacacggcgctcatcatcctgtacgccatcgtgacggcgggagtcgccgcggtgaccatatatatggccgtgaagcacatgcagcccggtccgcggttcaaatggacggtcggctggatgatcttcgtgatggtcttctcgctgttcaccgctgacatggtggggctgatcgcgttcggcgtggccttcggcatgtacatgacacgcgattggcagctgctgcgtgccgtcaacgccgcgaacgccggcaaacgctcgtcgaagcgctgacgcatggcctctgacacgaccagtcagcgtcgcgacgggcaggagctcgccgcggacgtcgacgcactcgccaaccaggcggtactcgccgacgtcgaacaagaagcgaaaagccactccggcaaggatgccgcggacaggcggctgccgctgatcgcccgcatctacggcgtgctcgtgctgctgcagggcctcatcactctccccgtcatcgtgctgatggcgggatattcggtgcatgagattctcgacggccgtgtgaccgtcgacgtgctgaacctgacattcatcctcacatgcgcccagacggtggtctccagcgccaacgcggcatgcctgaccgtgctgggcgtgctgctgatccgcaaccgacggcggtattccgcctggtggtcgtatatcgtcatgatggtgacgttcgccgagggactgctgtcgctcgcattggacgggttgggcgcgaatctgctcgtgccgtccatccagatgaccatactggtcgcgctcgccataacccttgacccgactctgctggaggaacggcggctgcagcgcgcgctcaagcgcatggatgagcgcgacgaatacgaggcggcgctcgccaagggcatggtcggccgcgacatgagcggcaagggctatatctcgctggatttcttcaacctgttctggattttcgtcatcggctgcatgatcggactggtggtcgagacgatatatcattggtattactacggcgaatatcaggatcgcgctggcatgctgtgggggccgttctcgccgatctacgggttcggcgccggattcatgacgattctgctcaaccggctgtggcgctcgaactgggtgctgatcttcttctccagcgctctgatcggcggcgtgttcgagtactgctccagctggttcatggaggtcgcgttcggtatcaaggcctgggattacacgggcgaatggctgtcgataggcggtcgcacctccggcaagtacatggtgttctgggggattatgggacttgcctggatcaagttcgtgctgccgtacctgctgaagttcatcaacctgattccgtggaaggtgcggtattcgctgaccgccgtggtgttcgtgctgctgttcatcgacggcatgatgacattgatggcgttcgactgctggtacgggcgcatggcggggcatgcgctggattcgccaatcacgcagttcttcgccgaccatttcggcaacgatttcatggcgaaccggttccagaccatgtccatcgacccgtccagggcagggcgcatgtaggtcgtgggccgtacgcgggcggggctgtgccgagccgggccgtgccgggccggggcgggcggagtgcaagaccgcccgaagtcctacactggtgcaccggaagcgcctggagaaggcgcgggaagggtggcaatgtccagcaaactggtgtttctcgatatcgatggcacattggccgacgaacggcatgaagtgccgatctccgcgcaggaggcatgcaaggcagcccggtcgcgcggccacaagctgttcatctgcaccggacgctcgatgccgaagatcgaacgcggcattctcgatctcggattcgacggcgtgatctcggtggccggagcgcaggcggacgtcaacgggcgggtgctgttccggcatgacatcgcgcccgaggcgatcgacgccgcaaccgcgtatttcgaacggcacggcatcgagaactaccagtggcagggcgcggacggcatgtacatctcgcgcgggtatgcgcggcatcttgaatccaaggggtcggccgtgtggaggaacggtcagttcgcgcggtactggcatctgatcgacgacatcgcggtgccggatggttccacgctggggcatgtcatccatgcgagcaagggatcgtatttctccggagcggatcccgatgtgagttttgatgacgtatcgcgtgatttgggggagtggttcacgctggttcacggctcgtacgatgatatttcgcccaacaacggcgagttgctcatcaacggcgtcgacaagggcacggccctgtgcggtgtggcgaaggacctcggctacagcatcgtcgacacaatcgcgattggcgacagcgacaacgacgccgcgatgctcaaggccgcgggcacgtccgtggcgatgggcaacgccactcacggcatcgagtgtttctgcgacatgaccaccaccgacatccacgacgacggtatcgccaacgccttcgtcaccctaggcctgatctgattcagcgcgtcgcggggcgactgctgtcttgcctccccccccccgctggcgggctgagccgttaagcaaacagcggagctgtttgtaggcgaagtcgagctgacaggcgagcagcagaatggtcgtgcgcagcacatccgtagttgcagggcccggagggctgccgcgtagggactgtgccatcttttgccccccccgctggcgggggctgtcgcgtagcgactggggtggtcgtcagtcagcgcgcgcaagatgccgcctgcgcgcaacgccgcactggacattgtccggtgttcgcgtgtatcttggtaatgttgcccctttagctcaacggttagagcagcgtccttttaagtcgtgggttgtgggttcgaatcccacagggggcacggttaagtccttggagatcggcgtttccggggactttttgcttgccattgactttcgaccctagtaggggcctgatgggaggtgcttccttccgttgattcattgctcgtgttgaaatccaacattcggatatcatgaaaattaccaatacccgcctgaagccgtgactgctgctcttacatgtggcggatcttttcatctgcgatatcagagggcagtgtgacgatggcgtccattaccgtacatccagccacgcgctccggtgggccgtcagacagagcggagctgatccggtggctgtagcacatagagatggtcttgccgagcttcctcaatggctaaatgcggatgctccgttggacttgtcttttaccaagctatccacgattggttctgcgttgcagatgccgtttggtgcgttgatgcgttccgtggttcctgaagctcgtgaagacgatctgattagatatcggacgattaacaatcagggagtcgaagcgagccggaatcttcgagatacgattgttacttcaaggatttcatggctccgaacgtaggggatcgccatttccgtgtcttctgggtgccggccagtgtttttcaagtgatggtcggcggcgacgggaaaccgctcgctgatgtccttcatgacgaacgggctccgatggatgcactccatcgccgacccgaaacaacatgctcaaacgctcgacaatgtattaggagcatcagaacacaacggaagacaggccggggccgtaccggtcatggaaccggccccgcgcgtgggagcgagcccgacgattcatgggaacggccgtccgcccgtcgttcctgacggaccgccgagacgatatggggggtggcatccttcagaaatgcggcgtgtcggaaagaaggggcaaaggggagggggtgatgtcgtggctgccgtccgcggcaaaggaatcccggcttcgtacggcggggggggatggcgcgtcgggtggaagacgtccctcgtcgccgttccgcgttattctgccttccgcagtgagggaaccaagccgatccgtccggagggaggtgcgcatgccggcatcgtcgaagaccatcgtccgcggttggggagccgtcctgggcctggaggacgtccggaaggcttgcgacgcacgccgccgggcgtcgttcaggggaaggctgctgtccgtcgtgtccgtcgcgctcgtcgtatcggggttggtggtggtgtccgtgccggtcatgctgcagtcgtggtccgccggggaacagtccgccacgtctgatcgtctggaggagacggtcgcggactggccgtatcagcgggcggagaacgaattgaaggaggcgcgcgcgtacaaccgcaacctcgcctcgcacggacagtacgtcctcggcgaggccaacgacccgttcacgcagacgaagggttccgtctccgacaagagatacctctccatgcttgacgctggcgagggcgtcatggggtcggtcaccatcccgaagattggggtcgacctgcccatctaccacggcacatccgaatccacgctcgagctcggggcaggccacctgtacggcagcagcctacccgtcggaggcaagggcacgcacgcggtcatcaccgggcacaggggcttggtcaaggcattgatgttcaccaggctcgacgagctcaagaagggcgattccttctacatcaaggtgatgggcgagaccctgggctacaaggtcgaccgcgtcagcgtgatcgaaccgtccgacgtgtcgaaactcaggatcgtcgaggacgaggaccgtgtcaccctgatgacatgcacgccgtacggggtgaacacgcaccgtctgctcgtgtccggactgcgcgccgcgatcccggacgagatcccggacgagtcacaggtcatcgacccgcgtccggtccctctgtccgtggtggcggcctacgtgctcgcggcgttgtgcataccgctgttgttcacaagagattctgatccgcggcgtcatagttcgggcgtgaaatccgattccgtccttggaaggaagcactgatgagaatggcggaaaacggaaaaaccaccggggggggggataggttcctcctggccgtgatggtcgccctcgccatggtgctcgcgttgtcggtggccggcaccgcgagcggtgagggcatgccggccggcacgtcctcggcggagacagcggtgaagtccgccggcaagacgggcgagatcacgttccctgccggctcgtacatcgtcgacatgggcgacaccttttctgacgacgcccagctcaaaccatacggcctcatctacgatctcgtcctcaatgccaaggtcccggtgtactgggtcatcaacgggagcaagaccagccagaccggcgtggacctcacctacaacggcaagggctacatctccggcccgttcgtcatatccggcgacgacgtcgattacaacgtcaggtcgatgctgtccaagtggcgcggctacggcgtgtccatcgacgggcccaccgacaccgccgtcacggttgccgacagccggaagatctcctcggtcccccgcgtcgtgctcgacaatcagaacggcaagatagccaaaggctacctcgtcaagtccggcatcctgcggaacgagaataccaccgatgaccgcgtctacaaagaaaaagcgactccggcggacctggactcttcctgcgacgacatctacgtcatgccgcacgccgaaccgaccaccgcgacgcatagcccactcgcctccttcaacaagggcggcggctacatctgggccggatgccacgccgtctcctatctcgaaagcaataccaagggcaagggcgtggatgacggttccatgttcttcctgtccaccaacggcctgctcatcggagacaagcataaaaaagcgtcgggtgtaagcggcgcctaccgggtgacgggcgccgcgtcggacccgatcatgcagttcgtcgggaacacgttcgccgcgcacgccaacggagcggaagagatctacatgcccgcccccggcagcgcgtggcgcgccaccaccagggtgctggagaccgacccgaaccagcggcaagtcctcgccggtatgtctcccggtccggccgtgttcatggccgtgggtcccggatacggcgactacggcaacggcatggtcatgtacgaggccggacacgaattcaaaaaaacaccgacgccgaccgcaacgccatacgagcgttcctgaacttcctcatcctgtccggagtggagaaaagcctcgacgtgaaggccacgatcccgtccgacgccacggccggatcgaccgtgcaggcttccgtgaccgtcaccaaaggcacgccgccatacacgtaccagtggcaatccgactgcaacgcgtcgttctccgacccgaccggatcggccacttccatcacgttcccgaacgaaggcccatgccatgtgaaggtcacggtcaaagaccaatgcggccgcgccacgttcggcacccggctggtcgacgtcaagacccgcaagggaaccgtctcatggcgcaagaccgacaccgaaaacaatccgctggccggatcctcctggactctgaccggcccggacggccagtccaggaccatcacggacaacggcgacggcgacgaggaccggaccgacggatcgttcagggtgacaggcctcgacatgggcgcgtacacgctcaccgactcccaagccccgtccgggttccacaaggatgacagtagccacccgttcacgctcgacaacacgcatcccgactggacgttcaccagtggattcgtcaacagtccgacacccgccacggtcaccgtgaacggctccaaaaccctgaccggccgcgattcgaagaacggcgagacgttcaggttcacgttcatcccatccgaccaggccaccagacaggccgttagggacaagaccatcacggtatccaaaacacggtccgtcggcggtctgcgggacggcgtggccaaggccggcacgtatacgttttacgcggccgaggaccggacggactgcccgggcgaccttgcctgctcgaaggccggataccggatcaccatcacggccaccggcggcaccgcatccagcggcgccctcaccgtccatgcctccatcgcaaagaccaaggacgacgagagaaacacggccgacgtcaccggcatcgcgaaggcggcgttcacgatcacgcgggtcgcacagagcgcgctgccgttgacgggtgcgtccgaggcccggaacaacacgatgctcggcctgtccgtcatcgccgcagcgctcgtgctggccgtcctcggagcgaaacgctccagggcgtagcgacagatttcgcgcgccgcatgcacgccggcgcgcggcccgttcgaccgtccggccgaacggtctttcatgaaagaaggagagttccccatgaaactcactaagatcacggcgatggcggccgccatcgccaccgtcgcgggactgggggccgtcgcggcgtccagcgcgaacgcgcaggtcgtcacggacggtgagaagaccatcacgttgaacgccacgagcgcggaccaattgactggacacacgttcaaggtcgtgaaggtcgcgtcctacgacgtgtacggcaccgccccgaaccagagcgtcaccctcaagaccgaggacggcctcaagaaggatattgccgactacctgaagtatacgggcaccggcgatccgctcgcctgggcgcagcagcaggaccaggccaagctcgacaagtccaccacgagcccgtggctgggcgacggcaccacccgcggcctcgccgacaagctcgcgtccaaggccacgaccacggtcacgtcgaccctgtccaacgaaaacaagcaggccacgttcacgctggacagcccgggcctgtggctgatcgtcgaccaggtcgtgaccggcaagagcagcaaggccctgccgatcctcgccggcaccaagctgaccatcaacaacacggtgtactcctccggttccatcgacatgaagaaccagaccgcgtcggtcagcaagaccgtgaccgaccagaccgtcgcagccgggcaggatgcctcctacacgatcacgaccaaggttccgaactacgtgggctacaaggtcaacggttaccagttcaccgtgtccgataagttcgcgcacaacgcgccactgtcctacaagaccgacaccctgaaggtcacggtcgataacaagcagctgagggccggcaccgactacacggtcgccggcttcgacgccacgtccaagaccttcatcatcgacctgagcggctacatcaaggccaagggcttcaagggcacccccgtcgatgactccaagttcaccgacgccgacctggtcggcaagaacgtgaccgtcgaatacaaggccaccgtgaccggcagcaccggcaacaccggcgccgcgaacaccccgacgatcaagtatccgaacgatccgagcaacaacgagagcaagcaggaagtgccgggcaccccggtcaaggtcttcaacttcgactacaccctggtcaagaaggacaagaccaccggtgctgcgctcgagggcgccaagttcgccatcaagaatgccgccggcaagtacctcgcctacacccccgacaaggacggcaacggcaagtggagcaccctcgacaccaagccggaatccaccgccgacggcaccctctccggcgtgttcaccaccggcaagaacggccaggtgaccttcccggccctcgacgagggcaagtacaccatcgaggagatcgcagccccgaacggctacgtcaacgtgggtgtgttcttcagcttcacgatcgcggccaacctctccggcaccggcgcggaccagaccgcgaaaccgtcctacacgatcgacgccgatagcgtcagcagcgatcgttggggactggtctccgacggcagcaccgccgaagtggtcgtggagaacgtgaagagcatcacccagctgccgctcaccggcggcgcgggcaccgtgctgttcaccgtggttgcggccctcctgatcggcgccggcgtgaccgtcggcgtcaagtcccgcaaggcgagcgccatcgcctgaacggtctgacggatgcccccggcccttcgggtccttctccctcaaggggacgtccgtccgagaggccggcatcccatggaaaccgccatgggatgccggcctttgccgtatatggcgtctcatacggaaaggaacggcgatgagaagggagttcactcctgacgaacctcgtacctgcgcggcctgtgggccgtgtccaacgtcactccgacgcgcatcatctattccgacgagttcaaaagatacttcctccgcgaacacgggaaaggcaggggagtgaccgagatcttccgcaacgccggactgctggcgctgatcatcggcaggaaacgcatcgaacgctgcgccgcccggtgggtccggccggatcattgtcgtcaccaatgagcaagcaatacatcccatccccaacaacccgttgaagaaagagcctaagattcccgatgtggtcgaggcgatgggcgtgcgctccataaacctacgtgagttctatgacgctagcggcgatctcattcccctgccgtatcccattcggccgacactctgatcgtgtgctgtcggcgcggcgtagcggtcatcgtgatcatttgtcgcatcctttgctgttccattcgtgtgcgtcatcggcgtaaccatctcgcgtgtgtcgcccgggacattgagacagaacaaacgcaatggcttcctgagccgtggcttcaatggagggttttaatcgtgtgccggcgctgttgcggcagcgaggcgttccctctggcgcaatcgctgaaatgcctgtatgattgtccttatgtcggacaattcagagaatgccgctgtggggcatggcggcgagagagacatggctcgggatattgaagcgtcatcgatcgcgagtcatatcgatttgttcttcgatgaactgcatcgcattgacgtggcgtattcggattacgctcgccgagccggagtgtcggataatgtgatgtgcattctggactacctcaaggaccatgatggggcgtcgcagcgggcgatctgcgagtacacgctgttgccgcggcagacggtcaacaatgtcatcgcatcgtttgtggcgcatgggttcgtggagcttggggacgccgaaggcgatcgtcgggtcaaaacggtccgtttcacgcctgccgggcgcagatattgcaacagcttgatcgcgccgagtcgcgccgcggagtatcgggcgatgagcgagcttcctgacgagctgcgcagcgcgttgctcaagggcatgggcgtctacgggcgggtgttccgcaaacagatgcatgacatttccgtgtagtttttcccgtctcggacttcgccacgccgtatggctcaattgtcctacttcgggacaatactgagatatgagcgtagacgatttcgcgaggggaaggaagaagcatgcggctggttgcccgtttcatgaagccatactgggcgctgtgcgcggtgacgacggtgctgctgctggtcgacgtcgtcggcgcgctggtcattcccacattcgccgcggagctgctgaacgaaagcgcgacatccgcatcattcaagaagatgaccatcacggcggtcggcatgggcgtggccgcgctgatttccggcatgtgcgccgtggcgggcggatggtgctgctcgcagttgacctctcgcgtcggcaaggacatgcgcatggctctgtaccgcaaatccatggatctgtcgatctatgatttccgcaatttcggtacggcatcgataaccacgcgaacgatcaacgacgtggtcaacatccagatggccatgaccaatgtgctgtgcatgctgatgccggtgccgatcatattcatcatcgcgctgaccctgtcgttccggctcgacgtgaccctgtctctgtggctgctggtggcgatagccttcgtgtgcgtcgtggcgctgttcatcatgcgatccgcggcgccgttgttccgcaaactgcagaaactgcttgaccgcatcggcgccgtgctgctcgaaaaccttaccggcgtccgcgtgatccgcgccttcaacaaggaatcccatgagcggcggcgcatggacggcacgttcgtcgactacgccgatacgtccatcaaggcgaaccggctattcgcgaacctcgacggcctgtcgtacttcggcatgaacgcattcatcgtcgtcgtgtatttcctcgcgggaggacgcatcagcgccggaaacttccaaatcggcgacatcaccgccatcgtggagtatgcgatcatggcgctgttctatctgatgatggcgcagatggtgatcatcaccttgccgagggcgcttgaatgctgcgagcgtgtgcggctggtgctggatcacagtccgcagatcgccgacccggagccgggcgcggcggtggatatgagcggccgcggtccgctcccggacggcgaggtgctggcgttccgcgatgtgacattccgcttcgcggacgcgcaggaggacacgttgcgacatgtcagcttctcctgcaagacgggccagactacggcgatcatcggtggcacgggctcgggcaaatcgacgatcgccatgctcgcactgcggttccatgacgccaattggggagaagtcaccctcgatggcgtggacgtgcgcaagatgacgcagcacgatctgcggcgccgcgtttcctacgtacagcagcaggcgtggttgttctcggggacgattgccgacaatctgcggtacggagaccgagatgcctccgatgagcggctgaatcatgcgatcgatgtcgcgcaggcccgcgagttcgtcgattcgctgccgcaaggactggaatcccgcgtcgcgcaaggtggtacgaacttctccggtgggcagaagcagcgtctgtcgattgcgcgcgcactgaccggagacacccagctggtggtgttcgatgacagtttctcggcgctcgatttcaagaccgacgccgcgttgcgacatgcgctcgccgcagagacgaacgggcgtgcggtgctcatcatcgcgcagcgcgtgagcaccgtccagcatgccgaccagatcgtcgtgctgtcggacggacaagtggcaggcatcggcaaacatgacgaactgatggcggactgcgaggtgtaccgcgaaatcgtcgaatcgcagaccaaggagccggcaatgggagaggaggcgtgacgagaatgacaacgcagaatgacgatatgacggaaaccgttgtgaacgcgggcgacacggtaaagaccgacgacatcgagctcgaagcgccgaagaacgcgatggtcacagcccggcggctgttcgtgcagctgggcaatcagcgggtgcgcctgtgcgtggtcgccgcgtcgattctgctgttcacgtttttccatatcgccgctccgatgtacagcgccgtcgtggtggactcgatatgggatgccgtgcagggcgcatggcgtgacggcgttccattctcagtaagctggaacgccggcggtatcggctggacgatcctgattctggcaatcctgtatctcggcgagtggggcttctactacctgcagtcctatctgatggcgtccgtggccgaaaacctcaacctgacgctgcgcaagcagatcagcgcgaagatccagcggcttccgctgcgcttcttcgaccgcaataagccgggagaagtgctgagcaaggtcaccaacgatcttgaccgtatcagcgaagtcatgcagacggggttgctgcgactcatcactgccatcaccacggtgaccggctcgctggtcatcatggtctactactcgtggctgctcacggtcgtgttcctcgtgttcatggcattgagcatgtgggtaaccaaactggtcgcccgcaagaacctcgagatcgcgtcattgcgtcaggagaccatcggagagctgaccggcctggccgaggaatactacaagggccgcaacatcatcaaggcatacaatcgcgaggaagacagtgcggcagcgatggaggacgccgccgaacgcacccgaaaagccgcgcagctcgccgacttcatcacgatatccgtcaatcctctgatccgcatgatcgcgcggttctcgcagatggcggtgatgctgctcgccggttggatggtacttggcggccgcatgaccgtcggcgtggcgcaggcgttctaccaatacatcaaccaggtgtccgaaccgctgaccgaagccagctacatgatcaactcgctgcagtccgcgctcgcgtccgccgaacgcaccttcgagctgttggacgaggaagaggaacggcccgacccccagccagctgacgcggcgaagatcgctgaggagcctgtgcagggccgtgtggtgttcaaccacgtgaggttcggatacgatccgcaacggccgctgatgaaagacgtcaacttcgtggccgagccagggcagaaggtcgcaatcgtcgggtcaaccggcgcgggcaagaccacgctgatcaacctgctgatgcgattctacgagatcgatggcggcgcgataacgcttgacggcgtatccacagccgccatgacgcgaggcgatctgcgccgcgaattcggcatggtgctgcaggatacgtggctgttcggcggcaccgtggcggagaatctcgcctacgggcggcccgatgcgacccgcgaggagatcatcgcggcggccaaagccgtgcgcgccgactacttcatacgcacgctgccgcacggctacgataccgtactcgacaacgaggccgggaacctgtcggtcggacaacgccagctgctcaccatcgcccgcgtcttccttgcggacccgccgatcctgatactcgacgaggctaccagctccgtcgatacccggaccgaggcggaaatcggcaaagccatgacaagactgatggcaggacgcaccagcttcgtcatcgcgcaccggctgtcgacgatccgtgacgcggacctgattctgtatatggaacatggtgacatcatcgagcacggcaaccatcatgaactgttggaacgcggcggccgttacgccgcactgtacaacagccagttcgcgtgacacgtcaaggctcatcgacgggcgatcgtgccggcgatgagcctatgcctcgcggtcgagcggaggcaacttgtgcagggtccgcacgatgtcgcattggtcgcgcagcgtgccttcggcggcgcacatcgtcgggtaccacatgcgtttgcgcaatgtggaatccgccctcaacagcatgccgtcatcgctggcgtactgaaaatgcagatgactgagcaggccgccgctcgccagcgcagcccgttcgggcatcggatccatcgccaccagcacactgaacgggcagcctgccggcgcgtccgtcgcatgaaacacataacagggtttgccctccaaccccttggcgatggtccggtcaagccgataccggtagcggcccagtgaacgatccggtcccaccagccagtcgatgatgaatccgtcggcctcgccggccgccgtttcgacgccggcgctctcctgccgcggcgccccgtggcgaggcgccatcctccgaatccgcatcggcctgacgatatcggaacgagcaatcgcgcaaccgtatgatcacatcgctcatagtatgccgccgatgctcagtgccagcgggatcgtgcagaccgccatcgccgcccaatcaaaccaacgctgtgaatctccgttatgcaggtatgccggccgggccgtcccaatcccttggtaagtgccgcgaccgacaggtcatgcgagacgatcgtcgcgttcatcaacagcggaaccagcacgaactccagcgactgggccggatgccgcagcagcgcgagtcggccggaggcaagaccgcgaagggccatcgcgtcgcgggttcgccggtagtcccgcccgattgtcggaaagaaccggatgaccaccatgcaggggatggccaccgattcgggcacgcgcatacgacgcagcgcgcacacgaattcgctgacgcgcgtggtggagaacgcgtaggcaccggtgatgaaacagggcatcatcatgcgaagccccacggaaaacagcccgacgacatgtatccaggcgtcggcgtcagagccggaggctgacgcggcgcccgaagccccgccgtgtccagcgtcgccgcgtccgaccacaatccccaccccagcagaaccgcatagcaggccgtcagccgcagtcccatacgccagcgtccggcaaggaacagcggcgtgaggaacagtgccgtcagcagcgcttcggctcgcgcatccgcgtggaagaacaacagcgtgttggcgagcagcatcagatacagtttcgcccgagggccgaggacgacggccgctggcgcgggagcggacttggatctgctcatgccgtctgcgccggctgcatatgcgccggttcgccccgcatggctgctctcgaatgttgcccgtgaattcatgatgtgtcggtgtcgatgttcgcgaacaccacgtagctgatgaggatgccgatcttgctggagtatttgccggctttggcaatcagatcggcgaccagcgcgaagtacagcgcggagaacacgccgatgttgatcagatcggggatgtcagcttgccggagcggctctggcgtgcggtgccggcctcggcggggcttcccgcctgtgcggtcgggcgggcgcgccagacaaactgcgccgattgcgatgccttgcctagatgcgtgggccggggcgccacaatacgggttgaaatagccgaaatccgcaattccccgtgtcaaatcgccgttttgtggcccgaaaacggcgatttgacacggggaattatcaagaacggctatttcaacccgtgttttggtgaagtgcgacaccgcgatggaggggcgcggaaaaagagaaagcccggcggggaagccgggcttgagagagaagagaagaaggggttcagttattgcggccttgcggtcgtgattactatataaacgcatgtttcggggcaagtcatgtggtttacctgaaaaattcgtgtgaaaccctgcgtatttggctgagatgacataatatttggccttccgtagtattttttctgccgcagccgtcccgttgatgcgcgatggtgaggccggctcctacagtggtcggcatgtcatgcaccacattgcttatcggaaaatcagccagctgcagcggcgcgacgatcatcgcccgcaacgatgattccggctccggccgctacgatcccaagcggctcgtggccgtggcgccgacggaccagccgcgccactaccgcagcacgctcagccatgtcgagatcgacctgccggacgacccgtgccgctacaccatcgcgccgaacgtgctgccgaaccgaggcgtgctcgccgaggccggcgcaagcgagcgcaacgtggcgatgagcgccaccgaaaccatcgcggtgaacgagcgcgtgctcgccgccgacccgctggtcgagctcaggccagccgaaggcgtgccgggagaggccggctatcggccggagacccccggcggcatcggtgaggaggacatcatcacgctggtgctgccgtatgtctcttcggcccgcgagggtgtggaacggctcggcgagctgctggaacggtacggcacctatgagtcgaacggcgtgatcatttccgacgtggacgagatctggtatgtcgagacaatcggtgggcatcactggattgcgcgccgtgtgcccgacgactgctatgcgacgatccccaaccagctgggcatcgacgacttcgacttctccgacgcgttcggcgagcggcggttcttcatgtgcagcgcggacctgcgcgaattcatcgatcggcaccatctgggccgtgccatgcggcccgcgcagggcgccggtttcggcgtcgccgccgtgctgccggaccacaccaacccgcgtgtggtgttcggcaccagcaccgtcaaggaccatatctacaacacgccgcgcgcctggtacatgcaacgtcacctgaacccgagcgaggattgggattcgcccgcggcccgctacacgccgacctccgacgacatcccgtggtgccgggcgccggagaacaaggtgacggtcgaggacatcgactttctgatgtcgtcgcatttcgaaggcacgccttttgacccgtacggaacgctcggtacaccggaaagccggcatcgctaccgtccgatcggcatcaaccgcactggtcacatggtcgcgatcgaactgcggcacgacgtgccggccgcagcggcggcggtgatgtggatcgccttcggttccggcccgttcacggcggtcgcacctttttatgcgaacgtggacgacactccggcgtatctgcgcgacaccacgcccgaggtctccaccgacaacctgtactggacgaaccgtctgatcgccgtaattgccgacgcgcactggtacgagacgcgcaacgcgatcgaatactatggcgagcaggtgcgggcgttcgggcgccggcttgtcgaagaaacggatgcggtgctcgccgatgccgaagccggggacatccgcgcggcgctcatggctgcgaacgagacgatggccggtcgtctgcaggatctgacccataagctgctcgataacgtgctgtatacgtcgagcaacctgatgcgcaactcgttcgccatgtccgataggtgggtctgagggcttgctcccttgtcgcagcgaacggttctcaataagaaaggtgcgagtccgtgtgacgggggaaatgaacacgaaaacagcagaaagcccggaattccgggctttctgcgcaatgttcgcttgttcgaaaatgtgcggaatcctcgcacctttcttaatgagaaccgttcgctgctacctcatacgtctgcgcgtggaaatcacacgtcacggcggtgccgtcggcgaagaccgagcgctgcaccagcgggtcgccgccgacaaggtcatgccgcacgagctcctgcatgccgacgcgccggtgcagcccggccacgaccgcacaccgctcgatgtcattctcggtacgggcgcgcagtgcggcattcatatcaccgtccatgccggcatatgcggcgtcacggatcaggtacggcgcaccgccgttgagcagcgcgtacagcatgtagtcgtcgccaccggccacccgatccatcatccacggctggatcacgctgatcggtcccgcgacccgtgccatcttcgccgagacggtcgccaacccgaacaccgccatcaccgatatccgtccgctggccgatctggcgcaccggcacgggctggcgctgattctcgacaacaccgtgccgacgccgtacctgctgcgcccgatcgaattcggcgccgacatcgttgtgcattcgaccaccaagggcatcaccgggcatggcaacgccatcggcggcgtgatcgtcgacgccggacggttcgactgggcgaacggccgtttcctgcaattcacgcggcctgagcaggtcatcgccgacatcgacggcaaccggcgcagcttctccggggcgtttggctccgaagcgttcatcaggcgcatccgcgtcaaatacctgcgcacgttcggtgccgtgcaaagcccgttcaacgcatacctgcagctgatcggactggagacgctgccgcagcgggtcgcccgccaggtcgaaacggcgacggccatcgccgggcacctcgaacacacgccgcatgtcgtgtcggtgaattattcagggttgccggactcgccgtatcatgcgctcgccgggaaatacttcccccgaggcgtcggccagatcctctcgttcaaggtggaaggcggcgcggaccgtgtgcgtcgcatcctcgacggcgtgaagctgttctcatacgtgccaaatatcggcgacgcaaggtcgctgatcgtcgaccccgcgaacatcactcaccgcgaggtgccggaatcgtatcgcaaggccgccggtgtgagcgacgatctgattcgtctgtccatcggtcttgaggacgcgggagacctgatggccgaccttgaccgggccatagccggcgcatacggggagtagacgcgggcatgccgccgtcccgtacggtgagacgaagaagggccacacggcgaacaactcttgaattttatgtgagctttcactgaaagcccgtcgttttcggataggatggaatagacatcgcgcccgaagtagggtgtggcaacaccagtcaaggaggaatgatgggtgttctggtgggaatgacgggtgctctgatcatgttgggcgtcatcgtcgtcatcgtcctcgccgtgctgtgcgcctcgattttcatcgtgccgcaacagcaggcatacatcatcgaacggttcggcaaatacaataaggtccagttcgccggcatccacgccaagatcccgttcgtcgaccgcatctcgacgaagacgaacatgcgagtctcccagctgaacgtgcagctggaaaccaagacgctcgacaacgtgttcgtcacggtcgtcgcttcgacgcagttccgtgtcaatcctgagaacgtcgccaccgcatactatgagctgcgcgatccagccggacagctcaggagctacatggaggacgcgctgcgttccgcgatcccggcgctcagcctcgatgacgccttcgcccgcaaggacgacgtcgccttcgacgtgcagaagacggtcggcgccgagatggcgcgcttcggcttcaccgtcgtcaagacgctgatcaccgccattgacccgagcccgcaggtcaagagcgcgatggactccatcaacgccgcgcagcgtgagaaggaggccacccgccagcgtgccgaggcgcagcgcatccagatcgagacgcaggccgctgcggacgccgagaagacccgactccagggtgagggccaggccaactaccgtcgtgagatcgcaaacggcatcgtcgaccagatcaagagcctgcaggccgtgggcatggacatcaacgacgtcaacaacgtcgtgctgttcaaccagtaccttgatgtgatgcgctcgctgtccgagtcgaacaacaccaagaccgtcgtgctgcccgcctccacgcccggcggctacgaggatctctaccaacaggtcaccaaggccatgctcaccacaaacgaagccaagtaacaagtcctactcatcgataaagcccctcatcgcgaggggcttttacgttatgcccccgttgacgggctgagccgtcaagcaaacagcggtgctgtttgtaggcgaagagcgaacgacagcgagccagcggaacagtcatgcttagcccgtccataattgcagggcccgaatggctgtcggcggagacgactgggggtggtcaccacccaccggcgctgcgcgtcatctcccgccagcgggaggtgcgccgtgtcccgctaccgcactctcggcgtatggctgaccgccgaaatcagtatcttcttcaagccgtcatacggcggatacaccagcgaaagcgtatccggcaccgcgggcttgccgaccacggtcttgacatgactgaactccaggaacccggccttgccgtgatatgagcccatgcccgaagctcccacgccgccgaacggcagccgactggagatcagatggccaagcggcaggttgaatcccagcgctccgcaactgacttcgcgctcgaacatccgccgtaccctcttgctgcccgtgaacgcgtaggccgccagcgggcgtggccgggcgttgatgaattccactgcggctttcgcgtcggcgacttccaaaatgggcagaatcgggccgaatatctcctcctgcatcaccggcgcatcgggtttgacgcccaatagcacggtcggtgcgatgtagaggtcatcgcgtctggtattgccaccgcataccgtgcgtccggtggcggggctcttcggatcgggcagcagcgcagtcagccggtcgaaatgccgggcgttgatgatgcgtccgaaactgtcggaatgttgcaggtctgagccgaagaaccgcgtgacggcctcggcgatctttcctgccagcggctcgatgacatcggacgttgcgagcacatagtcgggtgccacgcaggtctgcccggcgttgatgaaccgcccccaggcaatgcgccgcgcggcgacgtcgaggttcgcggtacggtcgacgaacaccggcgacttgcctccgagctccaaagtgaccggtgtgagatgcttcgcggcggcggccatgactattgaaccgacttttcctccgccggtgtagaagatgtgattgaacggctgctccagcagctttgtcgtctcctgcggtcctccctgaaccacgcggaacgcctgcgggtccatgtaccgtgcgatgaggtccgccatcacgccgctggtgtgcggagacagctccgatggtttcatgcacacgcaattgcctgcggcgatcgcgtccgccataggctcgaaactgagcagcaccggatagttccacggcgagatgatgagcgccacgcctttcggctcggcgactgtccagccgactgcgggctgcagcaggtaatgcatcggcttgggatgccgcgccgcccacctgccgaggcgtggcttgatgaagcgaatctcatcgagcaccagcccgatttccatcagcgcggtctccgcggcgggtttgcccaggtcggcgcgtaccgcacgggcgatgacggtggcattctgcctcagcattcgggccatcgcgtcgagttgcgcctttcgccagcgcagtggccgggtgactcctgagcggaaggtcgcgtccagttgcgcgaacgcccgttgccgggcggctgcctgcttcgtcgtggtcgccgccgccgtttcctttgtagtcatcgtcgtcctcctgtttgcatggtagccgaagaatccgcggaacgtaatcgacgatttccgccctgacgtcgtattggagttgcatgctggctcctgctggcgggagctgtcggcggagccgactgagggtggtctgggtctttaggcggcgattgtgcccttaagtgcaatcgttctcgatgatcgtgcccgacatatgatgaatgcaccgaaccggcacatcgcaaccgatcggtgacggcttggatggcataagatggacgtcatgaaggattttctgatacgatggctggtgctgacggttgcggccgcggtgatggtggtgcttctgcccggcatgaccgcggtggggcagcctccgattttgggaatcgcagtgttcgcgctgttcatggcgctgatcaacgcctcgatcaagccggtgacgcagctgatcgcgctgccgttttcgattctcacgttcgggctgctgtatctggtcatcaactggctgttcatgcggctcgcctcatggttggcaatcagtctgttcggtgttggcgtgttggtgcacgggttctggtgggcggtgctcggctctctcatcatgtccattgtctcggggatcgtcggcagcatcgtgcgcgattgagcgtcggcgtacatccggcatgatggtcggatttcgggcctcgcatgattgcctggccgcgagccgacggcgttcgcggacactccggttccgtcggccacataccgtgctaggatatgcaccgaagtcaaggcgatgatccgttatcagcggggagtcttcggaagaaaagcttcatgacggtcgatcgaacgtcgacggcacgaagctgagtagaaccgacgggatcggcccgtcacagccgaacacaagcggttgcgagttttcgccatcttaggatggccggatgcgagcgacaagcgaggtggtaccgcggtggcggtcggcagcctgagggcatgccgccgatcatcgtcctcgtaggcgggaatggccatgacggctattccgggcggaacaagggttccggctgcgaggacatcgccggcgcatatatgccgccggtgtggcgaacggccgtctcaatccctgttcttcccgtgaatggttcgctatagccagctcccgtaggaccagtgcaatgcgacatcgaggagagcaatggtgagcgaaaccaccaattcccacgtgtatcccaaggcgaacgagggcggcgagaccgccagcgtcgcgccgaacccgagtttccccaacatggaggaaaccgtcctgaagtattgggacaaggacgacaccttcaacaagtccgttgaacgcaacccttccggcgaccatagccagaacgagttcgtgttcttcgacggcccgccgttcgcgaacggcctgccgcactacggccacctgctgaccggttacgcgaaggacgtgatcccgcgctaccagaccatgaagggccgcaaggtcaaccgcgtgttcggctgggacacgcacggtctgcccgccgagctggaggcgcagaaggagctcggcatcgactcggtcgaccagatcgagaagatgggcatcgacaagttcaatgacgcctgccgcgcctccgtgctgaagtacacgcacgaatggcaggattacgtgcatcgtcaggcccgctgggtcgacttcgagcacgggtacaagacgctgaacatcccgtacatggagtcggtgatgtgggcgttcaagcagctgtacgagaagggtctggcgtaccagggctaccgcgtgctgccgtactgcccgaaggatcagacgccgctttcggcgcacgagctgcgcatggacgccgacgtgtatcaggatcgtcaggacaccaccgtgtcggtggccgtgaagctgcgcgacgaggaggacgcctacgcggtcttctggaccaccacgccgtggaccgtgcccaccaacttcgcgatcgtcgtcggcgctgacatcgactatgtcgaggtgcgcccgacgcagggcaagtacgccggcaagaagttctacttcggcaagcccctgctctccaagtacgagaaggagctcggcgaggattacgaggtcgtgcgcgagctcaagggctccgagatggccggttggcgttactggccggtgttcccgtacttcgctggcgacaaagccgagtctgagggcaacgtgccggggcccgaaggctaccaaatctttaccgcggactacgtcgacaccgtcgagggtaccggcctggttcaccaggctccctatggtgaggacgatatgaacacgctgaacgcgcacggcatcaagagcactgacgtgctcgacgccggctgccgcttcaccgcgcagtgccccgattacgagggtatgtacgtgttcgacgcgaacaagccgatcctgcgcaacctgcgcaacggagacggcccgctggccgagatcccggccgagcatcgcgcgatcctgttccaggagaagagctatgtgcactcctacccgcattgctggcgttgcgccacgccgctgatctacaagcctgtgagctcctggttcgtgtcggtgacgaagatcaagccgcgcctgttggagctcaaccagcagatcaactggattcctgagaatgtcaaggacggccagttcggtaagtggctcgccaacgcgcgcgactggtcgatctcccgcaaccgcttctggggttcgccgatcccggtgtgggtgagcgatgacccgaagtacccgcgcgtcgacgtgtacggttcgttggaggagctcaaggccgacttcggcgactacccgcgcgacaaggacggcaacgtcaacatgcaccgtccgtggatcgacaacctcacgcgcgtcaacccggacgacccggccggcaagagccacatgcaccgtatcagcgacgtgctcgactgctggttcgaatccggttcgatgtcgttcgcgcagttccactacccgttcgagaacaaggagaagttcgagcagcacttcccggccgattacattgtcgaatacatcggccagactcgcggctggttctacctgctgcacgtgatggccaccgcgctgttcgaccgcccggcgttcaagaacgtgatctgccacggcatcgtgctcggttccgacggccagaagatgtcgaagcacctgtgcaactacccggacgtgaacggcgtgttcgacaagtacggttccgacgccatgcgctggttccttatgtcgtcgccaatcctgcgcggcggcaacctcattgttaccgctgagggcatccgcgacaccgtgcgccaggtcatgctgccggtgtggagctcctactacttcttcacgctgtatgcgaacgcggccaatggcggggccggcttcgacgcccgtcagctgcgcgcggacgaggtggcgggtctgcccgagatggaccgttacctgctggcccgcacccgcaggctcgtagagcgtgtagagaagtcgctcgacgagttcgcgatttctgacgcgtgcgatgcggcaagtgacttcatcgacgtgctcaccaactggtacatccgcaacacccgtgaccgcttctggaaggaggacgcgaacgcgttcaacacgctgtacaccgtgcttgaggtgttcatgcgcgttctcgcgccgctcgccccgatggagtccgaatccgtgtggcgtggcctgaccggcggcgaatccgtgcatctggccgattggccgtacgtcgcggacgagaagaccggtgaggcgaccgagcttggccgtgtgctggtcgacgacccggcactggtggacgcgatggagaaggtgcgcgagatcgtctccggcactctgtcgttgcgcaaggccgcccagatccgtgtgcgccagccgctcgccaagctcaccgtcgtggtcgaggatgtggacgccgtcaaggcgtacgacgaaattctcaagtcagagcttaatataaaggatattgagttctgcacgatggaggatgccggttcgcaggggctgaagatcgtgcacgagctgaaggtcaacgcccgcgccgccggcccgcgcctcggcaagcaggtccagttcgccatcaaggcgtccaagaccggtgcctggcacgtcgatgccgcgaccggtgctccggtcgtcgagacgccgaacggcgaggttgcgctggaggccggcgaatacgagttaatcaaccgcgtggaggaggagaacgccgccgaggccgacgcttccgtgtcggccgctctgcctaccggcggtttcgtgatcctcgataccgtgctgaccgccgacttggaggccgagggctacgcccgcgatgtgattcgcgccgtgcaggacgcccgcaaggccgccgacctggacatcgccgatcgcatcgccctggtgctgaccgtgccgtccgccaatgtggccgatgtcgagcggttccgcgatctgatcgcccatgagacgctggccacctccttcgcggtgaaggaaggcgccgagctgggtgtggaggtcgccaaggcgtgacgccgtggtgagccgaccgcgcccgctgcgtgacgcacgggcgcgtggaatgcatgaagtggtcctgccgcttggcggcgggaccacttttgttgttccgcggtatgcttgcgctgcgacgatggcgttgcgatacggagcgattgacgaggtggtgataatgtgtgcgacgtactatgcgagaaccagcgatcatgggtatgagacctgcgacaaacccaagcctccgctgtcggcgaccggcgcgaacgtgaccgcgatatcggtcgcggtcatggcgctcgccagcgctgcgacggtgctgctgaccatcaagcgccgtaggggctgaacatgaccggtgccggagagtccaatgctctccggcaccgtcatatgtcgaactcctgcatagggtaccttaagtcagcctgatctgatagactgtctgcgggaatccgaacacttggcggaacgatgtcgtgcctccggggcaaagattccggcaagaagtacaagaatgttcaaaatcatagaggattgaaatatgctacacacagcatcaaggggacgctcgcgttcgtggctgcgcagactcaccgcattgatagcggtctcggcgctcgcgttcgtggcattgccgaacgtcgcggtggcggcgaatccgacggaatacctcgatgtgtcgttcggcggcacgttcgctgaagacacctacaccacaggtggcgacgaggtggcgaagggctccgtgaccaagcacggcagcataccgaccaagcttgacggcggcggcatcaccctcgctggcggcaccaacggcgtgaccttcacctcgaccgcgagcttcagcgcgagcgggaaggcgaacaagggattccgcgccgaaatggaataccgtacgaagcagacgcccagcaacctcgccacattgttctccgccatgggcaacatcttcgtgcgggcgaacggcagcaacctcgaatacggcttctccacgaacccttccggcaatacatggaacgactacacaaagtccgtgacgctgccttccaacaatgtgaagcacatcatccagctgacatatctgccgggagccgacggcgctgcctcgacgttgcagttgaaggtggatggcgtggccggcgagaccgccacctccacggccggcgagctcgcggccgtcagcgattccgtcgagaacaagttcgggatcggctacgaggtgaaccccgcttccggcgcggcgagccgcggtcttgccggtgacgtgttccgcgtgcgtgtcgccgattcgaacgccccgtgggagattcttgacgcatcccagctgctgcatgtcaatttcaacggcacgttcagcggcacctcatataccgcggcgagcggcgagcagatgctgggctcgctggtgtcgcgctcagccaatccgtccatctcgaactccgccgtcacgctggccggcggcacggccggattcgatttcacgcccacggacttcaccctcggtaacaacgaggccctcaccacgccgctggtcgcggagctgcgcttcaccccgacgcagaccggcgacaaccagaccctgttcggcgcgggcggcaacctgttcctgcgctacgagtcgaacaagctcgtgttcggcgcctccaccaagtccggcgataattggaccgaccacaagatcgagtccgcggccgccacgggtgcggagcacgtcgtgtcggtggcgtacgtgcccaatgaggccggcaccggcgcgaagctcgtcatgcgcgtggatggcggcgacgcccagaccaaggacatcaccggtctggcttacctgaattcgaacatcaagggcaagatcggcttcggcaacgaagtgcattccgccgcgctcagccgcggcttcgtcggctcgctgagcgagatccgcctggccaaaacctccgcgaacttcaccaccaacgaattcaagctggtctactctcaggtcagctgcgacacgtcgggcatcaaggaggcgaataccttcgacgtgaagcccgccgagtgcgaggccgcgcttaagaccaagctgtccaagctgcgtccgaccgaagggcaggccgactacatcgactggggtcagatcggattcctccattacggcatcaacacgtactacaaccaggagtggggtcacggtaacgaggatccctcccgcatcgacccgaccggcctcgacaccgaccagtgggcgaagtccttcgccgacggtggcttcaagatgatcatggtgacggtcaagcaccatgacggcttcgagctgtacgactcgcggtacaacaccgagcacgactgggcaaacaccgccgtcgccaagcgcacgggggagaaggacctgttccgcaagattgtcgcctcggcgaagaaatacggcctgaaggtcggcatctactattcgccggctgattcctacatggagaagaagggcgtctggggcaacggctccgcacgcgtcgagcgcacgatccccacgctggtggagaacgacgaccgcgccgacaaggtggcttccggcaaactgcccacgttcaagtacaaggccacggagtacggcgcctacatgctcaaccagctctatgagctgctgactgagtacggcgacatctccgaggtctggttcgacggtgcccaaggcaacaccgcaggcactgagcattacgactatggcgtgttctacaagatgatccgccagcttcagccccaggcaattcaggccaacgccgcatacgatgcccgatgggtgggcaacgaggacggctgggcccgtcagaccgagtggagcccgcaggcggcatacaacgacggcgtagacaaggtgtcgctcaagcctggccagatggcccccgacggtacgcttggcaccatgtcgagcgtgctgtccgagatccgcagcggcgccgccaaccagctgcactggtatccggccgaagtcgacgccaagaaccggcccggatggttctaccatgccaaccaatcgccggcgtccgtagctcaagtcgtgaagtactacgagcagtccacgggacgcaactcgcagtatctgctgaacgtcccaccgtccgataccggcaagctcgccgatgcggatgccgcgggacttaaggggctgggcgaggagctcgcccgacgctacggcaccgatcttgccctgggcaagagcgcgaccgtcgccgcgtccgcgaacggcaccgcggtagcggccccgaagctgaccgacggttcgaagctctcctccgacaaggccgtgggcaatacgccgacgtacaccatcgatctgggcagcgctgtcgccgtggatgcagtgaagatctccgaggacgtgcgcaatgccggccagcagatcgaaagcgccaccctgcagggacgagtcaatggaacatggacgaatctggcgactatgacgacggtcgggcagcagcgcgaccttcgcttcacgtcccagaacatcgatgccatccgtctggtggtcaactcctcccgcggtccggtgcgtctgagccgtcttgaggtgttccacaccgaatccgagattcagaccggcgcccgcgcctactacatcgacccgacggcgcagaccgcgggagatggattcacgaaggacaagcccatgacgtcgatcgagcagctgcacgatgtgaccgtcgcgccaggctccgtgatcttcgtcaaggcgggcaccgagctgaccggggacttcgccgtcttcggctacggcaccaaggacgagcccatcaccgtgacgacatacggcaaaagcgacaaagccaccaccgcgagcttcgacggcatgaccgccgggctgacgctgaagcaggcgctgaaggcactcggcaaggacgacgccggctgggtcgtggccgattccgccactgcaccggcctcccgcgtgtatgtcccgcaggatgagatcagcgtgcacgcccagtcgtcgcagaactccggcgcagaggcggcgaaggcgctcgacggcgactcgtcgacgaactggcactcccagtacagcccgaccgccgcgtccgccccgcattgggtgactctcgatctcggcgaatcgcgtgagaacgtcgcctacttcgactacctcgcccgtatcgacggcaacaataacggtgccgccaaggattacgaggtgtatgtctccgacgatcccaacgattttggagcctctgtggcctcgggcacgttgaagaacgtcgcctacacgcagcgcatcaagctgacccccaagaacggacggtacgtcaagtttgtcatcaagaccgattattccggatcgaacttcggctccgcggcggaaatgaatgtcgagttgctgcccacggccgtagaggaggacaaggtcgctaccccgcagaagccgacagtggacgatgatgccgatacatacaccatccccgacatcgagggagtcgtgtacaaggtcgacggcaaggtgttggccgctggttccgtagtgaacgtgggcgatgaggacgtgaccgtcacggtcaccgccgagcccgccgacggataccgcttcccggatggtgtgacgtccccagtcacgtatgagctgacgttcaccaagaagggtggcgagaagcctccgaccgaagtcaacaaggacaagctgcacgccacgatcaccaaggctcaggcgatcgaccgttccgcctatacggacgagtcgctcaaggtgcttgatgacaagctcgccgcagcgctcaaggtctatgacgatgacaaggtgagccaggatgatgtcaatgccgccgaggcggctctgtctgcggcgatcgacgcgctgaagaccaagccgacgacccccggcggtgaaggtgagaagcctggtgaaggcaagaagcccggcgacgtgatcgcaaagaccggcgcctccacaatgggcgttgtcttcgctgcacttgcgatggtagcgggtgcggtcgtgacgcttgaagccaagcgtaagtccaaccggtaacatcggttctccggccgtctgatgcgccggcccgtctcctagaaaagacgggccggcgcatcgtcatttttgtcaccggcgtcgcggcaatattccgtgcgcctacaatgtcgatatatgcccgtcaacaaggggagcggcgatggcacgatgtcggccgtgcgctgagcgtgcgcggctccacggtgctggtggtcggcaccggggacatcggctcgcatttcgccagcatatgcaaggccatgggcgcgaacacgctgggagtgcgtcgtgacccgacccgcacggcggaaggcatcgaccggatgtatcgcattggagaacgtaaggcgttatgtagccggcgaacctctgacgaatcgccggcgctgaacggataatggcttcggcttcgcccgttcgacaccggcgagaccgaagccattatcgcttgagattcttcgtctaggattccaggtcgcgcaccgacccgcgttccaccagctccgcgggaaccacggtcttcacgcccgaaggcactcgaaggccctcgcacagacgcttggtcatgaagaacgcctcgcgtccgatgtcgttgaatttcatgcgcatggtggtcagcgacagccgtggaatcgtcccgctcagcgaatcgtccactccgacgatgctgacgtcttccggcacgcgtttgccggcggcctgcaatccgagcatcgcgccatacgccatctggtcgttggccgcatagatcgcggtgcaatcggggtcgtgagccagtgcgagtccggcttgatatccgctgtccgcctcccagtcgcccatataggtcggagggatgcgcagctccagttggtcgagcgtgtcgtgccacccctgcgcgcggctttccgcggctcgcgatgaggacggcccggcgatgtggtagacggtcttgtgccccttgctgagcagatagtccacgacggcggctgagcagccgtactggtcggcatcgatggtggggcagtagttcgcgggatcctcggagatgataacgaccggcagctccttgggcgggcggaactccgagaagtccgtcacgtgctcctccatgacggcgatgacgccgtccacgggaagctgcttcatacgctcgatggcggcatgcagggtgcgttcccgattgcgtccgaaggactgcatcgtgatggcgtaaccattgctgttcgccgcgtcggcgatgccgccgaggatacgcgcgttaccataggtgagcatgttgaacagcacgacgccgacatccttgaacttgccgtgcttaagcgccctggccgcatagttgggccggtaacccagcttggccatggcggcttccacacgctgccgtgtttccggccggacggcattgcttccgttggcgactcgtgagaccgtctggggcgacacgctggcggctttcgccacgtcctgcatggaagcgggttgcgaatgatccatggttcctgcttgttttttggcatttctatgttttggttaccatcagtatagactatttcctgatgacttgccgtaccctcaagtggacaattccaacaatattgatattatggtaacgcaaacatttatagagggtgcatctcgcggaacaagttcaatgagctgttgcgttgtggcaagttctgtgcggtgtgcttcgcttcgagtccttcgaaggagaggggcatgacatcggtgagtgtgtcgcctttggctcgtgtgaataagcacaagcgggattggcgtggttggaagttcatgtggccgttcgcgttggtgttcgtgttcgtgttcatcgtgccgatcttcgcggtctgctgcctgttcccgttcgtctccatgctcatcaacgcgacgaagacccaatcggacttcacgggcgcgttcggcctgggctttggcaagacgttcgcgctgtgggacaacatcgtgacggtgttcacctatgacgacggcatcttcgcgcgctggctggtcaacacgctgatctacgtggtggtgggcgcgggcggcgcgaccctgctggcgatcatgggcggctacgctttgacgaagttccgcttcccgggccgcaaggccgtgtccgcggtgatcatcggctcgatctcggtgccgggcatcgcgctggcggccctgttcacgatcgttgccacgtggaacgactgctttctgccgctgatcatgttgaaggactcggactggttcccgctgaccatcggtctgaaccagtggaaggaccaagcgtccactgcgggcggccaagccatccagaacctggtcatcacgggctcgctgatcacgatcatcccgctggtcatcgcgttcctgtgcctgcagaagtactggcagtccggcctcgccgccggcgccgtcaaggagtgatctcgcgggagggtcagtgtccgcttgcagcatgcgtcacgttcgtctgacggtcttgacgtgcgcctagcggctggctctccatacggaacatgtatatgatatggagggacgctcaccgtgtgcgatgcgggctggcgcgatatggcaccagcccgctcgcatgtcacagttgatttttcgtcgatgcgacggttcggccggggcgtcagacaatgaacaagtaatggagcggaatatgagtaaacgcagaaagcacagttggccgcagccgctgaagggcgccgaatcccgtctctggtatggcggtgattacaatcccgaccaatggccggaggaggtctgggacgatgatatccgtctgatgaagaaggccggcgtcaaccttgtatcagtcggcatcttctcatgggcgaagatcgagccggaggaaggcaagtacgatttcgactggctggaccgtgccatcgataagctcggcaaggcgggcatcgccgtagacctcgcctccgccaccgcctccccgccgatgtggctgacccaggcccatccggaggtgctgtggaaggacgagcgcggcgacaccgtgtggccgggcgcccgtgagcattggcgcccgacgagccctgtgttccgcgagtacgcgctgaacctgtgccgtcgtatggccgagcactataagggcaacccatacgtggtggcctggcacgtgagcaacgaatacggctgccacaaccgcttcgactactcggacgacgccatgcgcgccttccagaagtggtgcaagaagcgctacaagaccatcgacgcggtgaacgaggcctggggaacagcgttctgggcccagcacatgaacgatttctccgagatcatcccgcctcgctacatcggtgacggcaacttcatgaacccgggcaagctgctcgactacaagcggttcagctccgacgcgctcaaggagctctacatcgccgaacgtgacgtgctggagtccatcacgccgggtctgccgctgaccaccaatttcatggtgtccgccggcggctcgatgcttgactatgacgactggggcgcggaggtcgatttcgtctccaacgaccactacttcacgccgggcgaggaccatttcgacgaggttgcgtactccgcgtcgctgatggacggcatttcacgcaaggaaccgtggttccagatggagcattccacctccgcggtgaattggcgtccgatcaactaccgtgcggagccgggctcggtcgtgcgcgactccctcgcgcaggtcgccatgggtgccgacgccatctgctatttccagtggcgacagtccaaggccggcgcggagaagtggcactcctcgatggtgccgcatgcgggcgaggattcgcagatcttccgtgatgtgtgcgagctgggcgccgatctgggacgtctgtccgacgagggtctgatgggcaccaagacggtcaagtccaaggtcgccgtcgtgttcgactacgagtcccagtgggccaccgagtgcaccgcgaacccgacccagcaggtcgatcattggaccgagccgttggattggttccgcgcgcttgccgacaacggcatcaccgccgacgtggttccggtgcggtccgattgggattcctacgagattgccgtgctgccgtgcgtgtatttgctgtccgaagagacgagccgcagggttcgggagttcgtggcgaacggcggcaagttgttcgtgacgtactacaccggattgagcgacgagaacgaccacatctggcttggcggctacccgggctcgattcgtgacgtcgtcggcgtgcgcgtcgaagagttcgccccgatgggcaacgacatgccgggcgcattggatcacctcgacctggacaatggcacggtggcgcatgactttgccgacgtgatcacgtccacggccgacacgtccacggtactggcctcctataaggcggaacgctggaccggcatgaacgaggtgccggccatcgtggccaacgggtatggcgacgggcggaccgtatatgtcggatgccgtctgggccgtcaggggcttgcgaagagcctgccggcgatgctgggttccatggggctgtcggacctcgccggtgatggccgcgtgctgcgtgtcgaacgcgccgacgccgcggcggcgagccgcttcgagttcgtgttcaaccgcacccatgaaccggtgaccgtcgacgttgaaggggaggccatcgcggcttcgctcgcgcatgtcgacgacgggcgggccaccatcgatccgacgggcgttgtcgtgctcaggcgataatcgttggaaacactgggctgtaagggcttaggaaaggcgtatgtttgcggtgacacgcgacatacgccttatgggaaagaaggcgctggcgcttaccgggctgcggcgatgctggtcagcgtcgctgcgtgcggcaactcaagcagcagctccgctccgaagcaggaaggcgacgtcaaggaaatcaccgtgtgggcttggggcctacgctgactcaggtggccaaggacttcaaaaaaggagaccggcatcaatgtcaacctggtgaacaccggccagggcgacaagacctgggacgagttctatcaggacgccaagaagattcacacccttggcgacaactactacatcacgtccgacaccggtgtcgccggcttctacgactcgatgacctggctggccagtgcgacgctgttctccaccgaaggcgagacggtcaccattaacctgactggcgccccgaaggtcaaggcccgcggtatcttcggcgactaccttggcaagtcctacaccggcaaccagaagctgagcgatggtgtcgccgctttgggaacaggctctgaaggactacgcgaaggatcagggctacaccgtcaagtaaccttcgcagtcaagcaatctggcgtggtaatgaccggaatacggtgaccttcggtcatcccttcctcgtgtgaaggcccctcccctcatcagggaggggccttcacgtatcttcacctgttgcagcgcgcgtgtagactctacgatgagcgaattcttcccgatacatcgagcacgctaaggagatgacatgacgatatcggcacggttgcggcggctgcgtctgcgtatctcggcgttgctcacgatctgtgcgatgacgctggcagtcgcctcctgcgggcagccggacacgcgcaccgtcatcaccgtctggtcgtgggaacccagcatgacgacgctgatcgccgatttcgagaaggctaatccagacgtccgcgtgaagctgaacaacatcagcggctacgaccacctcaacagcgctatacaggacgggtacggcacgcccgacgtggtgcagctcgaatactatgccctgccgcagtacgcggtgagcggccagctgatggacctcaccggtcgtgtcggcagctacagctcgttcttcaccccaggcacctgggcgtcggtgcagctcgcgcagcgcacgtacgcgctacccatggattccgggcctatggcgttcttctacaacgatgacgcattccgccaggccggtgtcgacgcgaccaagatcaccacatgggatgattattacgaggccgcgaaaaagctgaaaaacatcggcgtgtacatcgccgcagacgccggtgacgccagcttctacaatgcgatgatatggctcgcgggcggtcggcctttccatacgtcatccgacggcaagaccgtgaccgtcgatctcaagggcgacgccggaaccaggacgttcaccgaattctggcagcgcatgatcgacgagggactggtcaacacccatctcaaagtctggtccgaggattggaaacgtgcgctgggtggcgggtcggtcgcctccgtgttcgccggagcctggatgccgtcgctgctgctggccgacgtgccgggcacatcgggactgtggcgcgtcacgcgcatgccgactcaggacggcacggtcaccaatgccgagaacggcggctccgcgctgggcgtgctgcacaccacacgcaagcctgaagcggcattccgtttcgtggattatgtctgccacaacaaatccggcatcaagacccgcgtcgatggtggcgccttcccggccgacaatgcgacgttgaacagcggcgaattcctcaacaagaccaccgtcaccagtgagcatcacgccgaggtggagtatttcggcgggcagcggttcaacgaggtgctgtccgaggcagcggagtccgtgtcggtcggataccagtacctgccgttcgaagtgtacgcgcgcagccacttccgcagcgccaccgcagacgcatacacgtggtcggcggccaagcaggcatacgaccgggccaaggcgcgcaaggacgcaggactgaccaatgacgatggcggtccgattacactgccggaccgacctggcaagaagatcacgctgatgagcggcatcgccgcatggcagcgcgacctcaaggagtacggcgtcaatcagggcttcaccatcaaatgacctgcgccggcgtggccaatgccgaagccggtcacgcgaacccgctgcctgcccgcgcgattcagcgatgcgagttgcggctgtggatcagcgccatgcctttgaagatcagctcggggtcatacacgtcgatcagctccgtgtcatccttgaacacgcggcccaggccgccggtcgccacgacggtgaacggctcgtccagctccatgcggaactgccggatcgtgcgttcgatgccgccgaggaagttgtagtagagtccggcctgcatcgcggtcttcgtgcctgtggcgagaatggatttcggcttggtgatttccacctcgggcagctgggccgtctcgccccacaaggccgccgcggccgtgcggatgcccgtggtgatcaggccgcaggtgatcacgccctcgtcattgacgtagttgaacgtcgtggcggtgccgaaatcggcgaccagcaccggaccgccgtacgtgtaatacgcgcccacgcagtcggcgaggcagtccgaacccagcgacttcgggtcgtcgatgcgaatgttgatgccggttttgattccagggccgaccaccatgggattgatgttcaggaacttgatgatgcttgcacggaacgagtgcatgaccttcggcacgacggacgcgatgatcacgtcatcgatatcagagggacgcagaccgctcagcgcgaggaactgcgtgatcatcaggccgtactcgtcggacgtgtggttcgatttcgtcgtgattcggtaggtgccgatgatgtcgtcgccgtccaggaagccgagaacgatgttggtgttgccgatgtcgaccgctacgagcatgcgaatccccttatgaatcgtgatgcgtgggcgcatcatgaacggatgccttcacccatgatagaacgccagcgcggcatccgcgcgagtcaggttcgacctgacgctacaatgtcctgtggcggacgacccgcaagggcggccagccgcagtatcacaatacaaatgaagaggaatcatgactgaaaaccatggtgcgcacggcgacgccggcgcaaccgacaacgaagatctgaacacacaggaaaccgctgcgacgaacgagagcgccgcggccagcatggacgcgcagctggagagccgcgccaagaacgccgccgggcaccggcgggctacatggtggatcgtcgccatcgtcgccgtgatcgcggtcgtcgccgtcgtcgcgggatgcatcgcggcgttcgccggacgcaaaaacgacacgacgggcgccaaggcgaacgatacggtcaccatcgggttgaaactcgcgcccaccaacctcgacatccgcaacaccgccggatcggccatcgaccaggtactcatcggcaacgtctacgagggactcgtggcgcgcgacgagcacaatcaggtcgtaccagccatcgcgaaggcatgggatgtcagcgacgacggcaccacatacacgtttcatctcaacgacggcatgacgttctcgaacggagacaagctcgacgccgacgacgtggcatggtccatcaacgagctcgtcacgaagcagtaccatgacgccgattcgctggtcaacttcgtctccgtcaaagcgagcgacccgaacaccgtcgaactcaagctcagcgcgccgtacgcgaacctgctgtgggggctgaccggccgtcccggactcgtgttcgacaaggacgcgaaatacgacgcgaagacccaggcgatcggctccggcccgtacaccgtcgagaagttcgtcaccaactcgtccataacgctcaaggcgaaccccaactactggggcgccaacaaggcgaagaccgacacggtcgtcgtgcggtatttcaccgacgacaacgcggccgtgaacgcgctcaagtccggcgatgtgcaggtgctcgcgccgatcagcgagaacctggccgaaccgttcaccaaggacagcgaccattacgtggtcaaggccggcgacgataccgacaaattcgtgctcgcgttcaacggcaccggagcgaagacctccgacaagcgcgtgcgccaggcgattcgctacgccatcaaccataaggagatcatcgcctcgcgcggcggttcggacaccgccctcggcggcccgatcccctccctcgaccccggctacgaggacctgaccggcatctacccgtacgaccttgacaaggcgaagtcgctgatgtccgaggcgggatactccgaatcgaagccgctgcagctgagcctgacctacgcgaacatatacggcaccgagatcggcgaccagctgcgcagccagctcaagaagatcggcatcgacctgaaggtcaacgtggtcgaattctccacgtggctgcaggacgtgtatacgaacaggaattacgacatctcgctcgttgaccacaacgaaagccacgacttctaccagtgggccgacccgacctactactacaactacgacaacaaggaggtccaggccctgtacgccaaggccatcgccgccacgaacgacgacgaccgcgacaagctgctcgccgaagccgcacgcaaggtgtccgaagacgcccccgccgactggctgttcaactaccgcgtcaccaccgcgtacgcgaagggcgtcaccggcttcccgatcaacctcaaccagaccctgttgccgctgtacaacgtcgcctacaccaagtgacggctgaaatcgccgcgtatcccggcacaggcgattccggccgtcagggtctcgggggctgtgacgggatgcgcggcgctctcaccggaaggagtccacttgcgattcgtcatacgccgtctgctgctgttcgcggcggcgctgttcggcatctccatcgtcgtgttcgcggcattgcgcgtgctgcccggcgacgtggcctcggtgatggccgggctgaattccccgccggaacgggtcgccgcgctgcgctcgcaactcggtctggaccggccgctgatcgcgcaatacgccgactggatcggcgcgttgctgcacggtgatttcggcacctccattctgaccggccgctccatcagcgcccaggtcggcgagcgggcatcggtgacgttcccgctgatcgtcctcgggctgcttatcgcgatggggctgggcattccgctgggatgcgaggcgacactggcccgcagccgcgccgctcgcggcatgtttcacatggtcgccatcatcggtggcgccgtgcccgcgctgtggggtggtctgctgctgatcctgctgttctcgcgcggaaccggactgattggcgtgtttccgtcgcagggattcccccaaggcgggtggtccgatttcggttcggcgctgatgtcgctggtgttgccagcctgctcggtgggcatcatcgtgggggccgggctgatgcggtacacccgctcggcattgggcggactggcatcctccggttacatcgacatggccatgtcctgtggcatgacccaccggcaggcggtgctgtgcgtgggattgcgcctcgccatgccgcaactggtctccgtcatcggactgacgttcgcggagatggtcaccggcgtcatggtcatcgagaatctgttcgcgctgccgggcatcggcaacggtctggtgaccgatgtcggcaaccgtgatctcatcgccgtgcagagcgagctgttcatgctggcggcttttttcctgctgatcggcctgctggtcgacctgctgcatcgggtgcttgacccgcggctgaagtcggctgacgatgtcacggaggtgaacgcatgacgcgaccgatcgatgccaagactcaagccggagccggaaaaccgtcttccgggaacagtgcgacgacggcgcaagaccgtgcccgcactgcccgcggcgtgcgcgccgcacgtgtcgttctgggtacgatgtggggccacgctgcgggcaagttctcgctgatcgtgctcggcctatggctggcatcatccgcggtgtcgctggtctggaccccgtattcgctgtggagcaccgacggctaccatgtgtgggcgaagccgtcgcgcgaccactggctgggaaccgacggcaccggtgccgacgtgttcagctggttgctggccggctcccgcaccaacctgctgatcgtcgtgctgaccgtggccgtcgctgcggtgttcggactggccatcgtggcgttgatggtgtccaggcacgcggcgctttcggcggcatcggtggtcgtcgtcgacgcgctgatatccattcccacggtgctgatcgcgctgattctcgccgtgccgctcggtccgtccgtggccgtcatcgtgatcgcgtgcggattcggatacgggttgaatctggcgcgcgtgtcccgccctcaggcgatgctcgccgcgcgttcgtcctatgtcgagtcggcgctgtcgaacggcgcttcgggactgaacgtgctggcgcgccatatcctgccgaatatctcgcctgtgctgacggtgcagctgtcactgtcggcaggcaccgcggtgttggccgaaagcggtctgacgtaccttggcatcggcgtgccgtcgggcgtgcccagttgggggcactccctggccacgtccgtgaagttcatcaacgtgtacccgctgaccgtgctgtggccggggctgatcgtcacgctcgtggtggtcgcgttgaacctgttcggcgacgcgctgcgcgacgccgccgacccattgacgaatcaccgattgcgaggtgcgcgatgagcgttacggttcgtgacctgaacattgccatcggcggtgcgcccatcgtgcgcggcgtcgacttggatatcgccgacgcgcagcgcgtcggcctggtgggggcatcgggctccggcaagtcgatgatttccaaggcgatgctcggcctgctgccgacgcatgccgtggtgtccggctcggtagtgatgggcggcatggagacggtcggtacggatgacaggcgtcttgccgacatccgtggccgttacgccggcatggtgttccagaatccggccgcatccctcaatccggtgatgagtgtggagaagcaggtcggactaccgctgcggctccattatgacctgaccgccgtcgagcgtcgggagcgtgtccgcgcgatgatccgcaaggtcgggctgccggacgacgtcctcggcaaattcccccacgagttgtccggcgggcagcagcagcgcgtcggcatcgccactgcgctgattacctctccgcgtttcatcatcgccgacgagccgacgaccgcgcttgattcgatcacccagcggcagatcgtgcgcctgctggtctccctggtcgatgacatgggcgcgtcactgctgttcatcacccatgatttcgccgtgctggcccacgcgacgacacactgctatgtgcttgacgaagggcggatagtggagtcagggcgcaccgccgacgtgctcgcctcgccgcgcgacgagcggacgcggcggctgatcggggctgcccgggaactgacattgcatgccggggatgccggggataaggagcagtcatcgtgagcgatttccgtatatcccaagttgccgcgtcaccctccatgacggaaccgtcaacaagtggttccgagcggaaactcgacaggcccgccgtcgtattgggcgcgcggtcgatctgcaagtcgttcggccggcgcgccgccgcgcatcaggtgctgttcgacgtggacgtggacgtatatgagggggagtgccttgctgtgatcggcggctccggctccggcaagtcgacgttgacccgcatcatgctggggttggggaacgccgatggcggcactgtggagtaccgcggcacgccggtgctgcgtggcggctccggtctgcggcggctgcgccacgattccggactgatatatcaggatccctacggatcactggaccccagatggacggtcggcgatatcgtcgccgagccgttgtccctgcgacggcgggggagcaggcccgaccccgcaggcattcgcgagaacgtgcacgcggcgctggaacgggtcggattggatgccggcgtgttcatcgaccgatatccaatggatctgtccggcggccaggcgcagcgcgtcgccatcgcccgcgcgatcatcaccgagccggacgtgatactcgccgatgagccgatgagcgccatcgatgtgccggctcgcctgcagatcctggagacgttcgccgcgatccgacaggccaagccgtccacggcgctgatcatggtttcgcacgacctgggcgtcgtgcagcatatagcggaccgtattctcgtgctgcacgacggtcatgtggtggaggtcggctccactgcaagcattctgggcgatcccaagtccgaatatacggttcgtcttatcgaagccgcctcgctgtagcggtgccgcggcaagcgccgccacagctgactggtgctacggcacggcgttatagtcgccgccagtgaaatacgaggccaccgcgtcgatcacctgtcgggtcagattgacgcaggcctcgtcgtcacgccatgccacatgcggcgtcaatacgacattgtccaaggagcgcagcgggtcgcccatcggcagcggctcgtggtcgaacacgtcgatggccgcacgcacgtcgcctcgttgaagccggcgggtcaacgcccccggttcaatgatttctgcgcgggcggtattgacgatcatcgaaccggggcgcatccggtcgagctgccgagacgtgatgatgcctgcggtgccgtcgagcagcggcagatgcaggctgatgatatccgactgcgcgaacacctcatccatatcgtcaatgagggtgatgtccaacccatcgatgccgtgcacatggctgttccataccagtgtcttcatgccgaagccattggcgatgcgggcgacggtccggccgatgccgccgaatccgaccagaccgagcttcttgccgtgcagcccgatgccgtcgatgccgccccagtcgccgcggcgcacctgcgcgtcaagccggccgacctgtcgggtgagctccatgatcagggcgaatgcgtgctcggccacggcatggtcgccgtaatgcacgacgttgcacacgcggatgccacgctcgcgcgcgacgggaagattgatatagctggcgacgccggtgccgccgaacgcaaagcacgagacatggccacgaacggtcatcgcgtccaatatgtcatcggtgatgtggaagccgatgacgatgacggcttcggcatccttggtgcgttcgaggatggtgtcggtgtccagcgtgaaatcgcagtgcatgcggatacgggcgatatcgtgcagcagggggaagttggcggcgaacggctcgatcattgattcgacgatcacgggaatcacgatgagcggcagatccgtgcgctccggttgggtttcgatgatgtttcgttcgttcatactgaaacattaggacgcgctgtacccggcatgcggcgacgcggacgcggtgaatgggcggtgaacaatccgcgacacgccgaaatacagtgagtgtagtgctgtgtggagcggtattcgaggtctactctggtatcagaaggccaaaaacaggcttttgcgacacgccgaaggaaccgcgtcattgcaacggttcctagctttcctgcgcccatcggtttgcgttgttcgcccatcccgtgtatgtttatctcttgctgctcagcacggcggacttctcctcctgagaacgaagcttgttgatgtgtggtggtttgagaactcaagagtgtgtttgtactacttttttggttgattttatgccagtccggttcccgcctgcggccggtgacggcaagtccaagaacagtcgcgacggatacggcggccgcgatcaggcgagagcgcatcgccctcgtatgcgatggtttccgattctgcttagtcacgataagcatcccttccatcatttccaaaactcttcatccggcgttcagcagttcgacaaagactcacgattgcgactctcaccgtcgcagcacgcgcaaatcatcgacttccatcggcctgttaactcctgaccgtatccgcacccaaaaatcgacgcaatcccccgaaacattgaaataacgccgaatacatgccccccccccgcagaaaaaccgctttcacagcccttgcggcataaggtcctcgggaatcagtccatcccccccttccctacggggaaaattcttgggaaatataccgagatgcggcttagatcaaggcctgaggcctcttacataacggtataccgctgtatcagcgaagtgtctgctcccgccaaagcacaacaagactgagggaggctctcgtcatgagattacgcagactcttttgcgttcctaagtgcgcgccgtatcgacgagtacgcgaacataagaacgcaaaacgtgcgatttgcgttcttatgttcgcaggctgaacgtttcagcgcgcacttaggaacgcaaaccgctcctgcccgcttcgcaagagccagccagcgggggcagagttatatattgcttctgacagtgggctgaaccatcggctaacgtcatttaccatcatctgccgatggaacagttccgtctcaatagacccgaaactatcgctcgtagaacacgccgaacgaggggaacccatgacgggccggcttcagctcctgcagcgggatctcggtgacgtccactcgttcgacatcggcatagcgcggcccctgcttcagtgccgaaatcagacgggcgaccttgccgcgttccccctgcgcctcgacctccaccgagccgtcgtagcagttgcgcacccaaccgcccaggccgagcttgccggcggtcatcaccgtgaaataccggaatccgacgccctgcaccagacccgccaccacggcatggacacggatatcatcactcgatgacaccggcacggcaccctctgcactctcgtcaggccgcgcgccgcggctcacccgcatatcatcacgtttcatgaccgcactcacctcacgttgccgtcagccgacaccaatacccccatcgtatgcccaccatcaaacggaagtcgagaagccggcagcgcagcgcgggcgctacagcccggcccctttccgccgaggcctgccgcaatccgtcagataaacgcgcgttcgccgaaaatcgccgttccgacgcgcacaatcgtcgcaccctccgcgatggcgagcgccatgtcgtgcgtcatgcccatcgacagttccgtgcagtgctcggtgccgggcgcgcgagaggcgagaatcgtgtcgcgcgtgccgcgcagatgcgcaaagcaggcgcgaatcgtggcctcgtcatcgacgtgcgcgccgatggtcatcaggccttcgagccggatgccgtccagctgtgcgatctgtgcggcgatgtcgacggcagcctgcgggtcgcaacccgatttcgatgcctccccggactcgttgacttccagaagcacgccgaccgtgattccacgggcgacggcacggcgggcgatgcgctgcgccagttcaacgccgtccaccgattcgatggtgttgacgtcggggaggattttaccgatcttgttggcctgcagctggccgatgagatggaacgggatgtgttcggcgtcagacggtcgagtggtgtcgccgtcacctgtgccgagcgcaaatccccggtccgcgcacaggcgacgcagtccctcggccttggccatgacctcctgcgggcggttctcgccaatcatgcggatgcccgcatcgatcgccgccatgatctcgccgacgtcacgggtcttcgtcgccgccagcagcttcaccgaaccgggagcgcgaccggccgccgactcggcttcggcgatggcgtcaagcacgcgatgcacgccatcgcgaatctgcgtcgcccgcgtctcgtcgatgctttcattggtcagatccttgtgatccatgtaagcggtcatcatatgctccctatccgtcttgctgcaccatatattagtatgcccacggatgagggcgaatcggctagagaaaccgggaacttccggtgtggcccccgctggcggggtgtcgagcgatgcgagactgggggggggcgaagcgcgaaacggctccgcacgcagcatatagaggaggaatctcacaatccgatgctgaacgggtcgtcggggatggaacgatcctgcgaatctgcggcgagcgcatcccacgaaaatccatgcaacaggtcggcagcagcgcacggctcgggctcttgctgcaatccgagcagccacgcgcaatagccgatcacctgatgcgccgtgacgccatgtttgcgtaacgttcccatatccagcgaccgttcacgcttggcgagccgccgcccggccgcattgtcgatcagcggaagatgtacaaaacggatatcgcgatgagccgcggcaacgccgccatccgagctatccccgaagccggcgtcgagcagccgctcacggatgtacagctgcagcgcggcggatcgcaacaggtcacgcccgcgaacgatgtcatccacacccatcagcaagtcgtcaaccgtgacaaccagctgataggcgaacagaccatccgcccgtcgcaccaccgtatcacccaaatcgcgcggcaaatcgaatcggcagttcccgaacacgcgatcatgcacggtgaccacggcacgtgcgtcgccggcgacaggcatggcgatgcgcagcgaatgccgatcaccattcgccaagcgttgctcgacctgtcgtggatgctcggcgagcgcgcgccggcatgtgccgggatacatgacgaaacggtcgccctcctgcggcgccgaggccgcacggatgtcggcgcgcgaacagaaacacgggtatatcagcgcagtggtctcggtgccgtcaacgccatcacggccaccgaacgcggcagcgtctcgcaagtcaatgccctgaagcgcgcgcaacgcctgctcgtagatgtcgagccgccgcgactggtataccggctctccatcccagtccagtcccaaccatgccagatcgtccatgatccagcggtccgcgtccggcagcacgcgtggggtgtcgatgtcctcgatgcgcagcagcatgcgccctcgcccgccgtccgcatcgcctggatcggctgcgccactcatgccatccacgcgattcacgttattcaggcaatccgcatcgcccgctccaccgcccgtccggcttgtacgctctggaccacccgcacgagccgacagccacgcgcccagcatcgcatacacgttaccgatatgcattcgtccggacggcgtcggcgcgaatcgtccgatcaccaccgcgcccagagctccgagtcgagcggccattcgttgatcgtgcagccgcgcaacgatatcgattgctgctgcatcagcggcgccggcttgcctgcctgctggcatacggtctcattgtcgcgatggtcgagccggtgaccggtctcatggttgatgaccatcgtgcgataattcgccagattgccgccgcccttcagccagctgtcggtcggctcgcgccagcggtcataattgatgatcacctgattgccgacgcggcagctgtactgcgacgagcaaagcgacgagaacgatttcatatactccgccgcagccaggatatacgtcatgtcgcacttgctggaaccgctctccacgaacgtgagaccggcacggggccacccacgcgaatcattcagcgtcgcgtacaccgtgcgcccgaactcgccggtatcgccgacgctccccttggtggacacgcagtaatggtattcgtggcggggtttgccgctggccgccgcggtctgctgcgccttctcgagaatctcgcgccgctgcgcctgcgagaacggcttcgaggggtcatacccgtttgactgtgcctcggaattagtggatttcgcggtggccgacgatttcgcggaatcgccgcccttctgctcccccgcagaccgcggctgcgctgttgcacctggctgcgcgatggacgaccgctcaccgcccatgcccggcacgcgaagtacgctcgcccgcaccgcaagaacaaacaacacgagcgccaaaatcaaccccgcacatacggcaatgcgccgggcgcggaacacccgacgcatatcgtcaccacgcaaccgctgcaacttcaatcactcccagcaacgtcataggtcaagccgcgccgccccgcgaaagcgcgagcacaagggcacgcttttcgcaggcgtctctccctgcattgtatcccgtcagccgtggggccgcgcaacacgcgtggcgtcacgcgagcccgccgcggctcacgcggttcgcgcaaaaatcacgcgaagaagaacacgtacagccacgcgccgacgatggcgcccacaatcggagcgacgaccggaatccacgcctctccccaacgcgaggtgcccttgttcggaatcggcaggatcgcgtgcagcagacgcggcatcaggtcgcgggccggattcaggccggggccggtcgggccacccatcgaggtcaccaagccccatacgatgaagccaaccacgatcgacgcggccgccaaatccttcgaaccccacggcagcatcaggcagcacagcgcaccgaacaccagcaccagcgtgccaaacatctcgttgaggaagtagttgatcttgtcgttgtcggcgtcggtcgtgcagaacgtgccgaggatcgcttccgcgtcctcggtctccttgtagtgcgggtaatacgtcaggtacacgatgaactgtcccagcagtgcgccgagcagctgcgccacgatgtacggcagcacgtcgctccacgggaacagaccgttgatcgcctgggcgagggtcatggccgggttgatgtgggcgccggacacgccgccgaacatgagcaccgggaacatgacgccgaaaccgtagcccatggcaatgttcagccatccggcgtggtggcccttcgtgttcttgagttcgacgttggcgaccgagccattgccgaagatcatcaggatggcggtgccgaagaactcggcagccagcttggtaaagagggaatattccacggcttcttcttttctctccaccgcatcgcagacatggctgactgctcacggtctctggatgattggatttctctcgtactcccggcgactcaatttcgctgggtgcgaaagcaaacgacgtgattgtacactttaccccttgacgaacggcgatacgggcggattggacggcagaatccccggtgattcacaccctgccctgccatgcacacttgggtgcagtcatgtggaacccattggaattactcgcgacacaccgtacgcgacacgccgatttgcatcgcagcgagttccgagtatagttatcacttggctcaagaaatgaccaacgcccctgtagctcagttggttagagcagctgactcttaatcagcgtgtccagggttcgaatccctgcgggggcacaagcaaggtcggaatcgaaagattctggcctttttttgttttcgtcgagagggtgcgcccgagtcaaatcacccctaattcgccactggaagcatgcccccgcccgggtgatcctcgcaatccgcccctatctgcgtttcaaggggttgattcaggccgcgacgaacatctatctgcgtttcagggggttggtagcaaagtataaacatcacgcaaaccgcatggtttcaatgagcaaatgccctatatactccgtgcatagtgttttggccaccccctgaaacgcagatagatgttcccaggcagtggaatcaacccctcgaaacgaagatagcagcacatacatcgtggaatcacgccgggcaaggccaaaatagacgaagatgccggtcgaatgggacagccgttcgaccggcatcaatgccatgcgttggccctgagccgatcagggccaacgcgactcaggaaatccgcgccttagatgtcgcgacggcggcgaaccgccacagacacggcgcccgtcgcaagcaggccgattgcggcgatggcaacgacggacaccgaggcgtcagtcgcggacaggcccggcttcttgttgccttggtcgtccttatcaccgtccttgtcggtatccttgcccggctccttgtcgggctccttgtcgccaggctcgacgggcgtctcgccggacttctccttgacggtggccacacgggtcacggacgcctcgctaccggccgcatcgctcaccgtgtacaccaacgtgtacgcgccgggcttgctcgtgtccaccgtgtcaccggacaccttcacggcaccggtcacatcaccgtccacatcatcaaccgccttcacacccgccatcggatcaaacgacgcaccgaactccacggccacgtcatccgcaccggaaatcaccggcggcacggtgtcgaccggctcggcctccttcaccgtcaccttgagcgtggcggtaagcgaggtatcggcggcgtacgtcaccgtgatggtcttttcgccggcggtcgacgagtcgaactcggagaccgtgtattcgccctcgccgagctcggcggcgtgccgtcagacatcgtggcggcgacggccatgccgctcaggtcgagcgcgtcgccgatggcgtattcggtcttggtcggctgagtggtcacggcgatcgacgcgacgtcggacacggccgcggagtcctcgacgagcgtgacgttgtcgatgtacgcgaacgagccggaggccagatcggtctgtgagatggcgacccacagcgcggcatacgggtccacgtcgagcggcacgatgaacgacccgctgtagtgaattttgccgccttccttgctttcggcgtccacggtctcgctcagcacggtcttgcggtactggctgaacgagctgacggcgccaagcgacgcgaggttggacttgacctgcaccttgagcgtggacggggtgtcgtcgttgctcttgccgagcgtcgcccacaggccgagacggtacgtcttgcccggcgtctcagacagcgtgtgctggttgatggtgtcgcccttgtacggggtgagctgttcgccgagtttcgccgcgtactcgccggagactacggcatcggtctggtttagttcggacttcgggcgccgagtggcaccaccggcgtcgttgttcttcgtgttgtcggcgttgccgagcgtccacggcgatgccgcggcgcatgtatttttcgtaatcggccgcgttcgcatcagtgttggtgacttcgaagccctgcactgtgatgtattcggagttcttcagcaggatggtctcgctgacgcccgcaccggcgatgatgggcgcggcgccttcgccgtacgctccgatggtgatgggcgcgtccttggtgcctttggtgttgatgacgcgcaggccggtcttgaccgaggcgctgtcgatggtctgggtcgcgctggtgcaggtggcgccggccttgagcagcagggactcaccggctttgagggtgatgccgttcgccgctgtcaacgagttgaacggggctggcttggcttccgtctccgttggcggtcgccgcgcagtcgacataatatgatttggccgggtccggcgtgctttcctccgcctgtgcggcacctatgccgacaatgcaggacgacaacagtgtcgctgccgccaccgcatacgcgaccgttgttcgtttgatcgtgggcatgtacttctgctcctcacgtccccgtatgtgtcgccgtcatggccgggctggagtccgttatgaggcggggagcgcaccgcaatctcgtcattgcgattcgcccgtgttcggccggcgtgtcctctctggcgcgtaaccggtcacgatatggtgcacaatattaacaaaaagatagaccagagtggggcttccgcgtcttgagaacgcccatcctcgcagcaaatcattctcattaagaaaggtgcgagcccgccgcaactccaaatgaacatcaatgtccgcaaatccttggaaaacaacgttgtctcatattgttcacttgtgcgtaaatgttcgcaatcctcgcaccttccttattgagaatcattcgctgcgacttggaacaatacaaaaagcccctcgccgcgcggagcggcggaggggctgatgcttaagctcagacgataatctgtctgatgggccggagctactcggcgacgaccttcacgaagaaggaggcggtgatctccgggtgcagggcggccttagccgggaagtcgccggtggtcttgatcggctcgacctcgatggccttcgggttgaccgcggccttgtcggagagagccagcgcgatctgctcggcggtgacgctaccgaacagcttgccggactcggaaaccttggcagcgatctcgacggtagtgccctcgatggcggccttggcggcgacggcatcctcgcgggtggcgacggccttggctaggcgagcgcgcttcatctgcacgatctgagcttcggcgcccttggtccacgcgaaggcgaggccctgcgggatcaggtagttgcgggcgtagccggagcggacggcgacgacatcgccggagtggcccaggttggcaacggtctgggtgagaataaccttggattcagccatttcctatcctccctaactcagcgaccggtggtggcgtacggcagcagggccatctcgcgggcgttcttgatcgccttggagagctcgcgctgttcctgcacggtcacgccggtgatacggcgggaacgaatcttgccgcgatcggagatgaacttgcgcagcagcgcaacgtccttgtaatcgatctcggtgaccttggcggccttcagcggattcggcttcttcttgaacggcttgaccggcggttgcggcctcttacgtgacatgatgttctccttgaaaattacgattgaatgcttgcttctggattgttacatgcgtcgcgcggcttcatatggccgcggacgggcatcagaactcgggttcctgcgaatcgccaccgaaatcggacgagccaccgaacgaaccgaaggacgagccggcatcgccggacgtgccccacggatcggtcgcgggcgcggcgctctggccggcgttgcccgcagcggacgcgccaccctgatagccaccgctgaagccgccattgccacggccaccctggtagccgccggcgttgccgccgaaaccgccgccattgccacggccggcgaatccgccttggccgttgccgctggacgtgcgcgtgacctgcgcggtcgcgtaacgcagcgacgggccgatctcatcaatcgtcatctcgatgacggtgcggttcgagccgtcctgcgcctgatacgagcgctgctggagacgcccctgcgcgatgacacgcatgcctttggacagcgtgctggcgcaatgctcggcgagatcgcgccaggcggagcagcgcatgaacagcgcattgccgtcctcgaactgcccggtgttgcgattgtaggtacgcgcggtagaggcgatggtgaaactggcgacggaagcgccgtttcccgtggtcctcagttcgggatctgccgtgaggttgcccaccacggtgatgatggtttcgcctgccatgacttaccttcttacctttggttcagcgagtcgcgaacaatcagaaactcatacggcttacttggcgtctttacgaagaatcttcgtgcggacgacggattcgttcaggttgagcacacgatcgagctcggcgctgacctcgggagtggtcgtgtagttgaccaccacgtagttgccttcggtcttgccgtcaatctcgtaagcgagcttgcgacgtccccaaatatcggtgttctcgacggaaccaccttccttggtgacgagctccagatactgctcggtcaacttcttcagaccgcgctcatccagctcaggatcggcaatgaacatcagttcgtacttatgcgcagacatcacccacctccttcggactagtcggccatggactatccatggcaggagtgtgtatacgcgctgctgaaaacagcaacttctctaagctacgccatgcccgcgacagcttgcgggggctgtcgcgaagcgactggggagtaatccgtcctactgcaaatccacgaccgcgcaatccgcggcaccatagccgttcgacttgcaccatgcgtcgccggccttcaccgagtcgaccgtatcacccgacaggatcacgtaatacgcggtcgaagcgtcggccttcgtgtacgtcgggtaatcgccggaccagatcaggatcgcgttcttgtgcttgatgcgctgctgcaggaactgctcgtagatgtccacgtaatgccaggtcttgccgtcggccttcatgtcttttttcttgctggacagctgcgtggtgtaggtggtgtagaagcgggatgcggcggattcgtcatgcttgagctgccagctcaacgcaagctgcgcgtaccgctcggcgtcctcgctgtcgatgtcggagcccgccaacgcgtcgccgtccgcactgcccgcctcgccggggccgctctgaccggtctgcaggatgacctcggcgctgccggtctcgatctggtcgtacgggcgccagtactgcctcgtggtgaattcgagcgcgacgttggccgtctcgccattgaacttgaccggctgcttggagaagtcgaagacggccgaggcgatgacattgccttcatcgtccttgatgctgaccttgacgtcggattccttgaactccgccgtgtcgccgtccttcgtcaacgcgcagttggaggtgagctgcagctgcgcgacgagattggcgtcgctgtggtcgacggaactcagctcggcatcgggcgcagcggtgcagggcttgtcgtctttcgcggccttgctgtcgccgaacttggtcttgccgctctgctgggatgtcgactgcgtctgagccgattgggtgccggaatcacgcagcatgaaccaccagacgccgaatccggcggcaagcgccacgacgagtacggcgatgatgatgccgacgatcagcgcggtcttcttcttgcccttgccggcggactctccaggccgtgacggttgggctggcggctgcacggcctgcggcgggaagacggcaccgggctgggcggcaccgtattgtcccgcgtactgctgaacagcctgataaggctgtgcaggaggcaccggctgggcggtcggcaccggctgcgcgggctgcgggccggcggacagctcggcaccgcactgctggcagaaccgcatgccgggttccgactgctgaccgcacaccgggcacacggaacccgcctgcacggctacgggcgccccgcagttctcgcagaatctatcgccctcaacgacattcgcaccacaacgggaacaccgcataatctctcctcatgactatcctgcgctcaacgttacactgcatgacagcattcccctgcaaatatactgcgatacggaccccaaatgacgtccgcaaccatttgaccgagatgtctttttagatatgtaatttgaagactgacgaaatttcgaagaggagattatcatgtcggcaaccaaaggttccagataacattgttggctgttttgctgactctcgccgcatcgttcgtatcgatgtcacccaagcaggcttctggctttgactccacatatgaagtcgtcactgatgcagacggcagcaaaatcatcatggccaagcccggctctgtagcagccatagaaccatcgaccggcaaacttctaaacgtgattcctccttcatccatgaatgtcaacgccatcaccgtaacaaggggatgcacaaacaagaacgctggatgctggacaagcggtagcgcacttggggatatgcaattcgccggaaatggagctgtgtccggcacttggccgtatagaaatgcgtactacaccgggaacctgcatggtcttgtgatctatcaatacaaaggtgcgaccatgagttcgccgaaaccaggaccgcatttgtggatacgcatggcaacaatagtgctgtcacggggaagagtgtcacccgttggtaaaaagacattctcatacgttgagataatgcatatcggagtaagaggagtaagaatggggcatattccggcatcccgtcgtacggtgacgatggccatcgccgtcatcgccgtcattacgctttccattgcgatgctgtgcggatgcggcacggcacggaacacgaaccaagcaacggattccggctcgggcgggaaacgtctcgcctcatctttgcaggcttatgcgacgcagctgctcggccaggactccggaatgggccccgcgcagaaagcgacactgcgcaaggccgcgacaagcggcaaaataagtctgtccgattacaaggccgcatggagccgatacatcacgtgcgtccaagacaagggctatccgaggccgacactgaaaacttactccaacggcatccagcagccgcagggagacgtacttccttcagataaagccgatgaccttgactacatccaaaaaaaggccaaggacttgaacgcgtgtggaatcgccaccgtggattcggtggacgcgttgtatatggcacaagtcggcaatcccaatctgtatgcgtctcatgaggagggggcagtcgattgccttaagcgcgccgggctggtgccgaaatcctacaccatcaaacaatacgagaaggaggcgaacgcaatgggtcacgccgctcccggagagaccgtcaacacgacgtatgacatgaagaaaccggaagtgctggcatgcctcgccgccaacggcaacgtattcatggacagatgacgccacaggcacagagaatgcactggcatgttttcgcccctatcggatatcggattacctgcccgatgggggcgaaaacataccttatatgccccgcccaaataccgcgaataagctgctgaagatgacgtggcgactatacaataaggagggaagagcaaaccaagaaaggggcttgttatgatatgtcctcactgcggcgccacgctgtccagcgccgcacgattctgcacgcaatgcgggcagacgctcgcggtcgccgcagcaaacagcaacgacaacgtcgaagattcgaccgtgctcggcaccgctccacacggcaccgcagccgcgcctcagccggaagcacccgctcccgtcgccgcattccccgaacccgtaccggctccgcaggccgcggcaccgcagcccgagccggcacccgcattccccggcgcggaacagcccgcagccgagccggccttcccggcggttcccgaaccagtccccgcacaagaagctcctgcagctcccgtcccggcggcagaagtgccagtcgccgctccggccggagaagttcccgccgccgcacctgttgcggctgcagcacctgctcccggcacttttgctgcgcccgcgcctggtgctcccgtccccggcgcacctgtccccgttacccccggcgcacccggcgccccggttcagcccggcgctccgcagcagttcgtccccaacccgatgttcaaggagctgttctccgcgcgttcgctacagaccgccgcaatcagccttgccttcggcttgatcggcgcgatggcgctggccctgatcggttccatcttcttcttgtcggccggctcatcatgggcgtccaagctgagcatggtccccggcctgtcccacatgatgagtgacgccagcggttccggcacggtgacgccgaacttcttccagttcctgattctggtgatggttctgggcgtatccggtcaactgtcgcccaacatcaccggaggcaacctctccatgtcgtccttcggcgtgtccggccatctatggatgcctgtcggtctttccggcgtggcgctggttctcggcaccgcgttcggcgcatactggttcgcgcgtaagttcgccatccggttcaagtggaccggcatcgtcagcagcgtcatcgtcggcgtcgtgatgggattcgtctatctgattctcgccgcgatcttcccgctgacgctgggagccggcagcatgggcggcattcaggccaaggccatcctgaccggcgtctccgcccgtacgtatttcatgacgctgctgctcgccgcgatcggcgcgttcttcggctatctgctcgcccagtacgcctcggattccaacaacgtgttcaccgcggcctggaagtgggctcaccgcacgcgcggcttcgtgcgcacgctgcttgatgcggcgttcatctacgcggtcgtgttcacggtgatcggcttcatttgcctgatcatgctgtccagcaacctgcacaacggccagatgttcatgctgttcccgattctgctgccgtacctttcgttcctgacgttcgcgctcggctcgttcggcgcggtcggcatcacggccagcggtaatatcgctaacctgtcgctgttcggcatctcgaaccagtacgtcggctccatcagcgcaccgtggcagctgtggctggtattcgtggcgttccttatcaccacgttctacattgcgttgcgcgccgcggcacgcaacatctatgatccggcatatgcgggatggcagcactcgtggaagtctccggtcgccacgctggtgatctggctgatcgtcacgttcctgttcacgtccgcgacgctgggttacaccatgcagtccgatacctatgacgcgtcgctgaacatcgcggcatggtacttcctcgtcgcggccgtatggtcgttcctgatcgaggtggtggcgctgacattcggcccggccatggtgctgtcgatgggcggcgcatggaagctgttcgtcggcggcacggtccgcccgacgcccgccgaggtcaccgcgtatgcggcggcatgcggagcgcactttggtcgcttcccatcacaggtcgccgcggccgccggctacacaggcccgcagcagtccttcggcggacagcctggcgccggcaccggagcgccgaccgcacccgcagctggcatcccggttcagggcgttcccgttcagggcgttcccgttcagggcgttccggttcccggtgctccggttcagggggttcccgctgccggcaccgacgccgcggcctttcaggcccaaggtggtgccccgactgtccaagttcctgccggcgctcctgccgctcctgcagctgcacctgtcgcccccgctccggtggctgctcccgccgccccggctgcagccaaggccatgaccccgcagcagaagaagctggccatcatcatcagcgccatcgtcggcgtgcttgccctgctcggtatcgcttacgcagtggtcaactccaccgtgttcagcgccgataacaccgcgaagagctacctgtcggccatcgcgtccggcgactatgacaaggccaacggcatctccgacccgcaggtcgccaacggcaagcgcacactgctcaccaatgcggcttccaagggcgacaagaccacgatcagcaaccagcgcatcatctccgccaccgacaacgcggacggctcccgcacgatgcggatctcgtacacgctgggcggcaagtccatgaccgacattctgacggtcgcgccgaacggatccaagttcctgatcttcaagaactggaacatcacgacgccgctggtcaaggagatctccgtctacgcgtcaccggccatcaccaacttcaccgtcaacggtgtcaaggtcggcgcgaagaacgccacagcatccgattccggcacctacaccttcaaggtgtatccgggctcgtacacggtggaaccggtcacgtcgaagtatctgaccgcggattcgacgacgctgaccacctcctccgaatcctccgcctcgatctctgccgagccgaccgacgctctggcagacgagatcaacgcgaagatcaaggacaagctggatacctgcgccaagtccacggatgcacagcctgaaggctgcccgttcagcatgtacggttccgatgacgactaccgcaacatcgcgtggaacatcaccgaatacccgaccgtcaccactgatgacctcagcatcgactcgggcagcttctacgtgtacggcggcgaagccaaggtggcgtacgagtacaagaactatgacgactcctgggagccgacggacagttccaccagcttcagcatcagcggacagttcacgctggacggcgacaagctggacatcacgctggacgacgactgatcggaatgatttcgcccggcacggggcacctgctgcgcgcaccgtgccgtaagtggaagaatccgtgagcatcgcaacccgccgttcctcttgggacggcgggttcttgtatattggataaggtttgtgtacggcaacgtatcaccacggtgaacggtaacgaaactatcgacggaaagagcggaaaaacatgtcggcgatccttgagggcacacccgataagcgactggccttggtgacgggccgcgcatatcctgagcttgccaatgaagtggctcaatatctcggcatcaacgtgctgcccaccaccgcatacgacttcgccaacggtgagatgtatgtgcggttcgcggagccggttcgaggcgccgacgtgtttgtgctgcagtgccacaccaacccgatcaacaagtgggtgatggagcaactgctgatgatcgacgccctcaagcgcgcctccgccaagtccatcaccgtcgtggcaccgttcctcggctactcccgtcaggacaagaaacatcagggccgcgagccgatcaccgcccgcctgatgttcgacctgttccgcaccgcgggagcgaatcgtctggtcaccgtcgacctgcatgccgcgcaggagcagggcttcttcgatggcccggtcgaccatttgaccgccatgcccgtgctgatcgactacgtgcgcagccacgtgcctatggacaaggcgacgatcgtctcccccgacgccggccgcatcaaggtttccgagcagtgggccgctaagctgggcgggctcccgctcgcgttcatccacaagactcgcgacatcacgcgcccgaaccatgccgaagcgcatggcatcatcggcgacgtgcaggggcgcgactgcgtggtggtggacgacatgatcgacaccgccggcacaatctgcgaggccgtgcgcacactgcgcaactccggcgccgcctcggtgactctggtcgccacgcatggtctgctgtctggcccggccgtggagcgcctgcgcgattgcggcgcccgcgaaatcatcctgatggacactgtgccagtgccgcaggagaagcgcctggataacatgaccgtgctgtcggtggcgccgctgctggccgccggcatccgctccgtcttcgaggaaggctccgtggcgacactgctggagggcctgccggaggacatgcgcccgagaaacatctacgcctgaaatataaaacaaagggctacatatctgcccccactggcgggggcaaaatgacgcggtcctggccatccataacggattgaacacaaaatagggaggccgccacagggcgacctccctatttctatttacttatatcactcggcgcgcttgcgggcgatgaacaccgcgccagcggcggcgaccagcatcatgccggccatgccgatgacggcgacgttcgcacccgtcttggagatggcgttgccgttggcatcggccttctccagtgcggcgatcgcgtcggcgagggccttctgcgcggcgtcgatgtcagcctgggtggcgttgtcatcggcgaggacgctctgggccttggcgagggcgtcacgcacggcctgggcggacttcttcgtgtaaccgctcagatccagggccttggcctgatcgatggtggcctgcaacttgctcttgtcggtcgtctccgggttcggagtcggcttggaggaggcgggcttcagggccttcatcgcggcgttcagcgcgttgtacgcggcatcgacgtcagccttggtggcgttcgcattgttcaggacggccttggcggcatccagagccttcttgaacgcggcccacgaatccttggtgtacgcggattccttgagcttctcggcatcggcgaccaggccggcgagcttggaggtgtccacgcgctcttccagggcggcgatggcatccttcaggttctggtaggcgagagccacgtcgtacgcggtggcgttctcgtcgtccagcaccttcttggcggcgtcgcgcttggcgacgagcaccttccaggtgtcggcggtgtaggtggcctcggtcagggcggaagcgtcatcgtacaggttctgcagatcgcacttgttgaccttgacctcggggctcggcacgtcgcgaaccgtggtgacacgcagctcggcagcggaggcgtacgtgttcacctcgcccgcggactgtcccgcggtttcgagagcggtgatgcgcaccttggtgacgttcttgaccgcgtcgaacttgaccttctgccagacaccgctggtcgtggtgaacgtgccattggtgacgacgtccttggtggtgccgtcggacagcgtcagcgtaatcttgtacttcttgatcttgccgttcgcgttcgcgccgccactgcgggccatgtaacgcagaccgtcgatggtcgtcggctcgttcaggttgaactgataccaggcggtaccggcggacactgcgttggcgctccaggaggtgtgccagtgagtgccggcattgccgtcctgggcgaggcttgccgggccctcattgccgcccgacagtgcctgctggctgcccgcctcgacggtgtaggcgtcggtcgccacgtcgtacgcatcgttcgagtcgtcgcccggtgcgttcttcatgtactcggccagcgccacagccttgttgtaggcggtggtgtagtcgggcttatccttggcgatgagcgcctcgatctcggccaccgtgttcacgtacgtggtccagacttcggcggagtagtcgccgctcttgccgtcgtaggtgtccttgacttccttgagcttcgcctcggcgtcggccttggtgtgctcggcggatgccacgtgctcgaccttcaggtcatcgaggacgaagtccttgtagccaccgaagttggcggcggaatcggacgtgttctgcaggtcgggagcggtggaggtcgagtagatgccgaaccagctgtcgccggtgatggaaccggtgatctcgaactcggccgtgccgtcctcgcccagggccttcttcaggttggtgagcttgacggtgctggcgttgtactcgccgtcaccggtggcgatggcgtagatgtcgtcggagccggactggtacttgaacgacaccttgtaggtctcgcccggttccagcttgacgttctgcgggatcgtctggtagatcagcgtgcccttctggatcaggccgttggccttgacggaccacttgccgtcgagcacgtcgtccatcttcttgacatcccagccggcctgcgtgaacgggtcatgcagctcggacaggtggatacggttgtcctcgacgccttcggagccggagaccacgaacggccagatgccctgggcattgtcctcgaagtcgttggtgagcgtcttcagggtgccgtcagcgttgagcgtcaggcccttgtaaccgttctcaagcacgcgcacgtcatcgaagtacacatggtcggtgttgtcgcatgcgccggagtgcgagagcgtcaccttgacgtcgccgctttccggagccacgaaccacacgtacatgttctggaagtagctgctgccgccttcagtgttcgagtacgtgttgtggccgtacgccttgatgtagttcttggcgatcgacttgccggtctcgttggtggcgaggaccttggtgccgttggtcacggtgatcttggccggggagttggtgcggttgtccacgcccacgtagatcgcgtaacgcttgcccgcggtcaggtcggtgagcttctgggagaccttcacgtcaccggtcaggcgcagcatggcgttgttggtgccttcgacctcggccttgccggtgccggagacggcccagttgtccttgagggtgttctggccgccgttgaagccggcgtccacgacgtgcatgccttcgctccacttgacggagatctgcttctcggagcccttggtcacgacgtacggggtctcggcctcggcggtcagcgagatcttgccgccggagacggcgacggtcttctcgttggtcttgccctggtcggtgagctggtacaccttgacggaggcgaggttctgccaatccttcggcagggtccactcggtggtgccgccctgggtattccagtggtacagcttctcatcggaggacttgacgagcttgccggtgttcacgtcccacagccacggcagcaggtaggactcagtgcccttgacggtgttgctgttgcccggggagaccgcgccggacgccacggtgatgccgttgagcgtgatggtgcggttgcggtacgcggtgttgttggtgtcgttggagccacgggacaggacgacgacgttgccgtggtcgtccttcagcgtgatctgctcgttgccgttgttgacggaggcatccttcacggaggtggcgtcgagcgggctgttgacccagcggacgaccttgaagtgctggatgaacttggtggacacgtcgtgcgtgtacaggttcctgatgtacgcggcgtagtcgttgcgtccctgccagccttcgaagtccttcatgctgtagccgccgagcagcggggcgttcgcggcctggccgtacgacgggtagtcgccgacccagctgtccttctggtggttgcgcaggaagcgcatgacctgagaattctcgcccttcatggcggaaccaccgtaggtaaggtcggcggcccagtgctggaaggttgcgtcatactcgttgccggcgccccattcggtggtcatacgccagccgttctggttgatcatttggctcatcttgcgggtttcccacgagtcctcggcgccggaggtgttgttgccccacacgtcgaggtagatgaagtccatgttgtcgccgaccttgctcttgaggtcagcgaagcgggacttgcgcatgccggaggcgagatcgtagatgccgtcgatgccgatgccctgatccagccagttccagccgtagctcaggccgccactggagttgcgacgcaccatgtcctcgctgaaggccttggcttccgggtacatttcggacgcgttgacgtgcacgccgaagcgggcgccgtacttggtgcccttctccatcagggtgttcatgtccgcggcgccgccggcgcgggtgttgatgtcgccgtagtccggatggccggagtcgtggccttcgttgccgtagcccttgagcagcacggactggccgaggccgtcggtgttgagggcgaccttcttgacgttgtcaagcgtggtcaggaacgggttctgcgcctgggagccgaagttcatggcgatgcgccatgcgaccagctcgggcacttcctcggacttgtatgggttgttcatgatgtcgcggtatgcgatcgcgccatcttcccagttgaccgtgccgtcctcgttctcgtcgccggcgatggcgacggccatcttcggcatgtcggtctcttcgacggtgtaggtgttcttcttcgtgtcggtcacgacgcggtggtagtaccacggtgcagtgcccagaccgaaggaggtggccttgccgaccttctgggtggaggtgagcacgcgggtgttcctcgcaccgccggcgacggtgttgccgacggtggtgccgtcgtgctcggagttggaccacaggccggcgctcaggccattgcccgagacgaagccgtaggtgtagtcgttcgcattgctgaccgtggtgtcggcggtgatgtcgaagttggtgtcaccgggcctggcagtgtcggacgacatgcgggcgccggtgaactgggcgccgtcctgaccggagcgcacggagatgaggctctggttcgggaacgcaatcgtctggaccgggttctcctcggcctcggtcttggcgtcatccgccttgttcacgatcttggtgacgttgagcttgagcgtattgtcgacgaccttgatctgcacggtgacgaccgcgttgatcttgtcgccgctcttgacgttcagcgtgtactgggcctcggtcgcgctgaccttcttgaaggtcacgtcggagtccttcagcgtcacgtcggtgccgttaatggtgatgacgcgcacgtccttcggctggccgtacatgatcttgccgtcgagcttcttcatcgtgtagtcgtacacggacgggaagttcttcttcacgcgcacgtccatggcggcggtggagagcgtctcagtagcgacttcggccgacttgttcagcgtgatgttgccgactgaggcattgccatcggcgacggtgacggtcttggtggcgtcatcgtagccttcggcggacacggtcagcgtgtagtcgccggcggcgaggccggtgagggtgaaggtgccgtccgccgcggtggtggcggagttcttgccggtgacgacttcggcgccggcgatggcggcgccgctggcgtcgacgaccttgccggtcacgttgtgcttggcgacttcacccacggtgaagtttttgaagtagacatcagtgacttcgctggtgccggagtaagagccggccttcatggcgagcttgtcggtcagcgcggtcatcgaggagtaatccacatcgaacgccttctgtccgtcaatagtcagcgtggcaaccttggcggcagtccaggagacgttgacggtgatttcagcgttcgcggcaggggcagcgacacgtgtgccgctgtaccaatcgccattgccgccgacatacttctgccagaaccagccctccttgtcatagcccaggaacagggcgttgcccggatccttgtagccgaggtagaagccgaaacggttcgcggaaccagcctgcggggacttgaccttgatggagaactctccagcccgagtcaggtcaatcgtcttgccgctaatggcgacagccggatagccactgctgctggtggcattgccgttggcggaggtggacttgaaatgagtccatcctgcataatcgccagtgccggctgcaagaatttcgccgcctttggcggtgttgcggtcaatcgtccagccgttcacggcagcatcgtccgcgacggtggcgacatcgttggcgttcgcgtcattggagctagccgctgaacggagcgcgagagtctgcaaatcacttgcagaaagcggcgcggcggacgctgtgctgcccacccccagtggggcgacagcgagtgcaaccgcaagggccactgaaaccactcgttttctcatatttccttaccttcatcatggagcactaaggcttaaccttgagcggatacgcatgacggaagcccgacacgcgcgtctcagttttctatgataacactcttaacaaaatacaagaacgtgtgttgttaacattattaatttccaaggaaaatagaaattttcgccatataccaatgggtatgcgtgaaaaaacctgtgcaaatcccctcaaagaacagtgatttttccccgtcgcggcaacactgtctcgcggaagttttccgctatttgttaacttaccttacttattggagcgctggaagagccaactggccgatgcgatgctcactggaggtgatttgcgttcatatgttcgcgccgaaacgacgatcctgcgcacttacggacgcaaatgggtctgtttgcgtccgtaagtgcgcgcacttgtcgtttcggcgcgcacttacggacgctaatgccccccagtcgcttcgcgacgggggcacgcactatataaaaagactatttgctattcggaacgaacgactcgaagatgtggcggtcgaaatactggtcgcattcggctagttcgtctgcactgcgaaccgtccacgacaccggtatcgcgcccatccagcgtgcggcccgcagctgcggagaggggccgccatgccagtcgaacgccacgaagtccgggcgggagatccaatcgaacgccaacagcccggccagccactccttggccccggcaccggtgagcgacgccggctctgccaactggccgcggcacacctccggacggtgctccttgtaccagttgaccgcgcccggatggaacgactcgatcacatacgggccgtcatacgcctgcagcagttggtcgcccttctccatcagctcgtccgcccgctcgccccacgcggcgttgtcggtgaacttgtactccacgatcaccggtacacgtcccgcgatcacgcgcagcacgtcgacgaacagcggcacgtgctggtagtagccctgcggagcgaactgtgcggcggccaccgggtcggcgacgggcgccgcctcggcatcccccggcttcgcgggcgcggggaacagcgggatgcgcgacagctcctcatacgtcaggtcggcgatcttgcgcggatctccggccacgcgcaacaggttatcgtcatgcacgaccaccacgcggccgtccttggtgagctgcacgtccaattcgatgccgaatccggcctcacaggcggcggcgaacgcagccagcgaattctccggggcgatcgagccgctgaagtcagcggtcccgtatcccgcgcgcaatgcgcagcgacgcgccagcgccacatactcgccgctgtgcgccgcatactccggcgtcagtcccgatcccgcgtcatgcaggccacgatgcgcataccatacgtccggaaccgacggcacgaaatgacgctgcttgtcgctgaacgaacgcggcttgatggcccagaccgcggcgcccgcggctacggctccggcaagcaccagcttgccgccaacatgttttcccatagtgtttctcctaaccgtgccgtcggtttctatcgcagcacgccgtcgatcagcttggtgatcaggtcggtatagccgatgccggtcgcctcccatgccttcggatacatggagatcggcgtgaaaccgggcatcgtgttgatctcattgaccatcacctcgccgtccggcgtcacgaacgtgtccacgcggctcaggccggcgccatccaccgccttgaacgccttgaccgcggtctcgcgcacctgctgcagagtctcctgaggcagattcgccggcacctccacatggctcgccgacgaatccatgtacttgctgtcgaagtcgtagaactggtcgtcgccgctgttgcgcttgtcgagcacgatctcgcccggccagctggcctgcggctcgctgccggccttcgggcacagcaccgcgcactcgatctcacgcgcgtcgatgccctgctcgatcaggattcgccaatcatgatggctcgcctcgaacacggcggcggccagctcggcggcgtcaccggcatgctccaccttggtcacgccgaagctcgatccggcgcgggacggcttgacgaacagcgggtacgccagtccggcctcctcgacccgagcgagcagaccatcggcatcagcggcgaaccgtgacgccgcgtcgaagccgcgcgcgtccacggtgatgccgggagcgaccggaatgccggcggcggccagcagcaccttcgtgtaatgcttgtccatgcacgcggcggacgcgagcacgccgcaaccgacgtacggcacatccatcatctccagcagaccctgaatcgtgccgtcctcgccatacgggccgtgcagaaccggcagcaccgcgtccacgtgccccagcgagctcagcgtgccgtcgtcattgcgggcgaagaagccatcctgcccgagcgccacgtccagcacgacgtcgcgcgagccgggagtcttctcgacgaccggcagaccgtcggccatatcccatccgcgcgggtcctcgccgtccacgatccactggccctgcttggtgatgcccaccggcaccggctcgaaccggtcggtgtcaagcgcgcgcagcacgccggcagtcgaaatgcaggaaatcgaatgctcgtcggccttgccgccatacatcaccacaacgcgaatcttggccgtttcagccatgtcttcctcccatgccatgttttgcacatactgggtcatagcctaatacgtgcgatggcgcaccgccccgtaacaattcgcctcttgcaaaacccgccaaactcagcagggtgggcaccggtgagattagctttgccgatggcgcgaaccaccccgtctcgctgcggggcatatgctaacgcctccgctggcgggggctgccgagcgcagcgagactgggggggggttaatgcagcctactcctcggtgatctcggtgccgagtagttcggagagcatctgctggcaggatatgccttcgttcagcacgcggctcatcgcgtaggcgagcggagtcggcacgtcgagctcgtcgccgagcgcgaccacggcgtcggtggtcggcacgccctcggcgacgccgttgctcaccttcgtggcctcctcgacgctcaggcccttgcccagattcgcgccgaacgtgtaattgcggctcaggggcgagccgcaggtggcggtcagatcgcccacgccggcgagaccggcgaacgtcttcggatcggcacctgcggccttgccgagcgcggtcagctccgccagtccacgcgtctcgatcatcgcggcggtgttctcgccgtatccggctccacgggccatgccgactgcgagcgcgacgacgttcttcaacgacccgcacatctccagtccgatcacgtcggaagtgatgaacgccttgaagtaactggtcgtgcaggcggacgccaccttgcgcgcattgtccagattctcgcaggcgacgaccgtggcggccggctgacggtcggcgatctctttgctcaggttcggtccggaaaccgcggcgaaacgctcagccggcaggtcgagggcctcgcggaccacttcatccatgcgcttcttggtgttccgctcgatgcccttcatcaggctgacgacgacggcggtatcgggaatcaggtccttgaactcggcgagcgccacgcgcgcgaactgggcggcgatggcgacgacgatgatatcggcgtccttgacggcctgcgcccggtcgcccgtggcggtcatgttgtcgggcagcttggcgacggacggcagacgaacggcattgtggtgccggtcgcggatgccctccacgatttcgggctcgatggcccacatcgtcacgtcattgcccgcgtctgccatcacctgaccaaaagtggtgccccatgcgccggcacccaatacagtacatttcataacccactaccctactccagccccggatacgagacctccatgcgcacgtcgcgcaggtatgaacgcgcccgcgcggcgtggcgctgcgcgggcgtctcggatgtccgtcgtgttcgggaatcagtcggtaacgcggctcatcgtacggtaatcccagtagccggagggagcacgctcgccgcggatctccgccatgacctgcgtcatgcgcacacgtacccggcgggtcagctcgtcggcgagctccacgggaggctcatcgccccacgactcgctgtcgaccagcagatcagcgtaatccagctgcgcgtcggcccatgttctcctcatcggccacgggaccgcccaacgacgaatacccgccattcttatagaaagaatcacgcaggttgtacagaacaatacggctttctttcattccatgagaccagatatcgccattttggaagcgttgatatttccaatcattcgacaactttttctcatcttcgatcggatatcccaagacgccgtgctcataattgcgacgagcccattccttgcgtattgttccagtcgtatagtgcgcgcctgttgacggagtccaggaaatcgcaccattctcaaaattctgatagcagttcaccctgccctgagtccaatcgcaaacttcattcgcaattggtttaccaataacgcttttctctgcgccaatagagcgccactcaactcccatgtctcccttaacctcataggaagttgcgttgttactattgttcttatctacatactccttgttcccaaacgcattcatatccacattgcccctgatgccgcccactttgccggagctggtgtattgccatccgcgactgttggtcgggaacgagtcgaatcccatgcgagcgccgtactgcgccacccacgtggttttggcgtaaatgtcggcatgtttcagcgggccttgcaggtagctggtgtacgagtagacgcctaggttcttgtatccggcggactgcagcgcgccgtaccaattgttgacgatatcgttgtacacgttcggatcggtgggcggctgatgccccttccacgtccacttttccaggtcgtagtacacggggtacgccaagtcgctcgcgcgcacaccgaatcgcttgagtttggcgaccacgccggcaccttcttctttggcaatcgacggagtgtccgcgtaggaataccagtagatgccgaacgggatgccaaatcgtttgcattcggaaatgttacgttgtgctttcttgtcggcattgttgccccaaccgtagccgaggcggatgatcacgccttccacgccgtcggctttcgctttggcccagtcgatgtcgccttgccattcggaaacgtcgatcacgcctttggcttgctgcacgaacaggttgttctggtagtcgaagaaggctttcgtattgttgtaagtgccccagtgcgcgccgtattcattgctttcgaatttggagagctgtacgttcgcgtcggctacagcatttttgacatcttccgcactcaccggaatgaaggattcgccattggttttggcgagtggatccggctgctgatcctgcgtgccgaccagtgtcgcatcggtcacggtttcgccggtttcaatattcttgacctcaccttcgggggtaacggccaggtcttccgaaaccacggtggcatcgtcggaaatctcgtcactgacggtgcctggaagtttcgcgttcggattgtcgggcatactgtcttgcgattgctggtcgcccgtctgatcgtcagactgatcgtcagactgcacaacaacgccattatctgcagtaacgggaccgctctgcgcgacagcatcctcaatcgcgatatcctgcaatgcgtaagccggcgtaaccgcaacggaagccgtcaacgcaaccgcagacagcgcagtcgcaatcttcaaaagatgatgtggcgaaaccattcgtcagcctctctcgaataaagtcatcaaacccaaataattcggcgcgaacgccctaatcgccaactctaaccgcaccctgctacccacctggctggcgggatactcctacacgatgtatctggtgcattcgccgctgtccaaggtgctgatcggtccgcggattcccgcgcccacggacggatggtcgtacgcgggcatcagcgtgctgatgttcgccgccacgctgctcgcggcgttggcgttcgcggtggtcgccgacaccgtggtgctcaagcccttgcaacggctgctgcgcaacgttgacctgccgcggaaaggccgcctgtagaggcggtcgcttcactgcccctgcgcgcggtagcgggcctcggtggcttccttggccggcgcccaccagtcgcggtgttccgcataccagtcgatgacgttgcgcaatccgctagcgaagtcggtgtgcatcggcgaccagcccagttcggcgcgcagtttggatgcgtcgatcgcgtatcgtctgtcgtgcccgggcctgtcgtgcacccagtcgaacgcatcttccggctggcccatcagctgcaggatcatgcgcagcacggcgatgttgctcatctcgccgtccgctccgatcagatacgtttcgccgatgcgcccgcgggtgaggatcgcccacactgcgcgggagtggtcttccgtatgtatccagtcgcgcacgttctcgccggtgccgtacagtttcggccgcgcgccctccatgatggaggtgatctgccgtggaatgaacttttccacatgctggtacgggccgtagttgttggagcagttggagatggtggcgcgcagaccgtatgtgcgcacccatgcgcgcaccagatggtcggacgacgccttcgaggcgctgtacgggcttgagggacagtacggcgtgtcttccgtgaaacgcgccggatcgtccagcgccagatcgccgtatacctcgtcagtgctgatgtggtggaagcgcacgtcgtgttgccgggcggcctccaacagccgcatcgtgccttccacgttcgtgcggatgaacggttcgggattggcgatggaattgtcgttgtgcgattccgcggcgaagtggacgatggcgtcgtgaccgggcacgatacgctccaatagcgcgacgtcgcagatgtcccctacgacaagatcgacctgcgacggcggcaggccggcgatgttctccggattgccggcgtacgtcagcttgtcgagcacggtgatgtgcgcgtgtggatggttccgcgccacgtatcgcacgaagttcgcgccaatgaagccgcatccgccggtcactagaatattacgcggctcgaatacgccgctgcacgccatgctgttcaccattccagcataccgtcgcatgccaacggctgcggcgttcgggtccgggcgcggacgctatcttgcacggattcaccggtaatgagtccaaggagagggctttggccccagcttcctccctcgccggcgggcagcacgcacatcgacaatccgctctcatgagcccgcaccgccgtcatcaggactgcggcagcagaatctccgtggtggaggcgccgtcctcggagttgcgactcaggtagccgcccgcagcctcgatgatctggtcgatgtggaccaacccgaaaccgtgcccctcgtcggatttgatggtgcggaagcgcccaccgaccttgcgctgcttgccgcccgaggaagcgttggtgaacgagatgtacagctgcgtgtccttcatgtccatatacacgcgaatcatgcgatcggcttcaggtaacccgtcgttggcctcgatcgcgttgtcgaacaggttgccgaggacgcagcacaaatcgagttccgaaatgcgctgcttgatcggaatatgggtatgggcgtccacgcgcacgtcgatgccaggcgcctgcgcaagcgacatcttgctgctcagaatcgcgtcagccatcgcattgccggacttgatcggggtatccaacgccttcatcgtctgaaggtgattacggtagtcatgccgccacatgcgcatctgacggtacatgttctcgacctcgcggtaatgcgtgtcgaccagctcgcgctgatatgccgcgatagccctgtcggccttgcctcgcccacgaaaccacatcgcccctcctctgcattctgccccgtccagccggggactgctttccagcaccctgccggccgtgagacggccatgcgtaatcatatctggtctatgattgcccgattcaacggctcgtacgccccacgaggcagtggcagcgtcgtcccgtcggttcaattgcacggacgacctgtctacgcagcggattcgccgcaggttcacgatcatcgcgcgtcccacccggcagaatccgtcgccgagctcggcctcgaactcgcccagcgggcgtttctccgtataatcccggtcggcgtgcaccgtcacataattacggcgcacgtcaagatagcggatgtcggccagcggaatacgcatcagcccttccgcgcattgcagatcaaggcacctggaatcgcggcgcatgcgcgcgaccgccttgtcgagcacgtcgaacagcttggccgcatccaccggtttcatcaggtaattgagcgcttcaacgtcgtatccttcggcgatgtaatccgaatacccagtgacgaacacgatctgcatcgtgccgcccgccttgcgcacggccttcgccaacgccacgccgtccatcgagcccatttcgacgtccagcagcagaatatcgacgtcacgccgccgcccatagcgcgtcagaaaccgctctgccgacgggaatacgtctatctggctccagctgccgagcggccgcccatgatgcggtcagcgagcgcacgtactgggcgtcgacatcgctgtcatcgcatatcgcaacggaatcgtcatcatgacatacgaaatcgcgtcaatgcggccctaccaccgggccagcagcgacgaaatccgaaaatcatgccttcttgggcttgagcgcggccggcatgggcatgggaatcggtttgcgcggcatcggcttgggcttcggagcctgagattcaggtgccttcacgaccggcatttcgccactggtcgccttcgccgcagcctcggcagcccacttggcgtactcgtcaaggtcatcctcagcgacggatccctgcgtattgtccacggcggcgttcgcatcatgagaatacgaagcctcgatatcggcaaacggatcgggcgacccctcgcccggctcctgcgtgctcagctccttggcgagctcatcgtaatcggtatcggtggtcaggtacttgagcttccgggctattttctgctgttttgctttctgacgtccgcggcccatgtgaccccctggcatgtaaatgtaactatcaattcatcacataagagagtaccacttgttatgagagaaatggttgtctgcttggacttttacgataaaagcgatattttcggcgttttgaagcaagcaaagggcgacttatgacggaccaagaacagcagcaactgaccgcagcgggcaacgaaatgagcgccagcttcctggccgcgaagaagcgttcggacgccacgctcgccaaacttgaggccgagccgggcaagttcacgatgctcaccggtgaccgcccgaccggccgcctgcacctcggccactacttcggctccatcaaggagcgcgtggccatgcagaaccgcggcgtgaacaccaacatcatcatcgccgactaccaggtcatcaccgaccgcgacaccactgagcacatccaggacaacgtgctgaacctcgtgctcgactacatggccgccggcatcgacccgaccaagaccatgatgttcacccactccgccgtgccggccgagaaccagctgctgctgccgttcctctccctcgtcaccgaggccgagctgcaccgcaaccccaccgtgaagtccgagatggaggcctccggccacgcgctgaccggcttgctgctcacctaccccgtgcatcaggcgtgcgacatcctcttctgcaaggccaatgtcgtgccgatcggcaaggacaacctgccgcacgtggagatcacccgcaccatcgcccgccgcttcaacgagcgctacgccaagaagaacccggtgttccccgagcccgccgcgatcctttccgacgcaccggagataccgggcctcgacggtcgcaagatgagcaagtcgtacggcaactccatcatgctgggcgccaccgccgcggagaccgccaagctcatcaagaagagcccgaccgattccgagcgcaagatcaccttcgaccccatcgcccgcccgcaggtgtccgcgctgctgaccaccgccggactggtgaccggccgcgacccgaaggacattgccgccgaaatcggcgatgcgggcgccggcgcgctcaaggcgtacgtgattgagtccgtgaacgagttcctcgccccgcatcgcgagcgccgcgcagagctcgccaaggacatggactccatccgcgacatcctgcacgatggcaacgcccgcgccaacgccatcgccgaggagacccttgaccaggtgcgcgaggccatgggcatgaagtactgattttccggcagtcgaacgcaacgattgcatcaggcccccttcgtcactccgccccgaggcacgcgacgaaggggccttcccataacggtgtcgcccttcgggacagaaagccgtctgcacgcccctgccccgacccgtcgaactcgccgagataaggctatctgcgtttcgaggggttgatttggaccgcgccgaatatctatctacgtttcgaggggttggtgccaaagtataaacgcacctcaaaccgcatgaccccaatggcatttcaccggcaatactccgggtatcgcgtttcggcaaccccctgaaacgcagatagatgcccagaggacgcccaatcaaccccttgagacacagatagcgtcacagaagacgccatccggtcaaggcgcagccagctacagccctccgcttctctctccaacgcaatcgcatcagcgcaatcgtgcgattccgcacccctgccttcgatcacgcgataccgtcaaggtcatccgcgtcaggaaaatcggcattggcgttcgggactcgcggcagcaatggttcaaaccctatccgctcgtacagtggcttgcgtctcatcgctctggcatcgcacacctgttggatggtcttccgcgcagtgacgggcacgggaattccagtgacctcctggatcttatccgcgatccgtctggctaaagcttcctcactccattcatcaccgaggtcaagcttggtgacttggatataccgccacttctcgtcttcgattgcctgccgccggcgtgcatcttccagccattgaccggcgtgatgccctccgtcgaactcaatgcagatcttgtattccgggtaagcgaggtcaagatatacggcccggttcagacgcttcactccaatcttgtaattgacgcagggcgcgtctatcccgtatttgaggggaacgagtcgggtgcgcgtttccatcgacgaatccgtcccctcctgaatcacacgcaacgcacgccggcaattggcatatccgcgaaacatattcggccggcggcccgtctcttcaaagaccgcttccgtgaattcccgcgccgaatccagatatgccgtcagctcctcaatggtcgtcctgcgcagacgcccatcccggcgcatcattgactccgccagtacgatcagctcttcaagattcagccatccggcgaacatcgcccatgtgcaggccggagacacgcacaagcattgctcgaccatgacgacatcaacagggaaggaccatgtcacttcgtttatgccgacgagattgcgcctttcattggcactcgggacgacaactgtaataccgttcaacatggcgcgtccttttggcaggcgcggtatttcaatcgcctgaagctccagggccgtggtcaaggcgtatggcggctgccacctgctgcgctgctggaattcagcgcactgcttcatacgctggtgcttcaactccgtcaattgcaccagtgcgattgatccgcccatggtcggccgctcctttgtgactcgaatattgccgtggagccgagtgtagggaaccgggcagttccccgtctaccgcgcctcaaaaaatgtggacaaatgtggataaatgtgcgcaacgcggtggataactcacctcggctcggcggagaccgcgcatgaggaaatcgccggccgccttctttcgcacgactgtacacaccggcgggttctgttcacagaagacttgcatgtacactggaaagacgatttgaacgtgacgccgaaggtgacgccacacaattaggggggtacggtgaaggggattggtgtaactggccaagcaaccgaggcgcgaacggatatgtacgatgtttctgccacatgcgcccatgaccttctgatctgatgcaggatggcaggtacaggcaattatgacgataatcaccaacgcgcggttcccgggcagcgcccgccgcgtagacatcgcgatcaagggcggcgcgattgcggcaatcacgcccgccggctcccggatctcggcgacggcaaccggcggcgcggcgactgggcctgaccgtgagggagtccagtcttgtgggcgagctcgaatggttcgacgcctactgcaagctcgacaatgcgcccggagcggcggaggagacgctcgaactgattcgcaaggccgaggcggatgccacccgcaaaggcgtggtcggcatccgcgactatgagatggcggaaaacgtcgacacgtggacccgccggttctccgcggcgtctccccgcccgcgcgacgctaacgattccgcttggacaggcatcgattgggatggctcattcacccacggcatccgaggattgcgcgtggaggcgggcgtgtatcccgaacggctggaggatgcgattgaagccggctggaagacgggcgtcgagctgcccggcagcgatggactgggccatgtcggcgcgatgaagatgatctcggacggctcgctgaacacccgttcggcgttctgctcgatgccgtattccgatatattccccgacttttacggcacgctcagttacgcacccgaccagatcgagacgtatttccacggggcgacatgccataggttcgccatcgcgtgccatgccatcggcgatgaggcgaacaccatcgtgctcaacgcggcggcgagcacacacgcccacggttccatcgagcacgcccagatgctgaagccggcggatattccccgattcgcgaagctcgggctgaccgccagcatccagccacagcacgccatggacgatcgcgatgtcatcacgcggttctgggcgaatccgggtggaaccccttacgcattcaaggcactgcacgatgccggcgtcaggctgcgcatggggtcggatgcgccggttgcgccgctcgacccgtggatggcgatatcggccgctgtgttcggcacggaaagctcagaccgcgaaccgttccagccggagcaatgcctggatgcgcgcaccgcgctggcggcttccacagccgtcggccgcgaccgccctgagcccggagatccagccgacctggtgctcttggaccgcgacccgtatgctgtctccacgccggaggagatgcgggcgatgccggtggcggcgaccatgctcgcaggccgttggacgtactcctctttgcacggcgaatgattcccgacaaggaacgcatgaggattcctcacacgaatcccatcgggaaccgtccgccgcgcaggcaaggcgtcagacgtcataccgccatgacttatcggtgatcacgcgggccatcgccaaacctatcggcaggcagataatcaccatgaacgctcggaacgcccagtccagcgcgtgcagcgtatcgaactgtccgaggtagaacatcgcccggtacatatacagaccgggcaccatgatgacgatggacggcacagtcaggcatatgcgcggatagcccagatgcggcggcagcaggccgttgtgcacggcggtgcgccatccggcagcgagcagaccggccagcagcgcgccgatgaacgccccggcctcggccggcaccccgaaatcgaccagcgtcagtcgcagcgtgtcggtgatcatgccgatggtggcggcgaccaggcacatgcgctgcggcgaattgaacatgatcgagaagccccacacgccgaggaaggcggtgacggcccgcagccccgtgttcacccacggattgagccccagcggctcgaacccggtcgggttcagatgcacgatcatggccactccccagcctgccagcgtggccattaggatgatgcacagcacgtatgccactcgttggatgccggatgggaagtcgatcttcgccatatcgaggccgcccgttatcagcgggaagccagggatgacgaacagcatcgcgccgatgtacgcggtgtcatgcgtcagcgcgatcgggtcgagcaggccgatcaggcgcagagtgcccgtgcaggcgagcgcagccagggccacgcacacgaacgtcacgaagaactggttgagatggcgggcgaacagtttgcggcgcagccagtggcccagtccggcgccgacgaacgcgccgatcatgtcgtaggggccgccgccgagcaggaacacgaaggatgcgcaggcgactgcggaggcgaagccggcgaacgccggggaatagagcggcttacggctctcgatcaggtcgagccgctcatgcgcctgccgcacggtgatgggcttgcgcccttcgcccgcggaacggcccacgtggtcgaaatgctcggcgtactcgccggtcagcggcttgtgagcgcgggttttccggcgtttcgcgcccagcagcgcctccgccgacatcgatgtcccgaattcgttcaggttctggtcttccgcactgctggcgcttgcgcccgcgcccgcgcctgcaccacccgccgccgcggcggccgcgtcgagatccggcgtctccacgaaatcatgctttccggagcgctgctgcatcaaccggtcatgcagcagcttggcctcgcgatcctcttccagggcggcctcggattcggagcgcagctcgtcgtccgtcgaaccttccgcggtgatgtcggccgcggccgcgcggaccatggagacgggcacggtgacctcggccgcctccatggcgtcgagcaccgggtcgtcggaggcctcgccgctgagctccttctgtgccttcttctcggcgcgcagtttcttggccagctgcgcggagacctcggacatgtcgctttgctcaaggttctgcaccacaccttcggacacgtcgcccgcgcgatggtacatggaatcgagcccgaggttcacgctgaaccagtcggtgtaatgctccagcagccagatgcgctcggtgttgacgccggtggtgggcaggtcgatgacctcggtgatgcggttggcgtcatcggtgcaggtggcctcgatgtccgtcaggttcacgtcggcgcgcacgtgcacgcccagggggtacgcgatgcggtgcatcatctcgcgcacgcggaagcttccggttccagcacccaggtccagtgcgccgacgcgcacgacgacgctggtcttggcggcgaggccggcctcggagatcggcttgtcccagtcgcgtcgaatgtcttccatgtcaaggggaacggagtgggtgtggaaatgactcaccgccgtcgccgcgtcctgatggggcgcgtcgccgttcatgtgctgctgcatgttcttctctatccgtatcatgccgttgtttttgccgccctatgggtgtgctcgggcgtgttttcaagatggttacagtagtcattcttactccgcgccgtgaactcatggggtatgaccgaaaccggcgttcgcatgatggactaccttcgacaagattatggacgatacgtcgacgaggatattcaggacgacattctcgggccatccgacagcgtgaagatatggtgaagattacatatttaccagtaatccttcagagaaaaattggacttcgtaatacaacttgcgatttcagggcaatagaatgggcacacagcttttggcgcaaccggctgtgggctcgcaactgacggccaacacaaccgcggaggagccgcggaggaccgactgaccgagcaaccggacccaaaagacaaaggaggttatgaatgaccgataccgatcaacagatcacgcccgccgacgcgaccatcgtgtcgaccggcaccgggaccaagggccccgaagagcgggagctgcctgagtcgctcagcaacgacatgagcctgtgcctgcgcattctgcgcgacgtactgggcgaatatgacccgcagctgctggcgacgttcgacaccgtgcgcaactacgcggtgaaggcaagcgccgagcatttcgccggagcgacggcggatccgcaccccgatgaggatggtctggcaaaggccgtcgccaccatcgatgcgatgaatctgcacgacgcccagctgctcgcccgcgcattcgccacatatttccacctcgccaacctgagtgaggagaactaccgcgtttccgtgctgcaccagcgcgagaaccaggtggaagacgacgaagccgttgacccggtgaacgaactgaccaccgcctaccatcagctgctgaccgaaatggggccggccaaagccaaggcgttgctggagaagctcgaattccacccggtgttcacggcgcatccgaccgaagcgcgccgcaaggcagtcgaaggcaagatccgccgcatcgcggagctgctggaagagaacaagcgcctcggcggctccgacaagaaggagaacgtccgccgcctctacaacgagatcgacgcgctgttccgcacgtccccgatcgcgctgaagaagccgacgccggtcgaggaggccgataccatcctcgacatcttcgacaacacgctgttcaccacgattcccaaggtctaccaccgtttcaacgactggctgctgggcgacaaggccggtctcgaacagccgcagtgcccggcgttcttccatccgggaagctggatcggctccgaccgcgacggcaacccgaacgtcaccgccaaggtcagccgtcaggtcgcccgcaagttcagcgaccatgtgatcggcgcccttgaggaggccacccgcacggtcggccgcaacctgaccatggagtccgagacgaccccggccagcgccgagctgaagagcctgtggagccaccagaaggagatgagcgagcgcctgaccgacaaggccgcactgatctccaccaaggagctgcaccgcgccgtcatgctggtgatggccgatcgcctgcgctacaccatcgagcgcgacgccgacctcatgtaccacagctgcgacgatttcatcgccgacctgcaggtcgtgcagcgttccctggccgaagccggcgccaagcgttcggcgtatggcccgctgcaggatctgatctggcaggcgcagaccttcggcttccacatggtcgagatggagttccgtcagcactccgtggtgcacgcccgcgcgctggaggacatccgcgagcacggcctgcacggcgagcgtggcgaactgcagccgatgacgcacgaggtgctcgacaccttccgcgccctcggtgccatccagaagcgcaacggcatcaaggccgcccgccgctacatcatctcgttcacgaagagcgcccagaacgtgcgcgacgtgtacgagctgaaccgtctggcgttttcgcacccggaggatgtgccggtcatcgacgtcatcccgctgttcgagcagcttgaggacttgcagaactgcgtgaacgtgctggaagagatcgtcaagattcccgaggtgcaggctcgtctgaaggccaccggcaacaagatggaggtcatgctcggctactcggattcgtccaaggacgccggcccgaccaccgctacgctggcgctgcattccgccgaatcgcgcatcgtcgcttgggccgcgaagcatgacatcgacctgacgctgttccacggccgtggtggcgccgtcggtcgaggcggtggccccgccaaccgcgcggtgctcgcccagccgaagggctccgtcaactgccgcttcaaactcaccgagcagggcgaggtcattttcgcccgctacggcaacccggtgctggccatccgccatctggaatccgtcgccgccgcgacgctgctgcagtccgctccgagcgtcgagaagacgaacacggagatgaccgagaagtacgcccagatgaccgaggttctggacaacgcctcgcatgagcgcttcctcgacctgctgaacacgccggacttcgccccgtggttctcgatcgtcacgccgcttaccgaggtcggcctgctgccaatcggctcccgcccggccaagcgtggtttgggcgcgaagtcgctcgacgacctgcgcacgattccgtgggtgttctcctgggctcaggcgcgcatcaacctcgccgcatggtatggccttggttcggcctgcgagaagttcggcgaccttgacacgctgcgcgaggcgtacgaggagtggccgctgttctccacgttcatcgacaacatcgagatgtcgctggccaagaccgatgagcgcatcgccaagatgtacttggcgctcggcgatgacgagaacctgtcgaagaaggtgctcgacgagatgaagctcaccaccaagtgggtgctcaagatcgtcaacgacgaatggccgctgcagcaccgtcacgtgctcggtcaggccatccgcatccgctccccttacgtggacgcgctgtccgtcactcaggtgcttgcgttgcgttcgctgcgcaagaaggtggacaaggaagagctcagcaagagccagcaggcgggattcatctatctgatcctgtgcaccgtctccggtgtcgccgccggcctgcagaacacgggctgacgttttggccggtgttgggccgcatgcgcggccaacaccgcttggaaagcccaccgggctttccaaggccaaaacgtagcggtgggctttgcgcaatagctttgcgcacgcaaagttcaccgcagcacggagcctccgcgacgagcggaggctccgttttatatcagcacatatcgcgaaagccctgccctacacgggtggggctttcgcgccccccctatcaatcacattgatacgatttcataatcatttccgatgtgaataagttcacggatcaagaccgcgatcatcggcaatcccaccagcgaagtggcgttatagtagcgctgtcggcgtcgacaagagctggaacgctgatagaatgcacaccaacgatgttcagtgaattgttcgcatgttcacgaacagtcctgcatgatgtgccttgagtgagcgatgcggctcttgttcaggccggcaggtcatcgtacagccagttacgaaaggatcctaccgaatggcaaggtttaccgagaatcgttggaccagcgcaatcatccccgcattgctgattcatatcccaatcggtaccgtctactgttggagcgtgttcaagcagctcatcgccgacaggctcaacgccagcccggcctccgtggaatggggcttctcgctcgccatcttcttcctcggcatgtcagccgcattcgccggccccatggtggagaagaacatcaagaaatccgcactcgtctccatggtctgcttcgtggtcggcttcgccggcacgggcgtgagcatcgctctgaacttcctgccgggtgtgttcatctgctacggcgcgatcatgggcatcggcctgggcgtcggctacctgaccccggtcaagaacctgatgctctggttctccgataacaagggcctcgccaccggcatcgccgtcgccggcttcggcctggccaaggccatcgccagcccgttgatggagtacctgatcggcacggtggggctggtcaacatgttcttcatcctcgccgtgatttatgcggtgatgatgttcttcggtttcctgctcatcaagcgtccggccgactgggtctacgatcccgtgacctcgcatgtaagccgcgcggagattctcaggaagcccgtgttttggggcatctggatcgccttctacatcaatatcacctgcggcctggcgcttatcagccaggagaaggacatcctgcacgatgtgctcaaggccttcccgcagtatgccggcctgagccccgccaagttcgccgccgccatcgccggcatcatcggcctggtgctcgccgtggactccgtgttcaacacggccggccgcgtgggcttctccacgctctccgaccacctgaagcgccgcgagaccgtttatcaggtgatcttcatcatgtcgatcgcggtatgcctgctgcagatcttcaccaacagcatcaacaatgcgctgttgtgggccgtgctggccatgctgttcctcatcaacgctggctacggcggcggtttctcgacgctgccggtgctgctcgaccagcacttcggcaccaagaccgtctccaccacgcacggtctcgcgctgagcgcctgggcgttcgccggcctgtccggcaaccagctggcctcgttcgtggtcacgcacacgcccgatcaggcccatcgctacgccgcgctgattccggtgctcaccggcctgttcgccctggctctgatcagcatcagcctggtcaagtatctcggtggcaggaacggcgagggcaagagatccatcggggcctgaaccgtaacgcaaggcggagggcttcagatactgaaagtaaatcacttcctgaatcgccccggacagtattcgtccaagaacgaggtaactgcccacatccgcgacaatagactctcatagttgactgattcgggggcctgcgcctagcgggcccccttattgatgccgtgtggcgcgtcgaaagcaccatgtccgccggccacggtcaacgaagttctaacatgtcaacggggtattctaacatgtaagaattattgaaaggggatgaaaggacagcgccagtcaccttacaccaacgcgtagcgggatgagggaccactcccctcatgccggaatacgccctccccctcaagtctcttcatgagcctgtacgcgctgatataagacaaatccagcagcttcatcacgtcagacgtggtcgccgcgcccccattgttcagcgcgaattccgtcaccaggttctcccgccgaccgtcgaggcccttttgcctcgcataagccggcaacttatcatccctcttatatacacgcgcgctcagcatataatctcgtgcgacaccgctgccgcaggcttccaccagcccgctctccactaggctttcgaccgcgccgaccaatcgccgagactccactcgcgagaattcgcgcatttgcgccacgctgagtctgcgatgctcccgcagcaacgacagcacgattagagaccacaccgacaacggagcgccacggcgagcctcttcattggcaatcatcacaacgaatgcctcatccggcaccacgcgacgcaggaacagcaccacctccgacgccgtggactgcgaataatcgggaaatgccccgccggaagccaaggagccggcatatatcttatcgacaccacgaccggtgcgttccgcatatcccgccgtcttgaggatggaggcgagctgagggttgcgggaacgcggctgcgcggtcaacaggttgttttcgctcaatccctcgatgaaacctcccgggttggatatggtcaggccatcgtcgtccacgaggaaccgcaccgatcccatcctcgcataatccctgtggcagaacgcgttgactgccgcctcgcggaacgcctgatgatcgaagtccggcagattgacatggaccagaccgctcatgacctcatgatctggattccatggttccatcagtgcgccgatacgagggagcatatcgatcagcggcaggaagaacggatccgtgtttaccttgggagacgtgcctttcatgacctggaatacggcggaggccgacggtacggaacgcttcagtgcccgctccgtaccgatgaccagcagaccggccacggaaggctgcgggccgccagggccgtcgactaccagttctagggcccgatcgaagtcctcatcatcaaacgccaacaatgagctgccggcattggccgtgcgtatgctctccctgagacggtcgcgcgcagacggatcaagatcggacagcgtcgaccccggagcaggctgcgcgctgtagtcgtaactacgctgctgcgacaaacgactgatgaattgcgcagggaacatcggaacgacttctggcgcgccatcggctttcagccggcgctgcagcgtcttcccctgactggtggacacgatctgctgactgctgtcaacctcaatgccgacgaccggtttgccgctctcgctcagcaacgtcacccgcacggaaagctgaggaaccgttttgttgaaaatgaatgccgccagaccattgacattgcgatgccggtcacagaccccagtcaccatgccatcgtcttcgacaccaaggtacagcgtaccgccttcggtattggccatcgccaccacattgtcgacgatttcgtcatcggtttgcgggcgttggcgttcgcttttgaactccaccgtcaggctttccttggtcggcagcatcggctcttcctttcacggctttcaataattctaacatgttaacggagaattctaacatgtaagaattattgaaaggggatgaaaggacagcgccagtcacagcgcccactatgcgccgagcaatgtcaacatctgcgggacactcttcttgccgaattcgaccttctgctcgccgccgggatggttgatgacgatgcagggaacgctcatcgcgccatactggtccttgagctcggggaagtgcgcgacgtcgtaggcttcggcacgcacgttcgggttcagcgacgcgatgcgctgcgcggccagtacggtttccggacacatcgtgcaggtgagcgagacgaggatcatcacgtcgatcggcgtgtcaatggcctcggcgcgagccttgaggtcatcgtccagaggctggcccggacccgcggcgttgtacaggccgagcacgaacgaattgaactcgtgaccggacggtacaccgtggaaggccaagccggtgaacagcaacgtaccggcgtcggaattctcggccggcacgcacatgcgcacgaccggccgcgcagacggcagcacccctgatacgtcgaactgcgcgcgaccggaatcatccagcgaaccatataccggcagttcggcgccatccggcaaggtgacggccaacggctcgccgaccgtcaacgacgttggcgcgctggaaccgtcctcagcggtgatcacgcccgccgcatcgaccgcgaccgaattcagtttgccgttcgacagcgccaccatctcgccgatgaatccctgcaactccgtcgacaatggcgtatcgtccagttcgaggacgagcgtgaccgggcgggtcatacggccaaagaccacgccgagctgctgcttgatggcggcggagaagagctcgccgggctttttggcggcggccgacgcggcggcggtatcggcgctgcgcttggcaggagccggggcgggcgtggtgccggcagcggcagcactgttggcggcagccgcggtctgcgcttcggcctgctcatatgcggatgcggtcgggcgaggcggcacaagaccggttttctcgctcatctgcttggcgtaccgctccagttccactgcggcgatggcaccgtcggcggtggcggtgacgacctgacgcaggttcttgacgcgcaggtcaccggccgcgtacacgcccggcaccgaggtctcgaggtatccgcgcgtgaccacgtagccgtggtcgtccagttcgacgacaccgcgcacgagctcggtggccggcacgtatccggcgaacacgaagacaccaaacgtgccgtcgtcggatggcttccacgattccgtctcaccagttcggcggtcgaggatcgtcgcctcgcgcagcccgccctggccggcggtgacgcctttgagctcgacgttgtagcgcacgtcgattttcgggttgttcttggcttcggcagccaccgccgcgtcgcaggtgaagtccggttcgcggacgagcaccgtgactttggaggcgtatttggtcaggaacacggattcctctgccgcggcgaaaccgccgccgacgaccagcacctccctgccggtgaagaattcgccgtcgcatgtggcgcagtaggccacgccgcggccagcgtactcgccctcgccggcgaaaccaagcttgcgtgggctggctccggtggcaatcaggatgccgaacgttttcaggtcaccgcgcgacgtgtgcacggtcttgatgtcaccgttcacgtcaaggccggtagcctcggctgagaggaattccgcgccgaaatccttggcctggttgcgcatggtctgcgtgagcgcacgaccggacgtatggccgacgcccgggtagttgacgacttcgtcggtgatggtgatctgcccgccgaaatcatccttttcgagaatcagcacgcgatagcgggcgcgagcgagatacaggccggcggtgagtcccgcagggccgccaccgatgacaacaacgtcatacagatcgcttcggttgatctgggtcatgatatggaactccttacatatgcatatgcccctgccggcggggctcccgcgaagcgggtggggtagttcgcctatcaccgcgaccacccccagtcggctgtcgccgccagccccccccccgccagcgggggcggagaggccactcgccttacatcgctacccgccagcgggggcgagagagttggcgatccccagccaactctgaccgctaccgacagccctccagcccctgcaatcagggacggcctccagccgcagcctgttgtgcttgcctgtcggctcgccttcgcctacaaacagctctgctgtttgcttgacaactcagcccgtcagtgaggcgggaaatcagaggagaccgacgaggtcgaggctcggctcgatggtctcctcgccgggggtccacttggctgggcacacctggtcgccgtgctcgtagacgaactgcgaggcctgcacgcggcgcagcagctcgtcggcgttacggccgacgttggaggagatgacctcgtaggccacgaccttgccctccgggttcacgatgaagtcaccgcgctcggccacgccgtcggcctcgttgtaggtgtcgaggtccttcgcgagcagtgcggtggggtcggcaagcatcgggtactggatcttcgcgatcttttcgttggcgtcgtgccaagccttgtgcacgaagtgggtgtcgcaggagaccgagtagatctcgcagccgatcttcttgaagtcctcgtacttggcagcgagatcctccagctcggtcgggcacacgaacgtgaagtccgccgggtagaagaagaacaccgaccagtgaccgagcacgtccgccttggtcacctcatggaattcgttgttctgaaaagcctgcaccgtaaaatcagtgagttcatgctgaagcagtgtcatcatcgttcctttccacgcaatccggtcattgcgtctccccatcgtaacgtcaagcggctttcgccgatacggacgcacgagggtttcttcatgacaatcatcacagtttgcgctcacaaaccggtaaaaacagccgcgcccgatccgtggtttcgctatgagcagaggtgatgaacgttccttggatatttcatacttatcaaacaggtttccgctatgctcgcacatacaggcacatacacgccgacccgacgcgaacctgagactcggaacggagatgtcatggcagaggaagacccggatcaggaatccaccgcgaactcgacgcttagccgcatgctggcgggaaaccggcggttcgccgaagggcacagcgagcacccgtggcaggacatgcagacccgcgaatcactgatcgaccggcagaaccccgacgcggcggtattgtcatgctccgattcgcgcgttccgccggaaatcatcttcgacgcggggctcggtgacctgttcacgatccgcacggccgggcagatcatcgacgacgcggtattggcatcgctggaatatgccgtggatcatctgcacgtcagcctgctcatggtcatgggtcatgaaggctgcggggcggtggcgctgggcgccgaacaacttgacgcgctgatcgccgacagcacgagcgacccggagagctcgttggagtccgctgatgcgatggccgaattggatgagcgcatcgccagctcggattcgattgtgctgcgctcggtcggcatgtcggtatggcaggcgcgggaggccgagttggatacgagcgaggacttcgaacgcgtacatgtggcgcgtaccatcgaagagctggtcacgcgcagcgaaatcattcaggacgcgctggcgcatgatcgactgatgatcgtaggcgcccgctaccagctgtccaccggcaaggtcgaggtactgagcttctgatgggagcgtgacttatcgccgcatttcgcgtcactgtgtgcgggtagcgtcacgctgtgcggccccgcacacagtgacgcatcagtaaaacccttattttccaatggttatacaatatgcgtcacgctgcaagggcgcacacagtgacgcaccccgcacagcgtgacgcattcgagacgccgcatccgcaacggcaacgcgccgcccgtttcgacgtggcgcgtcccgcaggcgtctccaccgccgtcgtcagctacgtgctcaacggcagtcccaagaaaatctcaccggacaccgcgcagcgggtgttcgacgcggcgcagtggctcgactaccaccccaactccgtcgcccgagccctcaagaccggcaccacgcacacgctcggcatcatcgtgcccgacttctcgaacccatacttcgccgaattcaccgaccagctcgaagccgctgcatccaaacgcgaacgggcgctgatcatcaacctgtcgcgaggcgacccgcaaggcgagcgccgccgcatcaacgaactcgtcgagcgcaacgtcgacgcgatgttcgtctcctccgcgcagaccgatgccgagctcgcccgctgcgcggtcaacgcggcgctcgaccccgcgcacacgcccgacgtgcagctcatcgccaccgaactcgtcaccaggcagtcctgcggatgcaagtgaccggccggcaagtcgcagcgaacggttctcaataagaaaggtgcgaggatttctcacatttgcgcacaagcgcacaaaaccataaagggcggcatctcgggactttgtcgattttgatgttcgtttcgggcgtgggcaggctcgcacctttcttactgagaatgattcgctgcgacaattgacgtgccacccccctacagtagagtccatgtcacttggtttaaacatccttctgatcttcatattcctagtgctcggatccatcttctccggcaccgaattggccttggtctccctgcgcggatcccagatcgatcaaatggaacaggaggacgcccgtggcgcacgtgtggcggcaatcgcacgcgaccccaacaagttcctgtccaccgtgcagatcggcgtgacgctctccggcttcctgtccgcatcgttcggcgaatcgtcgatttcgccgttcatcgtgcccgtcgtgaaaagctggggcgtgccggcgaacatcgccgcaccgctgaccaccatcgtgctgacgctgatcatctcgtactgctcgatagtcatctccgaaatggtgccgaagcgcatcgccatgcagcgcaccgaacagatcgcccgcgccgtagtgcccgcgatcgacgtgttcgccaaggtctgcaagccgatcatctggctcatcggcaagaacacgaacggtatcgtgcgcctgctcggcttcgacccgaacgagaccgaaagcgaggtctccgatgaggagctgcgcgtgctcgtcaacacgaacacgtcgctgagcaaagacgagcgcacgatcctcgacgacgtgttcgacgcgtccgagaccatcgtcgccgaggtcatgcgtccgcgcgccgatgtcgtgttcctcgacggttcgcagagcatcaaggacgcggcggcgtacgtgcgcgagatgccgtactcccgctatccggtgaccggcagggatttcgatgacgtgatcggcttcgtgcatgtgcgcgacctgctggacgtgcgcgaccccaacgcaacgaccgtggccgacgtgacgcgagaaggcatttcgctgcccggcacgtccaagctgctgccgagcctcgaactactgcgcaagcgcgggatccacttggccgtggtcatcgacgagtacggcggcaccgacggcatcgtgacgctggaggacatgaccgaagagctcgtcggcgacatccgcgacgaatacgacctgcccagcgaaccgggcggcgagcgcaaggagcagcccgcattcgtgagcggcgtcgccaccatcgacgcgagcatgaccatcgaggacttcgccgatctgaccggcatcgaactggaggacggcccgtacgagaccgtcgccggctatttcctcgcacacaccggcaagatgggtgccgagggcgatgtgctgcactccgacgacgggtacgacatgaccgtcaccaaggtcgacggccgccgtatcgaaaccatcgaggtgcgcaaggccggcgcccctgaccacgcgccggtttccgccgaatagcgcggcgcgggcgggaggtcgccggccattgccgatcatcggcgctgcgaggaaatccaccagttgatgatcgaaccggctgcgaccagcagagcgccgcaccagaacggcaacgtcaaagacaaccccagcaataccgcgctggctgccgtggacagcacgggcgtggcgtaagaggccatcgcaagcgtgctcatgctgccgtgcaagattccatagccccagcaggcgtatccgccagcgatgaccgccgcggccgccaccacagccaagtagccccaaaccgacggcgcggcagacggccaaccttggccggaagcgaagtggatgatccacagcgccacggccacaaaggggaagaatacggacgtaccgtcgaatcccttggacagcgcgggcgtgaacaccgcatacaccgaccatgcgagcgcgcccgcaaatgccagcagatacggcagtggattcgccgcgacatgccctgcggcgagcgcccagtccaagccgctgttgccgccgaccgccagtatcacgccggcggtggcgacgacagcgccaggcaatacgcggagcaccgcgcggccacgagaatggcggggcggcttgcctgcgctgcagtttgtgccgcactggaccgagtcatcttgagggctggctgagccccgtgcaataccgcaaacaccttggactggccgtctaaccgtccaaaaaaacatccgcaccccctagtgcccgaaaggttgcgcactttggatcatgcccgtccatggcgcgatgaccggttcgcttcctgcaggttgtcatcgagccgggacatgtcgaggtaacgccggttggaccattcgttcgcggtgacgtacctgatgcgcgcgcagacgagcatcagcgcgctgttcccgtccgggaagcctcccacgacgcgcgtgcgccgcctgatctcgcggttgggccggttcgatcatgtcgttcgtgcggatgcgcctgcggtgcccgtccgggagctccggcagcaggtaggtcgtggtctcgtcgatcccctcccgcaggcggttcgcggcggccttcagcctcctggactccatctccgcggcgacggtcccggccttgtccaacgcggattcccgggactccatggcgaataccgctttcagggccgcgcacgcccattcgcggtgggtcggcggcatcttggagagcgcgtcgcgcatgaaatgcaccatgcaccgcaggtatctcgcttttggaggcatggagttgacggtggaggccagtcccgcgcaccggtcgccggccacgagccgcacgcccttcaggccgcgttcgaccatgccgcgaaaggactgctcccggctggcggaatcctccctcatgccctcggcgacgccgatgacctcgcggtgatcatccttgctgacgccgatggcggccaggatgctgacgttctccgcgcttccgccccaggagcgcttgtgccacacgccgtccacgaacacgtatgggtactcgtcatccaacggcctcgtgcgccattcgtcgatctcggcgtacacgcgcttgagcttgtcgctcaatgtccgggacggcatgcggtcgccccacggcaactggccggtgtcgtcggcctgcctggtgggcacgccggccgggtacatgccgatcagcgcctcccctacgctttccccgcgtctgcggcagcgtccgatcaccgcggactcgaacagggcgcccttcaatttcggcaccttgagctcgagcctgccggccttggcggccaggctccgctcgtagtggccggcccggtacgcctgccgaccgccggaacgctcgtatctcgcggcgttggcgatctcgtccgcctgaagcgtcgggcatcgcgttgacgatccgctcgaccttctcgcgcaccatggcgtcgagcttgctctcgaacatggcccggtcgaactgtatgatttccttggacatggccccgtgcctctttccaatcgcggtttttcattgtccggcgactgaaaatcgcacccggcacggcccatgtccctttccatcaagaccggaatccgaaaatgcgcaagaactcggacgttatcggagcttttccggataattgcaattatccttattgtttctcatcatttagttgttcattgtccctttgatttgtgtgcagaacctttttgtctgaaacgtctctttttccagttcctctacagggcgtcaggaaagattggaatcgctttattccttcttatcaccgtttggttccttgggtagtgcgcaacctttcgggcactacctgcgaaagagtttgtatagggttgctgtggatcggttgtggacgaagctcttcgatagagtatggccgaaaaacttctagtgacggatattgtgaacgtctttgctgttctttagctgaaggcagtgttccttcgttcagaattcgaaatctggctaatgaagtgttcagcgtgcttttgactaagagagaaagtactattacacatgtgactgaagaactttttactcctaagaacatcatcgtgaccggtggctgtggcttcatcggatcgaatttcgtgcattacgtggtcgaccagcacccggacgtgcatgtgaccgtgttggacgctttgacctacgcgggcaacatcgcgaacatcgcgggcctgccggaggaccgcgtcgagttcgtgcacggcaacatctgcgacgcggagctgctcgacaggatcgtgccgggccacgacgcgatcgtgcattatgcggccgagtcgcacaacgacaacagcatcgcgaaccccgagccgttcctcaagacgaacgtggagggcacgttccgcctgctcgaggccgtgcgcaaatacggcatccgctaccaccacgtgagcacggacgaggtgtacggcgacctcgccctggacgatccggccaagttcacggagtccaccccgtaccatccgtccagcccgtactcgagcacgaaggccgcgtccgacatgctggtgcgcgcgtggacccgcacctacggtttgaggaccacgatctccaactgctccaacaactacggcccgtaccagcacgtggagaagttcatcccgcgccagatcaccaacatcctcgagggcatccgcccgaagctgtacggcaagggcgagaacgtgcgcgactggatccacaccgaggaccactccagcggcgtgtggaccatcctgacccggggtcgtatcggcgagacctacctgatcggcgccaacggcgagaagaacaacatcaccgtgctgcgcatgatcctgaagatgatgggacagccggaagacgcgttcgactgggtcaaggaccgtccgggccacgaccgccgttacgccatcgactccaccaaactgcagaccgagctcggctggaagcccacgcacaccgacttcgaatccggactgaaggccaccatcgagtggtacactgagaaccgcgcctggtgggagcccgcgaaggccgccaccgaggccaggtacaagcagcagggccagtaagccgggccgcccttttctgcagaataggaaatcccagaataggaaatgggcttctgcggaataggaaccgttgcaaaaagagcttttccttattccgcagatcattgcccgagcagaataacaacatcaaggaatgggactcatggattttgagaaggaactgaaggtcgagaggacgaacatcccgggtctgatcgtgttcgacctgccagtgcatggcgacaaccgcggctggttcaaggagaactggcagagggcgaagcagacgaatctgggcctgcctgatttcgggccggtgcagaacaacatcagctacaacgcgaagaagggcgtgacgcgtggcattcacgcggagccgtgggacaagtacatctcgatcgcctcaggcagcgtgttcggcgcgtgggtggatttgcgccccggcgactcgttcggccaggtgtacacgaccatactggatccgtcgaaggcgatctacgtgcctcgtggcgtgggcaacagcttccaggcgttggaggacgacaccgtgtacacgtacctcgtgaacgcgcactggagcctggaacagaagaagacatacacgttcgtgaacctcgccgacccggacctgcacatccagtggccgatcccgttggaggactcggaacgctccgaggcggatctgcaccatcccatgctgaaggacgcgaagccgatggcgccgcgccgcacgatggtgacgggctgcaacgggcagttgggccgcgcgatccgctcctacgtggacgcgcatggtttggagggtttcgagttcaacgacatcgacacgttcgacttctccgacccggcccagtacgaccggttcgactggtcgctgtacggcacggtcatcaacgcgggcgcgtacaccgcggtcgacaaggccgagacggcggaagggcgcgcgctggcctggaaggccaacgctcagggcccggccctgctggcgcgtgtgtgcgcggagcacaacatcaccttggtgcacgtgtcgagcgactatgtgttcgacggatcgcgcgaactgcacgacgaggcggaggcgttcgcgccgctcggcgtgtacggccagtcgaaggccgcgggcgacatcgcggtcacgaactgcccgcgccattacatcctgcgttcgagctgggtgatcggcgagggccataacttcgtcaagactatgatgatgctgtcgaaccgcgtcgcggaccccggggacacgctggacggggtcaccgtggtggacgaccagtacgggcgcctcacgttcaccaaggacatggcggacgcgatcttccacctgttggattccaaggccgggtacggcacgtacaatctgaccggttccggcagcgtggaaagctgggccgatatcgccaaggcggtgttcgaccagaccaacggtaacggtgacagggtgcgcccgatcccgaccgaagagtacttcgccaacgcgaaggatccggtcagcccgcgtccgacccattccgccctgaatctcgggaagatcgaagggacgggataccacgcgccggactgggaagaatcgctgaaggcatacatcgccaaggaactggccgagtgattcaaggggaagacgcttcctgataatgcgatgaaaccgcgcagactcctttgcgcggtttttcaatattggattgacctactaggctggaagcgcttattaccaaagacacgtcagaaagcaggacgattatgaagggcatcatccttgccggtggttccggtacccgcctgtatccgttgaccacggtcacgtcgaagcagctgctcccggtgtacgacaagccgatgatctactatcccctgagcgtcctgatgatagcgggcatccgcgacatcctgattatcagcactccgcatgatctgccgaatttcgagcgtctgctgggtgacgggagtcagtatggcgtgactttctcgtacaaggtccagccgaacccggacgggcttgcgcaggcgttcctgctgggcgaggagttcatcgacggcgagccgtgcgcgctggtattgggcgacaacatcttctacggcaacggtctgggacgtaccttacgcaaggctgtcgctgtagagcatggtgccacagtgttcggctattacgtggacgatccggagcgatatggtgtggtcgagttcgatgagaacaagaaggccatttctatcgtggagaagccggaacgccctgcatccaactatgcggtgaccggtctctacttctacgacgagcgtgtggttgaattcgccaagcagattaagccgagttcgcgcggcgagttggaaatcaccgatctcaacaggatgtatctcgaagacggctctttgaacgtgcaaacgttaggtcgtggctatgcatggctggacacgggcacgatggacagcctgtttgaggctggcgagtttgtgcgcacagtccagagggcgcaaggtttgccgattgcagtggccgaagaaattgcgttcgagaatggttggatcactcgtgagcagttgatggcggccgctgagaagtacggcaagagtccgtatggtaagcatcttaaggatgtcgctgaagacaaaatcattctcagatcaaagaaaggttagagactgtgagccttacatttaggaagatttcggtaagttgacgattggcatctgagttcaattgcgatttggaggaagtatgaacttgtttagcaaacgtaaccgtgtgcttcttcgcgagctcactgttacagattttaaattacgctatcagcagtctgctttaggatatttatggtctattctgaagcccctgatgctatttgcggttatgtatatagtgtttgcgaagtttctggcgatgggaggggatatccctaactacgctgtgtatcttttagctggtatttctttttggaccttctttgcggaggctacaacacagggcttgcaggcaattgtctcgcgtggagatttgattagaaaaatcaattttcctaaatacatcattgttctgtcaggaacaatctctgcgttaattaatcttttctttaacttggttgtagtctttgtttttgccttgttaacaggggttaagtttcgctggacagtgttttttttgccattgaacattcttgagatgtatctattggcattgggcataggcctctttttaggatctctcttcgtaaagtatcgtgatgttggatatctttgggaagtgactttgcagttgtttttctatgcaaccccgattatttatccaataacaatggtgagtgccacgcatccttttatggcaaaattaatgatgttgagtccgacggctcagataattcaagacatccggtataacctagtcacagattacacacagacgctttggtcgatgtggaacaatccgcttattggcctggttccactgtcgctggttgtgatagtactggcaatcggttcttggtactttaacaagagttctaagcaattcgctgaggtgatgtaagtgatagcgatgaatgacaatattgcgattgaagtcaaagatgtttccaaaagcttcaagttgccgcttgagagagcctctagtctaaaacaagcgatctttaatgctgtaagtgggaaaaaggggtacgaagaacatcaggttctacgtgatatttcctttaaaatcaacaaaggagattttatcggaatcgtaggacgtaatggcagcgggaagagcacgttgctgaagttgatggcacagatatactatcctgattctggaagtatcgacattaatggtgttttggtgccatttattgaattgggtgttggttttagtcctgaactaaccggacatgataacgtttatctcaatggggctctgatgggcttttcaaccaaagagattgacgcaatgtatgacgatatcgttgatttcgccgaacttggtcagttcatggaacagaagatcaagaattactccagcggcatgcttgtccgtttggcgttctctatggctattcgtgctcagtccgatatcctcctgctagatgaaattttggcagttggagatgaggcttttcagcgtaaatgttatgcatatttcgctaaattgcgtcgtgaaaaaaagacggttgtgctcgtaacccactccatggattcggtgcaacgtttttgtaatcgcgctattttgattcatgatggtgatcttaaaattgatggcactcccttggaagtcgcacaagcttatcaagagttgaatagtcaacgtcttgatctcgctaaccttgaatctcaattttctggtggtgacactgaggcgtcgatttcggagcaagaagaggaagctcgtcagcgaaaggagaatgttgatttcagaatatcccatgagattactgatagtgagcttatcttcaatctagatattcttcctaagagaagtttagaagatgcggttttaacttttgttattaatagcgaggtcggagagattgtttttcgtgtcgccagcgatgataagaacgttaatcagaaaatcgcgttttccgagggggaaaatatacatctgcgcctttctgtggataacatttttcctaatggtattttttcagtgcaagtagcagtgaagaagaaagatagaagcgaaaactatctaatggcaaataatgcattgttgtttgaggttcatgctcctgtcgacgtgagtcagaattggaagcctgacttcgattttgtcctgtcttcaatggagggataatatgaaatacggcctttttaaatatgagaccgagaacatcggggatgaaatccagagcattgcggcaaggcgttttttgccatctgtagatgcttatatagaccgagacagactaggtgagtactgtcctgatgaggagacaaaaataatcaccaacggctggtttatgcatgcgccatatcagtggcctccaaagtccggtaaagtgattccccttactgtatcaatgtatatcgatcaggctgattctaaggttcttgatactttttttagtgatacgagtattaagtatcttaatgatcacggtcctgtaggggcaagagatctttcaacgttggagcttttacagaaacatggggttgagtcttatttttctggttgcatgactttgactctgcagagggatccaagtattcctaaaggtgattttgtcttagctgtggatgttcctcagtctgttgtggagatggttcagagtcataccggtcgctcggtcatacacgcatcgccgtattttgatgcaaatatgagccaagatgatcgttttcagttggctgagtatttcttgtatttgtatcagtcggccgctgctgttatttctacgagattgcacgccatgcttccggcgcttgcacttgagacgccagtctttttagtcaaggatcgaagtaaatacgacgaaaaaaggtatgcaggattagctgagctggtgaacagtgcgaccgatgaagaatatcttaatgattattcactttttgatgttgacgcaccgaaaaaaaatcctgagtcttatctgaaaatacgcgaacggttaattgaaaaagctgctaatttcacgggttttgatagtgatagctcttttcgaacggttgatttttctcacattgcagataatgaatcgtatataaggctttttacgagaggttttcattccctgaatcgcgaacttctcttggaaggcgataagaaatggctccaggagcaatgtgatgatctgcgcagaattcggcagcatcttgatgaggagcttcaggacgctcaaaaaaaacagaatgatctttcccttcagaatgatattttgcgtaaacgtatcgaagtaatggaaaaccgtatcgaagtaatggaaaaatctagttcttggaggataggtaggacaattactgctcctggacgtaagctaaaaaatatgattagggggaactagaagtgaaatatatcagcgtttttttccaataccttcgacacaacggaatcaaggtcacttttgagcggtgcctttcttttatgaaacgtaagctgaggcgttctcatgcagcgcaaagcgttattccgaagcgccctattgatgttatgacatctgtggaggatgtcgtcaaagctgactttgtcactgagccgtatattgcgcctaagaaaattaataaaacgaagttgaatattggatgggttctttcgcccatcagtattggtagtggtggtcagcatacaatcgctcgttttgcgaaatcgttgcaagagcgtggacataatatcacttttttcatctatgagagcatttcgcggcagccagctgattattctcaccagttgttgaaagaacattttgacattgatgttccctgtctacctatgagtcaggccgaaaaagaagacatcgatgtactgttcgcgacgggatgggaaaccgcttatcctgttttcaacatgaagaatccggcccataaaatgtatttcgtccaggattttgagccgctcttttacggaatgggctctaaagcggtgttggctgagaacacttatcgtttcggtttttacggtattacagctggatgttggctgacgaaaaaggtcggagaatacggcatgaaagctgatttcttcgactttggcgcagacctagatatctatcgtcctactgagaaaactccaaagaagaagcagatttgcttctatgcaagacctgtaactgagaggcgagcctttgaaatcggcgtcttgactttgacgaagttccatcaaatgcaccctgactacaatatcgttttctttggttgggatgtgtctgactatgacattccattcccctacgaaaatcgaggaatcatcagtcctgcggaactttcttcaatttaccatgactctcaagcatgtttggtgctttccctaacgaatgcatcgcttctccctcttgagttgcttgccgcaggatgtgttcctgtgatgaacgatggggagaacaatcgcttagtaatcggagagaactcagacattgtctacacgttggactcgccaatcgaattggccaaaggattggatgaagttgtctctgatcctgacattgaagcaagatgccagcgtatctccaagagtgcggagagctcatcttgggatgcgtcatatgagaagtttgcgaaaattatcatgcgagaggtgactactgtcaaccatgagtgagattaaagccactgttttcatccctacctattatggtgaagacaatcttgatgagctttttgaaagcttgttgaaacagaagacagattttgagtatgagattctagttatcgatacgagctcaaaagatcgtactcccgaaattattaaagcttggttgcctaagtttaagcattttcggtatgaaaccattgcaaagcctgatttctcacacggaagggtacgtcaacaggcagctcaaatggcccagggtgagtatgttgtgtatctgacacaggatgcaacacccgctcatgatcgatggctgtatgagattattcaaccgatggagcgattccctatagttgccggtgtcatgggtaagcaggatcctcgtcccaatgctcttcccctgctcaaagaagaaataatacgaacctttaagcagtttggtccagacttcggaacaacggttttctatgaggatgactttattgactctcaacaagtttttgatctagttacgttctactcagacgttaattcagcggcacgtaagtctgtgctccttggagacgttccgtatcaggatgtgccatatgcggaggatcagaagtttggcgaggatcttgtcaaacacggttatgtcaaagcctatgcgccaagagccaatgtatggcataccaatgagattaaattacgtgattacaagaaacgtatgtttgatgagattgtcggtgtgcggcgtgttggcaaaacaatggatccaatttccatggcattcgttattaagcagatgattcgtgcctatacattaggctcaaagttcatcctgcaggatcatcaatattcgtggaagcgcaaattgtattggctggtggtcaatccactttttgtcgcagagaagtggaaaggcgttcgagcggctattgctgttgatctaaacgaccaggcgacaatagatgcgaattctttggaaaagcaacaagagaaatagtgaatgcgcggcattaagttgtcgcgcattcactatttcatattcttgattttcatatcgtatattcttttttctatcagtcttatccatttaagagaattgcagattactctatctttgaatgaaagagacttgactaaattcgcgacttgcaatttgtcaattctgaactgttgcttttcggtggaattcttcgcagttcttccttcatctttgagattacccgtaagagtgtagtagcttcgcgctggaataataccattttcttggcaaagaacaaagttttttttagctgcaacgatgtgatcatgatagaacgaggcgctacgcatcttgtgcgtaacagagtcgggtctttgtagccagtaatacagggttgcgtcgacgtcaactaccgttttcatccgcagatatagctctcctgctattgcagtgtcctgagcgtaaataccttcggggaaccgaactccatcccatacctttcgtttgtataaacggcaccaattcgcctcattaaaataacgagcttcagtgtttttgccagtcatctttcctagaacgcgaaatagcttgctgaaaacagtttgatatgactgtagaggattgctaaaagatgttgttttgcctgtaagggctgtatcatttgacgctttcgctttgatttcttgaatctgcgaaataccaaactgttgccaacgggctttgctcatgtcagcatgattggagactagcgcatgaaataatatttcgatattgtctcgtgccattatgtcatcattatcaataaaagcgatatagtcacctttcgccaaatccagtccagcattctgagctttggcaatgcctccattttcttggtgccttacaataattctgttgtcgttagaagcatataaatcacaaatttgcggcgaagaatcagtggaaccatcgtcgataagaataatctggagattgctccaagactggtttttgactgagtcgagacaaaatggcaaatagtgttccgcgttataaacggggataatgattgaaacgagtggcgtcctgtccattgtttccttctatcgtattgtcttcggactcaaagctttcttcagtctacactcatgaagtcgctttcttttagatagttttttccagaggtctgatcgtactgtacaagcttgtagtctgctagcagttgcttttgcgttttgttcatgctgtcagaatcagccactgtgccgtcggattgaagataagttgctgttccgagcccgattccgcccctattcgagatgacacggttaatcgcaggtatttcttcgtggagtttagttagcaaagctaggtagggcgaaactttttcattcatatgctcagctgcggatgacatgaaataattcgatgaagagaacgctgcttcaaaatcgtcaagcttggcatttgcagatggggacgcatcgtttgaccaaatgaaataatcggcttcatgaagcaggactgaatcgtctggatcttgatcttcttttaaataaatgccagaaagatgatctccatagaaaatgactgtaatgggcttgttgatctggttttaactggctgaggaagttaagagtcacttgatctgtgtatttcaggcccgtagaaaaaaagttaatcgcactatgctcatcatcaggtgtgatatgaactgatttttgttccgcttttcctctaactcgatgggagatgatggaaccatggcaaaaggcacgagacgcgcgcccggttgtcggcgctgggccgggatccggccgggatcggccgcggccgggtgacgagcgtcgtgcgggaatcgggagtcaggggcgtgcgccgcggcgggacgtccgtcaccgccagaccggcgaaggggcgcgggcggcgggcccggcctcgtgggacgcgggttcgagtgtttatgttcaatggttttaagaccggttgagcgtttggtttttagtccgaaagagcggtaggaattagtccatttcatcgttgatggaaaacaagtgacaccggtctgtcgttatcgattagtttcccgagttgaaaaaaacaaccattgacggttctcgggaaaggaaaggaatgaccataccggtgtcggttcaacaacgtatcaggctccttgaccagcagggaacgccatggcgagccatcgcccgtgatttgaacgtgtccagggacacggtcaggaaatacgccttgatggaggattgctcgcccaaacccaaaccatcgaccacgcggccgaggaaactcgacgggttcacgcccgtgatcgacgagtggttgcaagcggaccggttcatgccccgcaagcagcgccataccgccaaacgcgtgtacgacagactcgtcacggagaaagggttcaccggctcgtattccgcggtgcagcgttacgtgaagcaatggcgtcaagaacatcgtcccgcctgtgacgggttcatggagctggaatggcggcccggggtcatgcaggtcgatttcggcgaggccgtggtggtgctggcgggcgtgaaaaccaaggtgcattgcctggtggcgtcgtttccgtattcgaacaagcgttacgtggtcgcgttgcctggcgagaacgcgcaatgcgtgtgcgagggattggtcgagatcttcgagcatatcggcctggttccgatggtgttggtgatggataacgccacaggggccgcgcaccggaccgcttgggacaagatcacgatcgtcgggctcttccagttgttcctggagcattaccggatcgaggccaggttctgcaatcccaggagcggttgggagaaaggcagcgtggagaacgcggtcgggttcctgcgccgcaacctcatggtcccgttgttgaacgtcgagtcctatgcgcagttaagcaagcatctgctgtcgcggtgtgacgaactcggcaacgacaagcattaccgggctgatgaaagcgtgaacgacttgttcgaagaggaccgggcgggcatgcggccattgccgcgcgtgcgcttcgacgcggtcgattggcaggaacggcgcgccgacaaggaaggtgtcatacaggtcggttcgtatcgttacctcgcgggcccggcctggcgtagctggccgctattggtgggattgcgcgcgttcgacgtggagatccgtacccgcgacggccgcaaggtggcctcgctgcccagggcttatggcgagcaggccggtacggtgcgtagcccgtcgtcgctgctgccggcattggcgcgcaagccacgcgcgtggggcgaatcacccgtgcgcggtgattttcccgagggcctgagaaccctgatcgacgcgcaggactccgcccggcgcaaggccacgttccgcttgttggagcgcgtgggtgccgcttgcggtttcgacgcggcctgcaaagccgcggaacacatcatcggccagggcagaccgatcgacgaggcagccctgagcatcatggccagacggatagcgtccggcgaggcgccggccgatgttcccgcgcccgacctgagcgtgtacgacgacttcatgaaaacaggcgatggcgatacgctcaaggagcgggaaggagggaaggaccgatgagccggatccagaaccccgcgccggacgccacccgacgccgcgcgtccacgaacaggaaaatggaaacgatcatgcgattggcgcgccgactgccgttgaccaggcaagtgctcgccgaccagctcgaaaccgcgaccccgtcgcaaatggagttcatggaccaatggatgaacgcggagatcgagtccagggaacgatcgaaacgatcccggctgctcaagcaggccggtttcccggccgtcaagacattggacggctatgactgggagaacattcgttttccggtggattggggcaggcggtcgcttgaatcattggagttcgcgagccgtccggaggatgtggtcatgttcggacctcccggcacgggcaaaacccatctggcgatggcgttgggaaggaagacctgcctggaaggcatgacggtacggttcttcaccgccgctggcctggtcatgcgcttgttgcacgccagcacggaaggcaaactcgacagggaaatcgcgtccatcggcaaggcccgcctgttgatcatcgacgagttgggctacgtgccgatcgacgaggaaggcagccggttgttgttccaggtcatcaccaacgcgtacgagatgcaatccatcgtttacaccacgaacatcgagttcagcgggtggggccgggtgttcggggatccgaacatggccgcggcgatcatcgaccggaccgtgcatcacggcaggatgctcaggttcgagggcgagtcctatcgcaggactcatgctcttatgcaatgaaacaataaaacacgagcaatgacaggccagttccgaactggactaaaacctaccgctttttcggaaggaaaactcacgccacactggcctataacaacttgacaaaacacattcgaggcgggggcgcccggaccggccgcacgtggccggcatcgcctgcgtgcgcatggccaacggctcgttcggctgcacggcgttcgccgccgacgtgctcgcccgcgggatcgccggccgggcgtgcgccgccgccatggacaccagggggggggctggtgccgcgggcgccggaacaggcggtatcatgggccgcctcgcatggcggcatggacggtctcacgcaccgttccggccatggcacgtggcgcatcggcctcgtgtacgccaccggggtcggggaatgcggcatgcctccccccggccggcacggccggcgacggcgggttctagtgatcgttgcaacacctgacctaccgcaaggaggatcaggtgatgaaaagccatcatcatgacggggaccgcgacgcacgccgttgggcgttcaacggcgtcgaatacccgacgaggaacgagatgtgcgaggcgagacgcgccgagtacgtgcgcctgctggatgaggagggcatgaacttcacccaggccgcgcacgcggtcggcgtctcgaaacgcgccggcaaggcgtggcgcaacggcaggacgcgcgccacgggaaggaacgagaaacccctggtggactggtatcgttccaccatggacaaaccaaagaggatccatgcgcgctatctgagccaggacgagaggatcgccatcgcggaccgtctgcgtctgggcgattcgatccgcgccatcgcccggctgctgggccgcgaccccggcacggtcagccgcgaggtcgagcgcaacaggaatcccgagtccggcggttacgagccctaccgcgcccagcagaaggccgcggaccggctcaaacgccctaaaccgcgcaaggcggccgtgggcacgcgaccgtgggacgagatcgccgccgggttgcgcaggcattggagcccggagcagatagccaaccggctgaggctggacttcccggataatggggatatgcacgcgagcgtcgagacgatctaccaggccatctacctgcaggccaggggcgaactcaaacaggagctgaaacgcgccatgaggcaaggccgggccaagcgcaagccacagggcgacggcgggcgcagaccccggttccgcgagcccatggtcatgatcagcgaacggccggccgagatagaggaccgcgccgtgcccggacactgggagggcgacctgatcaccggcgccaagaaccaaagcgccatcggcacgctcgtcgagcgcaccaccaggttcacgatcctgctgcgcctgcccgacgggcacgacgccgaacacgtccagcaggccatcatcgacaagatgcagcacctgcccaaactcctgcgcaacagcctgacctgggaccagggaagcgagctcgccctgcacaaacggatcaccacggcactggacatggccgtctacttctgcgacccgcactccccgtggcagcgcggtaccaacgagaacaccaacgggctcctgcgccagtacttccccaaaggcaccgacctatccgtctacccggaggactacctcgacgcggtcgccgaggaactcaacgaccggccacgcaaaaccctcgggttcatgaagcccagcgagaagatcatcgaactactcaacaccgcaagctaacctaacaaccaacaaaaccaatcaggcgttgcaaccaccactagaatccacccgacccgtacggcaacgccatggccgagagcgccgacggcgcgtacaggaccgggctcgtccggcgttgcaagcccttccgggatccgagggacccggaatcggcgacgttccggtgggtctcgtggcggggactcgaagcgtccgcaccggccctcgggccaccggacaccggaacggaccgaaccgagtattatgtaaaccaagcggcgcaagccgccccactataaggacggaaaaatcaggccatatcaaagcgcaggccgtaattcgtaaataatggcgctttccagagcggtggttagtgggttaaaagagatttcagcgagagagaagcaggagaatgaatggtgaagaaaagagaagacattgagaatttgcgagcagtcgcaataattcttgtggttctagggcacagcgttatcctgtattcggataaatgggcgctgtatcccacaacagtctcagcccccccctctaaacggactgaaagacataattaaccttattcaaatgccgttgttcttttcgatatcgggattctgcctcgtatattcattgaatgggaagcgttctttcaggggttttctgaaaaacaaactgcgacgtgtcgtagttccttttctgattattggcgcattgtggttgtatccgttaagaatgcttgccgattatccggcatatcaggatgtgaacccggtcaacgtgcttgtcaagtatatttactttggctatgacaacggacatctctggttcttaccgacgttgttcctgatgctggtgctaaccgacctgattgcccgcgttccgcttttcgaaagcaagccatcactgttcgatttaagtcttgtggcgattgccttgctgacggttgcgattcccgtgtcttggccttatttagggcagttcggccagaactatatgtggttcgtggtgggtgtgcttttccacagacatgaaaagtggattagagaagtatgcaccggtggaatgaagattgtgcttgtctgtgcggcaggtattggatgtctgattaccgggtgtggcatcgaatcaatgctacttggcaaaatcctctctttgatctgcgttctggtggcatacctcgtcgttccgagtcattcgacagcgacactgcggaaaataagccgcaacagcatgggaatataccttttccactctccgctgatatatctatcctttaatttttggcctaatatttcgccatggctgatggtgctgattaatttcgtgggattcggtgccgtagcttatggaatgaccgaactcgtcagaaaactgggtctgggaatagtcataggggagtaggtgcgcggctaaagcttgcgaaattataacaatgcggtataggcgaattacgaaagcggtgaatcgtcgtttttggaattatgaaagcgacactgctcacagtttgtacgtagtttcatatgggcgaggcacagcaatcaataccagcgatattgatatcctcatgctgttgcctaatactgctaaaaagagatttgatgcctacgcacagaatggtcaatcagctcttcttcaggtcgttgggtgacttgaggaagctagatgtagctgagttgcttccgttcgataattccagagtcgtgcgcatggtgtccattgcttcggcgactttcactgcggttgatacagttgatgccgccattcgggctgtgctggtcgggttacaggatgagccgaaagaaggcgtcaaggaattcattctgagaatcaattacgtgggtgttgcccgcttggtcttcgcggtgggcgtcgatgccaaaacagtgtgggagcacaggggcgagcatgtgagatcgcaacagaaggatgtagctgacggtcaggtggcattgaatctgctgttgctgaagcctgagcatcagtctgttttgttctctattgagcggttgtccgtttataaggacatcgagcgaggtaaaccaaagagtcgtgctgataaggagcaatggcttgatcaatggggtaagcgacttcctgagggctgtcatctgcttaatctcggtcaagtgaagcaggaggcagaggatctcgtagcaagagatggcggtctttggaagcgactggttctgattgagtttgctcggtttaagccgtatgagctgattgaatctggtgaagacgaaactggcaagaaaggtaagagtcctccgtttgattcgaagattcttgacgaaatgtggtgtgaggtgttcggtgatccggacaaatcgtctgtgaaatatgttgccaaagtcttgaggcggaacgcgagcatcttggacggcagtcgtaacaggaaaatcatcggtgctgcgggaactgtggcaatcatgggtgctactggaggtgtcgcatttgcgatggctctggttatagcaccggtgcttgcgggttcgtctgttgctggattatccggtgctgcccttaccagcgccagtcttgcggcagttggatatggatcgttggctgctggcgggcttggcatggcaggtggaacagcgataatcgctggtggtggtgcggctctgggtttggctagtggtggtgcggcgacagccattaccgcgctgctgaccggaaccaagggagagtttgcgcttaatgaatgcgccaagctcctcactttctgcaaagattcattggtccagggcgataaagcagaggagttgattgagtcaattcgacacgaattagccaatcaaatcgggcagatggaaatccaacaggccatacttttcgaacgttccaaagattccagcctaaacaaggaagagaaaaagaaagccaagaacgagcttgcttctttcgagaagagtttgcgatacatgcataaatgcgaaaaggagatagccaaactggttggtggtcggcctcatgcggagagcgcagcagatgtcttgaacggtgccggcaatggccgattgattgaaaattgatggcaatgagcgcgaagcattgtcatgctatggggcgaaagcgctcgctgatttctggtgcagggccagcggttggaccagagaggacgccggcgttcagccacgcgtatttgctcgtcgtgatttgccggttgcccagtgggaagtagcgagaacctagtgggaagtgcgcggttgaggggctaaggatgctggaatcctagtgttttcaaagtgctctggcttcttgggggagctctattggttccgaatcttcgatagctactgtgcctacatggaaatctagtgggcttgcatggaaatccagtgggaagcagagaaatgtgtcgtaatctcaatgatttcaacggttttcaaagatgctaaggtgctcggtcttccggtgacatggcgactgcatggaaatcacagggtcatgtgttgtgctcgccggcttgggcttcgtcctaggctcgcggcaagtctttccccgtagtcttcttctcggagcgtgggagtcgtattgccatgatttcatgctcgtcggtaggttcataagaagcgctaatattacattagttcgttcgattttacattagttggagatctgctatggtttaccggccagaggaagtggtgaacaaggttcagagacttctgtctgatgtggaaacagaagtggtggagtacaagtctgccaagaacaattttgatttcgacgatttggggaagtatttctctgctttgagcaatgaagccaatcttcgtcatgccgatgctggctggcttcttttcggagtgcgtaacgatcgaacgatatgtgggactggataccgcaaggaagcgcatgggccaagtgtcgggttgcgcaagttgaagcatgaggtggcgctgtataccaatagcggcatgacgttcgaggaaatatatgagctgacgatagaacgtcagcgagtggtggtctttcagattccccctgcatcattcgctacgcctactacttggaaaggcgttccttattctcgagagaacgaatccattgtgcagatgcctgctttcaagctgactgcaatctattcccaagcaagacctgattggtccagtcagcttgcatatgacgccaatgttggcgatcttgattcggatgccgtggcttttgcctgcgaggagtattcgaagaagtatgcgcctaggcaacgggcgattaagggattctcgtctgaagagattttgaccaagatcggtctcctgattcatggacatgtgaccaatgccgctctggtgctgcttggtaagcctgagtccacggttttccttggtggaatcgagccgcgcatcacttggacgttgtataactcggcgaatgatgtggtctcatatgagcatttcgagcccccgttcatgttgcaggtggacaaggtgcttggcaagattcgcaacgagaaatacaggtttttcacggatccaaatacgttgttccccgaggtggcgcaacgctatagcccggagattattcgagagctattgcataatgccattgcacatcaggattatcgtttgtcggggaagatcaatcttttggaatatgaagaccgccttgtgtttatgaatgaggggtcgttcattccaggaagcatagatgctgcgctggctgtcgggtacaagcctccgtattatcggaattctctgcttgccaaggcaatgagcaaggttggcatgattgatcagaatgccatcggcatcaggaatgtcttcgagatgcagaggaagcgccggctgccgttgcccacatacgatttgtcgaatcgctctcgcgtatcggtctcgatctatggtaccatcctcgatgagaaatattcgcaattacttgcgtccttcccggatttggatttgcagagtgtggtatggctcgacatgattcaaaagggcttggtgatagagagggagcaggctgtttcgctgaggtcacgcggcttggtagaggggcgttatccccgtctgatcatttcgtcggatgtggcgaacgccatgggcaagcagaaagagtatgtgcgcagcaagggcttggataacaggatatgcaaggaactgattttggagctgcttcgatctaggccttcttcaagacttgaggtgctcaacgccattgatcatgcattgccaggggcgctaagtgccaagcagaagggagagcgggtgagctatctgctccagagccttcggaagcaaggaaagatttactcagaaggtgctacttcggctgctaagtggcatcttcaagagtagatggctgttttcttggttgagtgctgaagcaaactaatgtaaatttttgttacctcagaaatttcattagtcttgaaatgcttgatatatggcggttctgaagctgggtatggccactggcgaactaatgtaattttcttaagtccaaaaattacattagttcgtttatatgtttgtacaagacgaatctcccccgattccttcttctcgccacttctggttgtatgctctagcggcatggtaagaacgctctggcatgccttccttgctgtacatgccgattgtgagtgtcacccgtgatggtcgcaggctcgacccggcatggcgttgatggccgcgtacatcgacgagcacagaagccgtttcagggtcgggccgatctgcagggtcctttccgaatcgttgggctgcgggtttctcgcgccgcgcggctaccgcatgttcagaacacgtcccgtcagccgcatgcgggcgaggcgtgaggcgctggcccgcgccgtcctccagatccgctcggatctcttcatggccgtgtacggctgcgggaagatgcacgcgcagctggtcgcccagggccgggatccggccggggtcggccgcgaccgggtgatgaacatcatgcgcgggcttggcatccggggcgtgcgccgcggcgtgcgccagagcctcgaagaggccggtgccatggagtacaccaccatcgtggcctccccggcttccgattccgcaggcttcaagtacatcgcgccgtacaccggctcggccatcggccagcactggatgtaccacggcaagcacgtgctcatcgtcttcgacgacctgtcgaagcaggctgaagcctaccgttcgatctcgctgctgctgcgccgcccgccggggcgtgaagcgtaccctggcgacgtcttctacctgcattcgcgtctgctcgaacgctgcgcgaaggtctccgacgatctgggtggcggttccatgaccggcctgccgatcgtcgagaccaaggcgaacgacgtgtccgcgtacatcccgaccaacgtgatctccatcaccgacggccagatcttcctgcagtccgatctgttcaacgccaaccagcgtcccgccgtggacgtcggcatctcggtctcccgagtcggtggcgccgcacagaccaaggccctgaagaaggtctccggcacgctgaagatctcgctggcgcagtaccgttcgctggaatccttcgcgatgttcgcgtctgatctggacgccgcgtccaagaaccagctgaaccgtggctcgcacctgaccgagctgctcaagcagccgcagttctcgccgtattcgatggaacaggaagtcgtctccgtgtgggccggcacccatggcaagatggatgatctgccgctgggcgacgtgctgccgttcgagcacgcgctgctcgattacctggagcacagcaccgacatcctcaagaccatccgtgagaccgagaacttcacgcctgacaccgaagccgccttggacgaggccgtcgaagcgttccgcgagacgtacgtgaccaaggccggcaagccgctggtcgtgaagaagtcctcgacgcgcaagcccgtgcccgtggagcaggagaagatcatcgccaaggccgacaagcccgcgcacgatccgaccaagcacccgatggctggagaaaagaagtagcccatgggatcgcaactcgcattgaagggcaggatcgcctctacgggatcgctggagaagattttcaacgcccaggagatgatagcgtcttcgcatatcgccaaggcccgtgacgtggccctgaacgcgaagccgtacgccgatgcgattttcgatgccgttcaggctgtggtagcccacacccgtatcacgcatccgattgtcaagaaggaggaggacaaccccaaggttgccgtcctcgccttgacggcggatcgtggcatggccggcgcatacacctcgtcgatcatccgtgagaccgaggaactgctcacgcgactcgacgacgccggcaagcagccggaactctacgtgtatggccggcgcggcgtgacgtactacaagtaccgcaaccgcgcgatcgccgacacgtgggagggggataccgacaagccgggcgttgaaatcgccgaggccatctccaacgcactgatgaccgcctacatgaagccggccagcgagggcggggtctccgaactctacatcgtctacaccgagttcatcaacatggtggtgcagaaggtgcgcgtgctgcgtatgcttcccgtcgaagtggtcgaggccaaggtcgaatccggcccgggcatgtcgcgcgagagcgagggcgacaacgccgcaagctccaaggtgcgcccgttgtaccgcttcgagcccagcctggacaaggtgatggatgccatcctgccgaagtacatccagtcgcgtattcacgaatgcctgctggaggcggccgcgtccgagaccgcgagcaggcagaacgccatgcacacggcgacggagaacgcgcgtaacctgatcgactcgctgacccgtaagatgaacgcctcccgtcaggcgtccatcacccaggaacttaccgaaatcatcggcagcgccgacgcgctgaacacaaaggaagagtaggaacgcatatggctgacaatcagaccacagcggctcccgagacggctgcagagccgatcaatggacgtgtgacgcgtatccagggttcggttatcgacgtcgaattcccggtgggccacctgcccgatatctacaacgccctgaccgtcgagctgaccaacaccggcgctcacgaggaaggcgagaccgcgcacacgatcacgcttgaggtcgagcagcaccttggcgactccaccgtgcgcgccgtggccctgaagcccaccgacggcctcgtccgcggcgcttcggtgcacgacacaggcagctcgatttccgtgcccgtcggcgacgtgaccctgggccacgtgttcgacgtgaccggtcacgtgctgaacaagaaggccgacgagaccatcaaggtcaccgaacgctggcccatccaccgcaagccgccggcattcgaccagctggagtccaagacccagatgttcgaaaccggcatcaaggtcatcgatctgctgaccccgtacgtgcagggcggcaagatcggtctgttcggtggcgcaggcgtcggcaagaccgtgctgatccaggagatgatccagcgcgtcgcccagaaccacggcggcgtgtccgtgttcgccggcgtcggcgagcgtacccgtgagggcaacgacctcatcggcgagatgggcgaggccggcgttctggagaagaccgcactggtcttcggccagatggatgagcagccgggcacccgtctgcgcgtcccgctgaccgcactgaccatggccgagtacttccgcgacgtgcagaaccaggacgtgctgttgttcatcgacaacatcttccgcttcacgcaggccggctccgaggtctccacgctgctgggccgcatgccctccgccgtgggttaccagccgaacctggccgacgagatgggctccctccaggagcgcatcacctcgacccgaggccactccatcacctcgctgcaggccatctacgtgcccgccgacgattacaccgacccggccccggcgacgactttcgcccacctggacgcgaccaccgagctttctcgtgacatcgcatccaagggcatctacccggccgtcgacccgctgagctccacctcgcgaatccttgatccgcgttacgtcggccaggcccactacgactgcgccaaccgcgtcaaggccattctgcagcgtaacaaggagctgcaggacatcatcgccctgattggtatcgacgagctttcggaagaggacaagaccaccgtcaaccgcgcccgccgcatcgagcagttcctcggccagaacttctacgtggccgagaaattcaccggtcgtccgggctcctacgtgccggccgacgagaccatcgaggccttcacccgcatctgcgacggcgtttacgacgacgtcccggagcaggcgttctccggcatcggcggcatcgacgacctcgaaaagaagtggcacgatctgcagaaggaacttggtgagtgatggctgaatcgtcaaaggccctgatgcaggtcaacatcgtcgccgccgatcacccggtgtggcacggcacggcgaagtccgtcaccatccccgcctccgaaggcgagatgggtattctggccgaccacgagccggtgctcacggtgatcaagggaggcacggtttcggtcgtggatcccgcaggtgagcgccatgcgttcgaggtcagtgacggattcatctccttcgatttcaacaagctcacggttgccgtcgaacgcggccgtgatgtggtccgcactgaaggacccggtatcgaatagcgagctcttcggcacggcagcggctgtgccgttgcgctcgcactgggcgtcgtctgcatcccgcaggcggcgccctttttgtgttatctactcggtgttatcccccgtcaatgcccggcgcactccaccattcccaccaaaatacgggttgaaatagccgaaatccgcaattccccgtgtgaaatcgccgtttttggatcctgaaacggcgatttcacacggggaattgttcaaaacggcgatttcaacccgtattttggcgttcgatacgctcgcgctgtcggcgcggccgtacggttcgtgcctgttactggtccgagaggcgctccctcccttccgcgcgtactgtacactggtgtgacgtgcgcgttattgttgctgattgctctgctgaatattccggtcgcctcagtgcgtcgcttcctcccgcgaagcgcgttctgctcataaaggccgacaacagtctgctgatcttctccgaactcggctcatacaagccgctcaactggatggctgcgccctgcactttgaaggacgtcaccccggactctgttgaggccgcggacgggcctgcccccgagcatatccttcgcgtctgcgccgacaagaccagcgacgtcttggaagtctccctgtaccacgtctactccgacaccacctatgacctcggcatcgatcccggcctcatcaaggacggcgtcgaagaccacctccagcgttatctctccgaacagatcgaccgcatcggccccggctccaagctcatccgccgcgaataccccaccgccatcggccccgtcgacatcatggccctcaacgccgacggcgagcacgtcgccatcgagatcaaacgccacggcggcatcgacggcgtcgagcagctcacccgctactgcgagctcctcaaccgcgaccccctcctcgcccccgtccacggcatcttcgccgcccagaccatcacccctcaggcccgcgtcctcgcccaggaccgcggtttcgaatgcctcatcctcgattatgacgagatgaagggtagggaagatgattcccttcgcctcttctgaacacgcctgaacacaccgcgatggcgcgttacctgcgttgctcctcagtcgcggtacctttgtaccgcttccttcggtgcgtcttggtaccgcgcgcatcgcggcgtgttcaggggtgtgttgtgtggtggcgcgttgccggcgttgctcctcagtcgcggtgcgctcaggcggtatgcatgcggcccagggcgatggcggtgcgtaacacataggcctcgcgcgcgtcggcggcgtcccagccggtggtttcggcggcccgcttcaaacggtaccgcaccgtgttcgggtgtacgctcaattccttggccgtggtctccaacgagccgccgttgcgcaggaacgtggacacggtctccaaagtaggatcgtccggccccgccgtctgcagactggcatataccgtattcaccagctcgtccacggcatcctgatcccccagcagcgcccgctcaggaagcacgtcatcggcacgcatcgggcgcggaacctgcggcaatgcgggagccgccgcaatcgccgaacggaccgcctgcaccgtgcggcaggcaccctcgacaccgcggcgcaaaggtcccaggcacaccggcgccttcgtcgagaacgccgacagtgtattggtacacgtcacatcgggcgtcgccgccgcacgcggcatgatcagcgccacgcacagaccgttcgtcgtccccgtcacgcacggtccgccgcccagatcatgcacggtcctgcggatcgcggcccttgtgcccgccatcgtgtgcaacggcttgccaccgatggcaaagcacagaaaatcatccgaaaaatcaagaatccccagaatcgccgcggtacgctcatccgccaacccattgaccagacacgcgaacgccaccgattccagtcgggaatcggcgtcatcctgagcggaaccactgctcagcaggtcaagaaagtcaacggaaccatgctccgtgtcgaaatcggtcataccgtccagcatagccgaaccgtctgcaagcgtcaccagtcgtcaccggatgtccgcgttgcgccgcgcccgctgcgactcccgccagaacgtgagcaccacgaatccgaacacgaacgccaccggcagcatatgtcgctcgaaattgttcgcgggcgcggtgatcatcacgcccatgagcagcagcagcggcagatgcatgaccagtgtgcgccaccggcgaagcaccacttcggccgcgccgatcagcagcgtcatcatcacatacaggttgccgtgagccacccatcccagcaccggaatctcaccgaactgctttgcgccctcggcgatggactgccgccactcgctgcaccagtatttgatccacgtggtctggtctgtcacataatcgctgttcacgtagtaatccatcgacacgtacggctgatccatcgggttgaaatagccgaagcacttcgccagcagcgcgtcgatggcggtgacgggatcggccttgacgatctgccaccaggcgctattgaaccgggccatgtcctcctgtgtgaccgaccgccagcggtagcttaccttcttcgactggatgccggacgacttcaccgggtcggcatcctgcggctggtaggcgtcggccatctgatcgagattgaagatcggcgcgatctcctccctggcggactgcggtatgctgcccggattgcgcttggcgatgcgggcgatctgctgcagctggacgccgtggctttcgatcggatcgccgctgatgatcgcaccggtgcgggtcagcatcacgacgccgccatgcagcacgatgaccggcagcagcaacgcgacgacgtacgccttccagcggcgatggtcggaaagcagcgcaagaatcagctgcagcacgatgatgtaccaagcgtacttcgcgctcgccagcatcaccacgcaggccaggatcaatgcgataaggctgcggcggcgcagcctgaccaccttgtcgcccttgcctcgccacgtacggaacagctcgtaccacacgccgaacgcccacacgaacgagaacgcgaacagaggcgatttcgtcagcgagatcgtcgagaacaccgcgagcggacagcataggaagaacaggataatcaccagacgcgagaaccatcccgaggcgccttcgggcaggcgtccgttcccggcacatgcccgcgccgcgaagccgggggaggcgtacccgcgctccggatgcgtgaaatcaagcatgaccagtgccatcagcccgcgttcgggatgcgtgaagtcaatgccggcgcggcgcggcagccacggcaagttgaagaaccggttggcggtggcggcgcagcagaacgcggcgaacaggaactgcgcggatgacagcaccacgaatccgacatcgttggaatcggtgaaataccgggagaccgacagcacggcaccatacagtaccgtcagcacgatgttgtgctgatcggtcaggtacgtcggattcgacggccatatgtagtgcgcggtcggatagatgtccatcggcacgaatgagaagaatccgatatacggctgatccaggccggtccattggttccaggcccagctgaactcgcgagcctgagagcggatgtcggcgccgaacgcggacagcagcgtcgtcggcacccaaagccagccgatgaacaggatcagtgcgattttccaccaccggtcggtggcacgtacgcatacccgggcgaggaaccgtccggtccggctgacccacgagccgggagcggatgccaggagccgcgcggccgcgcgacgtgcgcccgccggaatcaggcgccgtggatgcaggccgttcttgccgctggaccagccgaacaccggtatgccgttcgcccagcgagtcattgcgaccacggcggcgaatggtacaaggaatccgacaacggcaaacaaccagttcaccgcgccgaaatccgcgatcgaggagtctgcccagtagagcggccccaccgccacgcacaaggcgatccacaggcaggccgcgacggccagcgtccatcgcgccacggccgcgagacgcgcgagggcgatgccggtggcgcgtcgtgacctgccgccgctgcctccgcgcccgccgcgggccggggtggcgctggagtgatccgtgatgtgagctgtggtcatgtcatggtattctaccgatgcgccttgaacggcggcgatcgtgccattgccggcatttgccgtaggacgatatcgggcataatctgaaggcatgtcggaaacaacaaggggaatcattccaaacatgccacgcaccaccgaggtggctgacaatgtgattgcggtggtggaaaccgcatcgaccaatacgctggcgcggcagatgctgcgcgacggcaccatggcgcctccggccgacgggggtgccggtgtggccgtggtggccactgatgtgcagagcgcgggccgcggccggctggaacgcacatgggtgagtgctcccggcgaatcgatgacctgctcgtacatcgccacgctgccggcgggcgtgatcgccgacggcagcgtaaacggctggctgacggtgatcgccgggtttgccgcgctggatgcgctgcggggcgcgctcgccgaatgtggggtggccagtgaagattgcggtctgcggctcaagtggccgaatgacctgttctgccagggacgcaagctgggtggcatcctcaccgagatggtgccgctgcctgggcgcgatgacagcgcggcgctggtgatcggcatcggcatcaacctcgcgataccggccgaccggttgcccacggagcagtccacgtcactgcaactgcatgtgcaagggctgcccgatgcccggacactgcgtgatatgatcgccgcgcatatcgtgcggtcgctgagttcccgactgagcggtttcgtggcagacccgcatgccgccgccgagcggctgcgcgaggagacctcctgcgtgtgctggacgctgggacgtcgtgttgaggcgcgcttcaccgatggttcggtgctgaccggtacggcgacggcgctgaacgccgatgcgtcgctgagcgtgcgtgacgatgcgggcgaaaaccatgtcgtgcacacggccgacgtcggcgtattgccgctgtagtcgcagcgaacggttctcaataagaaaggtgtgagcctgcatccgtccgaaatgaacaaaaaatatggaagaagcccggaattccgggcttcttccatatgagcgtttgtgcgggaatgttagaaatcctcgcacaaacgctattgagaaccgttcgctgcgacaacagcgacgcgaatcagaacagcttggccagaccggtcgccgcgagcgacgcgacgacggccttgatgacatcgccgatcacgaagcccatcgacgcaatcgccacggtcgtgaacggaacatgcatgaccatggactgaatcgtgatgccgaacaggtacagcaccaccaggttgccggccagtgaggcgccgaagtagcggacggcggtcagcgcggcgtgcggagccgagtcaagacgcgccttgccgcgtagcagggcggtgacgattacggccggcaggaagccgatcaggaagcccgcgctcgggccgaacagggcggcggtggaggcgccgccggcgaacaccggcagtccggccgcgccggcggccagatacagcaccaccgcgctgcctgcctgacgccagctgagcatcagacctgccagcatcatgacgaaggtctgcagcgtgatcggcaccggggtgccagggatcgaaatctcaccagctgccgaagcgagccacatgaggacggcgaacagcaccggcttgccgatggtcgaagccagcatacggccgcgctgggcggtggaaacagtacgttcggacatgaataacccctctcgatgatgaaagaacggacggcgagtgtccccccgttgtcgccaatgatagaaagccctcgccttagacggcctgtcgggaacatacaaaagtcgagacggccttttgtggatgttcgccggttacggtgccggaacttacgtggccgtttgtcttcgctctacaaaatatcgccgccgtttttgtcgaaaacttgactccgcgctcgcgcgcatacggcgatagtggaatatatgggaaatatcgtcaaaaaaatactcgtcgccaaccgcggcgagatcgcgctgcgcgtggtgagaaccgcccgggagatggggatttccacggtggcggtgtactccgaacaggaccgcaacgcccagtacgtccagctggccgacgagtcgtacctgctgtcgggtgacacatacgcgagcacatacctcaacgaggacctgttgatcggcatcctgcaccggtccggcgcgaacgccgtgcaccccggctacggattcctctccgaggtgccgagcttcgccgacaaggtcgagaaagcgggcgcgatctgggtggggccgcatccgcaggcgctgatcgacctcggcgacaagatcaccgcgcgtcgcgtggcgaagtccgcgcaggtgccgccggtgccgggcatcagcgagccggtgcgcgagctgcgcacgctgctggacttctcgcacacgtacggctacccggtgatgatgaagcgcaccgacggcggtggcggccgaggcatcaccgtcgtgcacgacgatgacgagatgcgtcgcttctacatgaaccatgacgcgatgcagggcggcgacctggacgagtacttcatcgagaagttcatcgacaaggcccgccacgtggagacccagtgcggccgcgaccgtttcggcgacttcaccgtgtactcgacgcgtgactgctctgtgcagcggcgcaaccagaagctcgtcgaggaggcccccgctccgttcctgccggacgaggtcatcaaccagctggagacgtattcgcgcagcctgttcaacaaggtcgactacatcggtctgggcacgtgcgagttcatggtgaccccgcatcgcaaggtgtacttcctggaggtcaacccgcgtctgcaggtcgagcacacggtcagcgaggaggtgtgcgggctcgacctggtgcgcgagcagatcgatatcgccgacggcggccacctgacaccggcccccgcgccgcgcggccacagcttcgagctgcgcatcaccagcgaggatccggcgacgaacctgacgccgtcctccggcacgctggagcgcatcgtctggccgtccggccccggcctgcgcatcgataccggcgtggagcagggagacacggtctcgccgaagttcgattcgatgatgggcaaggtcgtgatcaccgcgcagagccgtgaggcggctgtcgcccgcgtgcgccgcgcgctcgacgaactcgtgatcgagggcgtgccgaccccggtcagcctgttcaagcagatcttcaacgacgatgagttcaccgccgagcatggtcatctcttcgacgtgagcacgaagtggctggagcgcaagtacctcaaccatgagccgcagaccgtgcgctcgggacagccggcgtcgctcagcggcgaaggccaggacgccggcgcgaaggccccgacgagcgaaagcttcgtcatcgaggtcgacgaccgccgtgtcaagctcaccgtgccgaccgacatcgtcaacaacctcatgggagcggggcgttcgcgcggagccaagcgcccgtcgcagccgctgcgaggccaggggctgcacgccatcgcggagaagaaggagcacaacgacggcaagtccggcgtcatcgcctcgcccatgcaggcggtggtcacgcgcatcaacgtcgcggaaggccagtccgtcaccaagggcgacctgctggtggtgctggagtcgatgaagatggagaactacgtgtacgcgccggtcaacggcacggtcgcgaagatcttcgtcgcgcccgccaccggcgtcgaggccggcgagacgctggtcgcgatggacgtcgacggcgccaaggcgcgcgacaagtccggcgcggtggatgacggcggcaagtccgcaagcaccgcgaagaacggcaaggagggcaagtgatgaccgatatcatgaactcgccggccgtgaaacaggtcatgaaacaacctgggcacgtctcggcggacggcgccgcacaggcgcagggcgagcagccgatccgcgcagcggtggtacgcgcggcggaactcgcgcgtgacgctgaatccaacgcgcgcacccgccagcacgccaagggcaagatgaccgcccgcgagcggctcggactgctgctcgacaccggctcgttcgaggagatcggccggttccgcggcggcgacatcaacggcggcaaggccggttcggccgtcatcaccggattcggtgacgtgtacggccgcaagatcgccgtctacgcgcaggacttctccgtcaggggaggcacgctgggtcgtgccgaaggcgagaagatctgccacctgatggacatggcgctggacctgaaggtgccgatcgtcgcgatcgtcgactccggcggcgcccgcatccaggaaggcgtcgccgcgctgacgcagtacggccacatcttccgcaagacctgcgacgccagcggcttcgtcccgcagatctcgctgatcctgggtccgtgcgccggcggcgccgtgtactgcccggcgctgaccgacctgatcgtcatgaccaaggagaactccgacatgttcgtcaccggcccggacgtcgtcaaggcggccaccggtgagacgatcagcatgaacgacctcggcggcggactcgtgcacagcacgaaatccggcgttgcgcactacctcggcgaggacgaggccgacgcgatcgactacgcgcgcacggtgcttgcctacctgccgtcgaacagcgacgcccagcccccgatgtacgcctatgcggcgactcgcgcggaccgcgagaccgcgaaacgccttaccgacatcgtgccggacaacgaccgccagccgtatgacgtgctcgacgtgatccgctgcatcgtcgactacggcgaattcgtgcaggtgcacgagctgttcgccacgtccgccgtcgtcggattcgcctgcatcgacggccggccgatcggcgtggtcgccaaccagccgaacgttcgcgccggcatcctcgacgtggacgcctccgaaaaggtggcgcggttcgtgcgtctgtgcgactcgttcaacctgccggtcatcacgctcgtggacacccccggatacaagccgggcgccgatcaggagcacgccggcatcatccgccgcggcgccaaggtgatctacgcttacgcgaacgcgcaggtgccgatggtcaccgtcgtgctgcgcaaggcgttcggcggcgcgtacatcgtgatgggatccaaggcgatcggcgcggacatgaacttcgcgtggcccagctcgcagatcgcggtgctcggcgccaccggcgcggtgaacatcatccaccgcaaggacttcgtcaaggccaaggaggccggcgaggacgtcgacgcgctgcgggccaagctcgccgccgaatacgagcgcaccaccgtcaacgcgaacctgtcgctcgaaatgggcgagatcgacgcgatgatcgatcccgagcagacccgtcaggccatcgccgaatcgctgcgactgctcgccgacaagaagcgcgtgcgccgcaccaccaagcatcacggcaaccagccgctgtagtccatcccgccgcggcggccactccgcggcacaacagattttgagccgataccggcaatggcggctccgcacaatgtccaaataaaagaaggaacaccaacccatgtcagaccccaatttctttctcagtcggctcaacggcgaacctcatgcgctcgctttcggcggacagtccacaccctggccggttgcgctcgctgacctgaccaatgatccggcgctcgaagccacgctgcgcggccatgtcgccgcggcgaacacgatgctcgcccccgtggccgccgacctgcttgccaccaccggacgcgccgtcgacctgttcggcttcaagccgaccccggcacggctcggtgccgccgccgcggcgaccgtcagcgtcgaaggcatcgcactcactcagctcggcgcgctgatcgacgccgccggtctcggccttgacgtggcgaacaccgcccccgtcgccgtgctcggccattcgcagggcgtgcttggcgcgcacatggtcaacgtcatccgcaaggccggctccatcgaggccgcgggccagcagatcgacgagatcctggccatcgccgagctgatcggcgtggccggcacccgcaaggcgcgcgagctcgcgctcaccgcgcagcacgccggcgccactccgatgctgtctgtgcgcggcgccaccaagcgccaggtcgaggtgctcgcatcccgcgtgccgaacccgcgcggcccgatcagcatcgccgtcaccaactccagcaacaaccacgtgctctccggctacccggaggaccttgccgccttcgaggtcgaggccggcaaggagcacaagcgtcagcagacactgcgtgacgagaaggtccgcggcggcgcggtgttcgggcccgtcctcgaatacctggaggtcacgctgccgttccactcgccgctgatggccgatgccgtcgagcaggccgtggcctgggcgcacgcctgcggcttcaaggagacccgtacgcgcgagctggccgccgaagtgctgctcaaccacgtcgattgggcggcccgcgtcaaggcgatgctggaatcctgcgatccgtccaagctgtggatcgtcgacttcggcccgggcaacacgctcggcaagctcatcggcaacctgatccagggcaccggcgtcggcgtggtcgaagccaccacgatggccgagcgttccgcgctgtccaccatggaggacgagcccgtccgcacccagaactggaagacgttcgcgccgaaggtgttgcacactcccgccggcgacaagatccgcaccaagttcaccgacctgaccggcaaaccgccggtgctgctgcccggcatgaccccgaccaccgtggatcccgagatcgtggccgcggccgcgaacgccggctattgggccgagatcggcggcggcggccaggtgaccgccgacgtgttcgaccgtcatgtcgccgagctggagaacctgctcgaagaaggccgcacggtcgaattcaacgcgatgttcatggatcgctacctttggaacctgcagttcggcccctccggcatcgtgccgaagaagcgcgcgtccggcacgccgatcgacggcgtgatcgtctcggccggcatccccgagctcgacgaggccaaggcgctcgtcgcctccctgcaggcggacggcctgccctacgtcggcttcaagcccggcaccgtcgcgcagatccgccaggtcgtggcgattgccaaggccgtggcccccacgacgatcctgatgcaggtcgaaggcggttcggccggcggccaccactcctgggagtcgctggacgacctgctgacctccacctacgccgaggtgcgcgcatgcagcaacctcgtgctggtcgccggcggcggcatcggtacgccggagcgcgcggccgactacatctccggccagtgggcgcgcgcctacgacctgcccgacatgccggtcgacggcgtgctcatcggcaccgccgtcatgaccgccaaggaggcccacaccagccccgcggtcaagcagctgctcgtcaagacacccggcatcaccgacacgtcggccgacgccgacccgttcgcgcccgccggcgagaagtgggtgccgtccggcaagtcagtcggcggagtctcctccggcctgagccaccttcacgccgacatctacgaggtcgagaacgcctccgccgcctgcggtcgtctgctggtgcgcgtcatgaagcaccccgaagagctggaaagccgccgcgacgagatcatcaaggcgctcgacgccaccgccaagccgtacttcggcgacctcgcctcgatgacctacgtcgagtgggccgagcgtttcgtcgacctggtgttccccgtggtcgacccgacgtattcgctgcgcttcctgcacctgctgcagcgcatcgaagcccgtgtgtgcggtcaggaatccggcgagttcacctcgctgttcgccggcgtggacgatgtcgcctccgatccgaaggccgccatcgccaagctggaagccgcctacccgcaggttgccgaaatccacgtgaccccggccgatgtggcttggttcccggtactcgtgagcgaatatcccaagcccatgccgttcgtgccggtcatcgacaatgacctgctgcgccggtggggccaggatcagctgtggcagtccgaggacgcccgctattccgccgattccgtgcgcgtgattcccggcccgatctccgtggccggcatcaccaccgtcgacgagcccgtcgcccacatcctcggccgtttcgaggccgcggccctggagcgcacccgcgaactgcagtccggtgcctccaccgacgcctacagcgagctcggcggcgccgagagcgccgaagcgttcatccgcacctgcccgaatatctcctgggtcggccacctgaccacgaacccggcatacggaacgcaggtcggcgacgccaactatgagatcatcgaccgcggcgcttccgagcagggcgaggaatacgacctcgacatccatctcgacacgtactgggacaacgatccggacggtggcgtctccaagcacgccgtgcgcgacatcgtcatcccgttgacgctgcgcggcaccgaaaccggcctgctgccggtcgtcaaccgcgagcgcctggtcggcaacgtctacgcgatgctcgccgccaccgcaggcatcggcaacaccgccatcaccggcgacaagctgaccgacatgccgaagatcaccccgtccgacgacaaggccgcctacccgttcggcaccgcgtcggccacctacacgctgtccgccaacctcggctacgaccacgaggcggccaccggcggcgcgctgccgcaggacctcgcgccctcgcgcatcgcccccgacgcgctggtcggcccggcatggccggcgatctacgcggcgctcggctccgtgtacgtcaagggctacccggtcatcgagggactgctcaacgcggtgcatctcgaccacctcatcgagcttgaggagaccgaggacgagctgctgaagcacgtcgacgagaccatcacgctcaccagctgggccgaggactacttcgagtccgcgtccggccgcgtcgtgaccatccacgtgctgcacaccgccgccgacggcaccgtgctcgcccgcgagaccgagcgcttcgccattcgcggccgcgtctactccgacgtgctgccggccgacgcccccgaatacggtggcgccctcgaagccaagcaggaggacgactccgccgcagccacggtgcaggccacgcctcgccgtctgctgcgccgcgtcaccgtcaccgcacccgatgacatgactgcattcgcgcgtacctccggcgacttcaatccgatccacacctccacgcgcggcgcccgcatctccgggctcgccgccccgctggtgcacggcatgtggctgtccgccaccgcccagcacgccgtccaggcgctggacgacaagggtgctcactacgagatcgcaggctggacctacaacatgtacggcatggtacagctcgacgacaaggtggagatctccatcgagcgcgtcggcaaggtcgagcacggcggcatggcattcgaagtgacctgccgcatcgacggtcagctggtctcgcgcggcactgcgctggtccgcgcgccgaagtccgcgttcgtctaccccggccagggcatccagaaacagggcatggtgcttgacgagcgtgccaagtcgtccgccgcccgcagcgtgtgggagcgcgccgacaagctgacccgctccaagctgggcttctcgatcctcgcggtcgtgcgcgacaacccgaaggagctcaccgccaacggcgtgacctaccgtcacccggacggcctgctcaacctcacccagttcacgcaggtggcgctcgccacggtggcctacgcccagaccgcgcgtctgcgcgaggccggctccgacatctggccggcgtacttcgcgggccactcgctcggcgagtacaacgcgctgtccgcgttcgccgacatcatcccgctggaaaccgagctggaactggtgttccaccgcggctccaccatgcaccacctgatcgagcgcgacgcccagggccgctcgaactaccgcatgggcgcgctgcgtccgaaccagttcggcgtcaacgacgcgcacgtcaaggaatacgtcgagtccgtcgccaaggcgtccggcgagtttctggagatcgtgaactacaacctcgccggccagcagtacgcgatcgccggcacgatcgccggcctgaagtacctgcaggccgacgcgtcccgccgcgccaaggaatatggcggcaagccgccgttcatgctggtgccgggcatcgacgtgccgttccactccacgctgcttcgcaagggcgtgccggagttccgcgataagctcgacgcgctgctgccgcagtacatcgactaccgtggccgtctggtcgaccgttacatcccgaacctggtggcgtccccgttcgagatgacgaaggaattcgccgccaagatcctcgaagtcgtgccgtccgagcgcatcaaggccgctctggacgacccggcagtgtgggactcctacgccgccgacgaccagaagctcggccgtctgctgctcaccgaactgctgtcgtggcagttcgcgtcccccgtgcgctggatcgagacccaggcgctgctgttcaaccccgccaaccgcggtggtctcggcgtggaggagtacgtggaggttggtctcggcaactcgccgacgctcgccaatctcggctccaagacgctgcgactgcccgatttctcgggttgtgacgtgaccgtgtacaacgtcggccgcgatgagggccgtgtgtacatgaccgactctgattcgctggtgccggacgatgagccggaggagaccgagacctcggcgcccgctgctgctccggctccggctgcgcccgctgccgccgcgcccgccgcggctccggcagtcgtcgccgcgccgtccgccgctcaggtcggttccgccgtcgccgaactcggttccgccgtcagcggcccggtcgacgacctgccgttcaaggcgtccgacgccatcggtgtgctcatggcttactccacaaagatccgcctcgaccaaatcggcgcgaacgacacgaccgacacgctgaccaatggcgtgtcgtcccgccgcaaccagctgctgatggatatcagctccgagctgggtgtggccagtgtggatggcgccgcagaggcgacgctcacccagcttgcacagctcgtcaacaaggtcgccccgaactacaaggcgttcggcccggtactgtctgatgcgatccgtgaccgcctgcgcgcgctgttcggtgccgccggcgtcaagcccgcgcacatccgcgaacgcgtgaccaacgtgtggcagctcggcgaaggctgggttgccgccgtgaccgcggccctgctgctcgacacccgcgagggtgccagctcgcgtggcggtgatctggccaagctgcccaccggcgccgccgccaatgcggccgccgccgatcagctcatcgacgatgcggtggccctggtcgggcagaccaagggcgtggctgtctccaagccgagcgccggcggcgcagccggcggtgccgtggtggattccgcggcgctcgacgccttcgcggagaaggtcaccggtgccaacggcgtgctcgcctccaccgcccgttacgtgctcaacgaactgggcgtgacggctccggccgccgaacccggcgaggacgagaacgcggccgtcgtggccgccgtcgacgccgagctcggctccgactggcccaagcaggtcgagccgcgcttcgactcccgcaaggccatcctcttcgatgaccgctgggcatccgcgcgcgaagacctggctcgcctgttctacaatggcgaccagtctgtcgagtccctgagctttgtcggcgccggcagggacgtcgccgaccaggccaagtggttcgcgtccaagagccatggacagctcgccgacaccttcgaccgcatcgccaccgaggccctcgaatcggtcgccgacgtgcctgacgcatcccgcttcgcgaacgacatcgcagtggtgaccggcgtggctccgaactcgatcgccgcgcaggtcgtcaacggcctgctggccggcggcgcgaccgtcatcgccacctcgcacagcttccgtccgtccgtcaaggcgtgggcgaagcaaacctaccgcgagcacgcggtgggcggcgccaagctgtggctggttcccgcgaacctgtccagctaccgcgacgtggacgaactggtccagtggatcggcaacgtgcagaagaagacctccggcgcgaccaccacgatcctgaagcccgcatacgagccgacgctgttcttcccgttcgccgccccgccggtgcacggcacgttgaccgactccggcgaactgttcgagtcccaggcgcgactgatgctgtggggcgtggaacgcgcgatcgccggcctatccgccatcggcgccgacaccgacgtgcagcacaagctgcatgtggtgctgcccggctccccgaaccgcggcatctttggcggcgacggcgcgtacggcgaggtcaagagcgcgtttgacgcgatcgtcaaccgcgcccatgccgaaaaggtatggtcgtctcgtgtcaccttcgcccacccgaagattggctgggtgcgcggtaccggcctgatgggcggcaacgacccgctggtcgaggtcgtcgaacgccacggcatccacacgtactccaccgaacagatcgccgtgaagctgctcgacctgtgcaccgcggaatcccgcgcggaagcagtcgagcatccgctcgacgtggacctgaccggtgggctcggcaacgccccgatcgatatcaaggcgctgcgcgccgaggcgatggccgacgcagagaaggccgcggcttccgcacagcagtcggacgacgactccacctccgcgaagaccgccgcatccggcctgagcatcaaggcgctgcccagcccgcacgtgccgcagcaggcgccggtcgacctggccgactggcagaacgtcaccgccaagcccgaggacgagatcgtcatcgtctccatcggcgagctgggcccgtggggctccggccgcacccgcttcgaggcggagctcggaatccactccgacggcagcgtcgacctgtccgccggcgcggtgctcgaactcgcgtggaacatgggtctggtcgaatggcaggacagtccgaagccgggttggtacgacaccgacggcaacctcgtgcccgaagaggacatcgccgaacgctaccatgacgaggtcgtggcccgctccggcatccgtccgttcgatgaaggcatgggcaacgactacaaggacggcgccgacgaagaggagaccgaggtcttcctcgaccacgatgtcaccttctccgtgcccaccgaggacatcgccaaggaatacgtcaagatggacgaggcgcacacctccatcgcggccgacccggagtcgggcgaatggaacgtcacccgtcacgccggttcgatgattcgcgtgccgcgtcgcgccacgatgacgcgcacggtcggcggccagttcccgaagggcttcgacccgctcaagtggggcatcccggcctcgatggtcggcgacgtcgacaagatcgcgctgtggaacatcgtcaccaccgtggacgcctacctgtccgccggcttcacgccgaccgaggtgctgcaggccatccatccttcgatggtggcgagcacgcagggaaccggcttcggcggcatgatgtcgatgcgcaagctgtaccttgaccgcttcctcaaccatgagatcccgaccgatatcctgcaggaggccctgccgaacgtggtggccgcgcatgtgatgcagtcctacgtcggcggctacggcaacatgatccagccggtctccgcctgcgccaccgccgcggtgtcgctggaggagggcgccgacaagatcgccctcggcaaggccgacttcgtggtcaccggcgcgattgacgatatcggcgtggaatccgtgatcggcttcggcaacatgaacgccaccgccaactcggaggagatgtacgcgaagggcatcgacgcgcgcttcttctcgcgtgcgaacgaccgtcgccgcggcggcttcctggagtcccagggcggcggcacgatcctgctgacgcgcggtgacatcgcgcttcgcatgggtctgccggtcgccggcgtagtcggcttcatccactcgtacgcggatggcgcgcacacctcgatcccggccccgggcctcggcgccctggcggctggcctcggcggccgcgactcgaagctcgtgcacgatctggccgcgctcggcgtcaccccggacgacatcgccgtggtctgtcggcgagctccacgggaggctcatcgccccacgactcgctgtcgaccagcagatcagcgtaatccagctgcgcgtcgtagcacatgacgacgttcttgcgcggccacggccaccagtggttgatgctcgccgcaccccacgtcaccgcgcagaacagcggcacctggtatccgagccggcgcgatgcctccagtgcgatcacgccgacgccgttcttcatgctcatcggccatttcttcgggtcgcgggtcaccgtgccctccggccagacggtcagcgggcggccgctcgtcagaatctcgaccgaggtctcctcgatggcccgtgccttgccggaccggcgctgaaccggctgcatgcctacaatctggaaccacttgccgatcagaggccagtgcgccatctcggccttcgccatgtagcgcgggcgacggcccatgtggaacagcgacgccatcggcacgaacacgtcgaacatggtcacatgcgtggccgcggtgatgaacgggccggtttcagggatgttgtcgagcccccaggcgtacgtcctgcagcttgcgcggaacacgacatcgacgcccttgagcagccgtgaggtgcccttggggttctgcgcggcgatttcggcctcgttgatcgtgcgatcagggccggtcggcaggtcgcgcatcggatcgacgagcgtgtgcgccttggcgagcctgctcacttgtgcattggacagcggcttgaccgcggaacgcggtgacggttttcctttggatgccatgagagccattgtacgtgcgtggcatgtcgtggcacaaatggtgccggcaacgcaaaacggcggccggaaaaccgaccgccgttcatgcaaacaacgtctgacgacttactgaagcttctccacctgatggaagccgagttccaccggcgtgtcgcgcccgaagatggaaaccagcacggtgagcttctgtgtggtgggttcgacatcggagacgacggcggccatcgtggcgaacggcccgtcgatgacggtgacctgatcgccgacggcgtaggacacctcgacaacgcgcttcttggccgcggcaggcttatcgccggccttcttgagcgcttcggaggcgatcatcggcgccagcatggcgacgacttccttgcgggacagcggcgccggatccttggtcgggccgacgaagccggtcacgccttcggtctcgcgcacgatacgacgggcatcctcgtcgggccacatgcggatgagcacgtagccgggaatgcggacgcgggtgatgaccttcttgcccttgtcggtgtgcttgtcgacttcctccatcggcacttcgatctggaagatcttgtcttccaggccaaagctagtgacacgggattcgacgttcgtcttcacgcgcttctcgtaaccggaataggtgtggagcacataccacttgccttccagggtgcgcagcgactttgagaactcctcaacggcctttgcgcccgcgtcgagctcttcggattcctgctcgtcggcgtcgccggacgcttccgcatcgttttcgacggtgtcggattcaacggcgtcatcagccgcggcgggctgttcttcggcattgtcattgatggaatcaaccgccgcgtccgcaaccggatcggcttcaacggccgtgccggccgaatcgggaagatccgccagtgcgtcgaggttatcgagattcacttcatcagtcatgcgtaactttcaccttcagggtcgatggatcagccgaacacccacagcacgagcttgcccagaccgaaatccatgcccgtgacgaggagcatcagcaacacgacaaagatgaacacgccaagagaccagaagaacagttccttcgcagtgggggtgaccaccttgcgaagctcatcgataatctgcttgatgaacaggccgatgcgcatgaatacattcggcttgaccgctttctccgcattgcttgccttcgccatgttcatccttttgtgtgttggttgcaaatacttggcagggaaggcgggactcgaacccacaacctacggttttggagaccgttgcgctaccaattgcgccacttccctaggtgaactttgcccactgtacccggcacgcaagactacgtgtccgttacttggcaaaaccgccaagaggccatattagcggggattgccgatttcgtccaatcgcgtgtctcgaccggcgcgtaatcggcgtgccgcggcgtgcgcggcagataccgcgcacgacctcttgcaacggtttcagccgacccagcggcggaaccggcgcatgccctcagcgagctggtcatcggccagcgcatacgagaaacgcaggtatccgggggcgccgaacgcctcgcccggaaccgcggcgacatgggcctcgtccagcagcgccgcggcgagttcggaagacgtgttcacgacggtgccgttctcgccgagcggcttgcccagcaggccggtcacatcggggaacgcatagaacgcaccggtgggcgtcgggcagtggacgccggggatatcgttcagggcggcgacaatggccttgcggcgggcatcgaatgactcgcgcatcatatgcacctcgtcgagcgaacccgcgacggcggcgagcgccgctcgctgcggaacgttggaaacgttggagctcaaatggccctgcagcttggcgacggccttggcgacgggcgcgggggcgaccatccagccaactcgccagccaggcatcgcgtaggtcttggcgacgccgttgagcaccagcagctggtcgcggcattcggggacctcgacgccgacgtatgcggtcttggcgccgtcatagttgaggtgctcgtagatctcgtcggagatgacccacacgtggtgctccacggcccactcgccgatcgcgcggatcgtctcgcgactccacacggcaccggtcgggttgttcggggaggtgatgatgatggccttcgtgcgctcggtccgagcggcctcgatggcggcgatgtcgggctcgaaaccgcggtcggcgccggcgaacacctcgaccggtttgccgccggccagcttgacggcctccggatagctcgtccagaacggcgtgggaatgatgacctcgtcgccgtcattgagcagcacctggaaggattcgtacacggcctgcttgccgccgttggtcaccacgacctgatcggcggtcacctcgtagccggagtcacgcagcaccttggccgcaatcgcctcgcgcagctcgggcaagccggcggtgggcgtgtacttgtagttgcgcgggtcgttgcacgccttgacggcggcatccacgacatccgcgggagtcgggaaatcgggttctcccgcgccgaagccaatcacgtcgacgccggcggccttcatcgccttcgccttagaatcgacggcaagagtcgcgctcggtgccacattgttgatacggtcggaaaaagtctgccagtcagccatagtcatgccatccatgctaaacccagagcacgaaaaaacaacagaccccgactacgctcggcacggcggctctcgttgcgcgacgaatcagaccagcacgagattgtcgcggtgcaccacggggtgagcgaactcgtcgcccaggaaccgcctgagctgcgcggtgttgcggccgagcatctgcgggatctcctcggagtcgaagcccgcgagcccgcgagccagatgcgcgcccgcctcgtcatcaatccacaccgggtctccggcggagaattcgccgtgaacctccacgacgccggcggcgagcagactcgcgcgcccgcctcgaaccgccttggccgcaccggcatccgccaccaaggctccacgcgggtcggacgcgaagccgatccacagccgacgcgatgaaccgcggtgcttcaccggcgcgaacaccgtgccgaccggatcgcccatcagcgccgggccggtgttcgtcgcgctcgtcagcacggcgggaatgcccgacacggccgccacgcgggcggcatccagtttggtgaccatgccgcccgtgccgaccccggacgacgaaccggcgacctgcacgtcgccgatcgtgtcgatcacattcggcacaaagccgatgcggcgggcgcccggcgtgctcggcggagctgtatacaggccgtccacatccgtgagcaacaccagcgcatcggcccggacgaggtttgccaccagtgccgaaagccggtcgttgtcgccgaaacggatctcgttgctcgccagcgaatcgttctcgttgacgatcggcaccacgccgagttccagcagacggttcagcgtgcgctgcacgttgcggtactggaccgcgcggatcgtgtcttcggcagtgatcagaatctggccgacccgaacgccgaaacgaccgaacgcggcctcatactgcgccatcagcagcccctggccgaccgcggcgacggcctgctgcgtcgccacgtcactcggacggctctcgaagccgagcgggccgaaacccgcggcgatggcgcccgacgacaccagcaccacgcgggcgccctgcgccgaggcggcggacagcgcggccaccagggagttcagcttcttgacatccagatgcccggacggctgcgtcaacgagctcgaaccgactttgacgaccatggtccgtgcgcctgcgatggcgcggcgcacatccgattcagtgacggacaacacgcactcccttcccgatcacgtatatcttgaatcatcacagacgccggtgtcataggacgccgccgttccacgctgcggccgccgcgctggtggaaccgcagacgaatgtgccagccatcctcagtcgctccgcgccagcccccgcgggcgggggctggcaatgaagctgactgggggtggccaggcgtcaggccaggccgccgtcattctcgtcgccgtcctcgccgcgaccgaacaggctctgctcgtcgtgacggtcgtcgtcgacgctcggatcggcccagtgaccggcctgacgttcggccatcatggcctcgcgcaccgcggccttggcgtccatcatctcgtggtactgacgacgacgctccgcattggtacggcgacggccgcccggctcctgatcctcaagacgcagatcgcggccgcgggcacccagctgagcgccgtcaagcatctccgcgccggcggcgatggtcggatcccaatcaaacgacacggcacgctgccccttgccgatacgcacctcgtcacccggcttcgctcccagccggcgcagctcgtcctcgacgccaagcttggcgagtcggtcggccagatagccgacggcctcgtcattgtcgaaattggtctgcaccacccaacgttcgggcttcgcgccggtcacctcgtaccagaaaccgccatcgccctccttgcgggccacggcgaaatcggcagtgccgttcgcagccgcacggcgacgattcgaccgatcctccaacggattgatgacgacacgcgcctcctcctcggcctgctcgcggctggcgacctcctgccgcatgtcggcgaccatggccgccagcgcaaagttcagctccttcagcccctcatgagaagccgtggagatctcgaacaccttcaatcccatacgttcgaagtccgggcgcacgaaatcggcgagctccttggcctccggcacatccaccttgttgagcacgatgatgcgcgggcgttccggaatcgggatggcgcccagcggcagttccagcttgtcggcgtattcggcgagctcatgctccagcgcatggtagtcggaaaccgggtcgcggccaggctccagcgtcgcgcagtcgatgacgtgggcgatgatttccgtgcgctcgatgtggcgcaggaactccagtcccagacccttgccctgcgatgcgccgggaatcaggccgggcacgtcggcgatggtatagcggtggtcgcctgcgacgacgacacccaggttaggcaccagcgtggtgaacgggtagtcggcgatcttcggcttggcggcgctcatcgcggcgatcaggctcgacttgccggccgacgggaagcccaccagcgctacatcggcgatggatttgagctccaggatcacgtcacgttcctcgcccggttcgcccagcagagcgaaacccggagcgcggcgggtcttgttggccagcgccgcgttgcccagaccgcccgcgccgcccgcagccgcgacgaacttgtcgccgttatggcgcagatcagccagctgctcgcccggacgcttgggacggccttgagcgccgaccgcggcgaagatcacagtgccgagcggcaccggcaggatcaggtcggcgcccttggagccgtccttgacgtcgcccagacccatcgtgccgtcgccggcgttgcgatgcggcatgaaccggtagtccagcaggctggtggcgttcgtgtcggccacgaacactacggaaccgccgttgccgccattgccgccgttcgggcctgccaacggcttgtacttctcgcgcctgatgccggcggatccattgccgccgtcgccgcccttgacatgaacggtcactctatccacaaaatcactcataacgctctaccttaccttgacccccggttctccccaggttcgctcgctccgcccgcagcggagcagctccggtcgctctgccccccccaatccgtgcggaggtcttcacaagtgctcaaattacgggttgagatagccgattccggcaattccccgtgtgaaatcgccgttttcaggccccaaaacgaccatttggcacgggggattccggataacggctatttcaccccgtaatgtaccggtgtaccagaggagggtggggtggctcctcggagagtgatgtggtgcctgatgagggaggcgcggtaccggaggggacgcacgggggttacaacacatgacgcgggaaacacgatacatgatgagagggcacggcacatgacgcgcgaatgtgggccgtcgccgcctatgcgcaatcgaatggatgccttgcactccaccgtatgctccgccatcatccggatttcccggcggaataggctcatcgcgaattcgcagatgtcgcgagcccagaccccctacacttggcatatggggacgcatcattcgctggacagacttttcgccgttgcacggcaggagcgacgctgcgccattccctccaccaacacggacatacaggcaatacgcaggagagtgaagaccggcgccgtgctgagagtcttccgcggcctgtacgcagagcccgcgtattgggaatcgcttgatccgcatgaacaggttcgccatatcgtacgagcgctcgccatccaacatcctgattgggtgttctgcggtcctacggccgccatcatgcacgggctcgactgctcctatcggctggcattcccaatctgcatcgtcgcgagccccggcgcgcatcatcaggacaccaggcacatatcgcatcacgcgatcacgcatccggacatcaccgtggttcagggagtgaaggtcatcagcttgctgcagacactgttcgacctcgcggcatgccagcctctgcgctacgccctcgggccagcggattgtgcgctccgcaacggcctcgtgagcgaatccgtgctccgggcgtatccctccagcgtgaaatactcacgcaaccgcgccgccgtcgagcgcgcgttcgcgcttgcagatcggcgtgccgagaacggcggcgaatccgaggcccgcggcatgttgcatgatgccggctgccctcctgacgacattcaggtggaattcccctgtctcgatcatcccggtcgtaagcatcgcagtgattttctctggaagcgtgaagacggctcggtaatcgtcggggaattcgatggcgttcgcaagtatgtggatccgcatatgacttcaggccgggaaattcgcgaagtagtggatgaggaacggaaacgccagcaatgcatgtcgcagtatgcgatcggcatggtgcgcatgtactacagggatcttgacaatccgggacgaatcgtccggcagctcagagatatgggcatacaaccatgacacgcgtgatgtcggggcgcgcgccgcactcgtaacccacacatgtgggccagcaggcataagcccggaaaggccgcgtgatcgcagcgacaccattccaagccccgataagcgccgccatgcgccaaaacacgggttgaaatagccgttatccggaattccccgtgccaaatggtcgttttggggcctgaaaacggcgatttcacacggggaattccggataacggctatttcaccccgtaatgtaccggtgtaccagaggagggtggggtggctcctcggagagtgatgtggtgcctggggagggaggcgtgacatcgcatggcacaggcgtgacggctctgtggggatgcgccgtgcggtgcgggcatgccgggaatgcgctagggcggcaaacaaaaaagccgcacccgggtgggatgcggcttgacgcttaatgcggtattgctcaggcggcgatgacgtcgacgaccttgcggtcgtgacggacgccgaacttcacgctgccgtcggtcagcgcgaacagggtgtgatccttgcccatgccgacgttctggccagggtggaagttggtgccacgctgacgaatgatgatgttgccggcgacgacggcttcgccgccgaacttcttgacgccgaggtactgaggcttcgaatcgcgaccgttgcgcgagctggaagcacccttcttatgtgccatgattcagatccttcctgtattggctcaggcgatcgccgtgatcttcacggcggtcagcttctgacggtgacccttgcgacgagtcacgccggtcttgttcttgtacttcatgatgttgatcttggggcccttggcctcgtcgtcaatgacttcacccttggcggacaccgcggcgagatccttggcgcccagcgtcaccttggcaccatccacaaccagcgcgaccgggaattcaacggtctcgcctttcttcgcctcaagacggttgacgagaatcacgtcaccgacctcgaccttttcctgatggccaccggccttcacaatcgcgtacatgcttcgttccttgctatggtgttataaaagctacttgcctgacgcacgcaagccgctggtcagacaccagcaatctaatctacactgacccatgtactaacgcaaatcatatttccggcgtgtcaggttgacacaccggaaatcatgattcattcagcgcgtcgggtcactcatcctcgtcggtgccgttcgcggcgaccgccgcggcggcgatctgcgcgagcttggccttgatatccggcgaggagccctgcggcacctgcacatccgtaccgcggccgtgcttgttggtcttgatgaacggatcgccacccttgagcgcatacggatcgtcgtaatccgcgctgacggtcggctcgtcatgcaagatgaacccgcggccatggcaggtcgggcactcctcggagaacgcttcgaccaggccctggccgatgcgcttgcgcgtcatctgcaccagacccagcgacgtgacctccgccacctgatgcttggtgcggtcacgcgccaggcattcgaccagacgccgcagcaccagatcgcggttggcgggcatcaccatgtcgacgaaatcgatcatgaccatgccgccgatatcgcgcagacgcagctggcgcgcgatctcctcggccgcctccaggttgcatcgcgtcaccgtctcctcaaggctcttgccgcggccgatgaaccggccggtgttcacgtcgatcgtggtcatggcctcggtgcggtcgatgacgatcgacccaccggaaggcaggtacacctgacgctccatgcccttcctgagctgcgcgtcgatctgccacttgtcgaacacgtccttgccctgatgctcggacggatcccacttggacaacttctccttgagatcgggcgccatcgtgtcgaggtattcctcgatgcgctcgtacaccttgtcgccctcgacgattagctcgccgaaattgtcgttgaagatgtcgcgcaccacgcggatcgcgacgtccggctcgccctgcagcagcttcggccgcttgccgtgccagaactcctcgcgcttggcgttgatgcgctcccactggcggaccaggctctccagatccttgacgatcgcctcctccttggcaccttcggccgcggtgcggataatcacgcccatgtccttcggcgcgatcttcgagacaatgcccttgaggcgcgaacgctcgcgctcgctcagcttgcggctcacgccggtcatgccgccggacggcacgagcaccaggaaacgcccggcgagcgtgacctgcgaagtcaggcgagcgcccttgtggccgatcggatccttggtgacctgcacgagcaccgggtcgccagatttgaacgccagctcgatgcggcgcggctgcccttcgaggcgggtcgcgtcccagttcacctcaccggcatacagcacgccgttgcgggactggccgatgtcgacgaacgccgcctccatgctcggcagcacgttctgcacgcggccgaggtagatgttgccgaccgtggcgacctcctggatgtcggagacgtaatgctcgacgagcacgttgtcctcgatgacggagatctgcgtgtgatggccgcgttcgcgcaccaccatgagacggttcacgtgctcgcggcgcgcgaggaagtcctgctcgaccagctggctctggcggctgcgctcgcggcggttgtcgcggcggcgctgcttcttcgcctccagtcgggtggagccctcgacgtcggtgatctcgtcgatgtactgctgcttgcgcgagcggcgcacggtcatctcatcgtcaccctgctcgtcggacgcgcgggagcggcgacggcgacggcgacgggtgacgttggagtcatcgtcttcttcctcgtcgcgtgtgcggcgggacgacggcttggctggctcatcctgctgcgccgcggactggctgctgtccgactcgccgttgccgcggctgtcgtcggcacggttctgacgggagcggcgacggcgacgggatctcgtgcccgaatcctcggagggctcctcgtcgtcgaccggcgtataggagatgccgtcgagctccaggtcctcctcgatctgctccacttcggcggccgcacggcgctcctgcgcgttcaggcgacggttgcggcgcgacgaacgcaccggctcgtcggcctcgccggattcgtcacggctgcggctgtcgtcggtatcgaagctgtcgacgcgctcgatgtggctcagaccgtcgatatcgcgacgggaggaagcgctcttgtccttgtccccctgcgcgccgtcacgtgacacacgaccattgcgcgagcgacgggacttgccaccgccgcggctgtcgcggtcgtcatcctcgcggtcgtcatcgcgcgcgtcgcgcacgatttccggcacgggcagcaccggctcctggaacagcacggacgtcatcgcgtgagcgcgcggcgcaggttgcggcagcgtgctaacgacatccagggcgcgggacagatcggcggaatcatcgcggacgatgatatcggtgccggtatcgacgccgaggtcgtcatccgacggctcgcccggaacggccggcgaagcgtcctcgcgcgaggagaacatggcggtgcgacgacgcacgcgggtgcgccggggttcggcctgatcggcgtcatcgtcatggcgcttcgtcgctttcgaggagcgcgacgcggaccgagacttgccgtcggccttggcgtgccgcgcatcatccttcttttcggaatcggccgatgcggcggtctccggctcgttggcctccggcgattcgtcggccgccttcgagcggcgacgacggggaaggggctgctccaccacgggttccgcgaacagcggagcggaatggtcctcgaccttcagcgcgaccgcggcaccggcggcaccggcgccacgaaccacgcggcggccaccgcgacgacgacgcggcgccgcaggcgttttatcggccgaatcaggcgactgggccgcatcggcgtgggtaggctgctgttcttcggtttcgtcacgactgaaaccgttatcgttcacactaggcacgatactcctcacgacgtgctgcaccacgtcgcacactcatggcctcatgcggtctcacaccacgctctcaccgtggccgcgctacgcttgcgcccgcaggaagcaaatccgttaaaagtccgtgtgcgtgcttcggcggacaccagcgctcgcgcatcttcatgcatgcgaggggatcgacgcctttcacgctcaggtggtttgcagaaccaccatctttaagtatggcacacaatttgaccggccatgaccatctcaccatattcaacgttcttttggcgtggcgacaacgctcagcccatgcttgtacgcagacgctttcgctccgcgaacggtgtcaggatccgtatcatcgtcaccgatgcggacggcgacgacatcgtcgacaaaacctgcagcgccaactgacagcgttgtgcgggcagccgtccgcacactattcgatggcacggatgccgacatccgcgcccgaaccccgctcacgcgcggccggtgagccagtcctccaggatgccggccatggtcgccaactcgctttcggcgatctgctcgtcatgcttgtgcgcaagcagcgggctccccgcgcccaggttcaccgcgggcacacccagcagcgagaaccgcgcgacatcggtccacccgagcttcgccagcggttcccgtcccgtacgctcacgcaccagcttcgccaacgacaccaccatcggcgcgtccatgcccggccgggcggacggcgactcgtccttcatctcgatgccgaagccctcgaacacgccaccggtggcgacatgctcgccattgccgagctccgcgccggcatccgcgcccatcatcagtgtcttcgcctgcggcagcgtcttgtcgggcgcgaaccggtagttcacatggacacggcattcgtcggggatgacattcgtccccttgccgccggaaatcagcgtcgcgttcagcccctcgcgataatccagcccatccaccgtgatggtgcgcggctcgtaggagttcaggcggttcaggacatcggcggccttgtgaatggcattctcccccatccatgccctggccgaatgcgccgcgaccccgtgcgtgaccacgtcgaatcgcatggtgccgttgcagccgccctcgatgccgcagtcggtcggctcgccgatgatcgcgaaatcgccggcgagccaatcgggatgcgcctcggccaccttccgcagaccgttcttctcggccgcaacctcctcatggtcgtagaacacgtacgtcaggtcatattgcgggtcgaccagcgtggcggcgaggtacaggaacaccgcgtcggatgctttcatgtcggtcgcgccgcggccccacatcacccgctcgccggggtgcgccgcggcgacgtcctcccggatcagcgggtcgccgggcaccagccagcgcggcgggaagttgtcgatcaccggaaccgtgtcaaggtgcccggcgagcaccacgcgccgaggcctgccgagcgacgtggacgcgaccaccgtgtcgccgtgcctgtgcaccgtcaggtgcggcttcgaccgcaggaacgcctccacggcgtcggccagcggcttctcgtcatcgctgacggaatacgagtccatgatctgttcgagcagtgaggcgagcgccttctcgcgcgtgccggtcgtgtcgcaggtgatcggcgcgatcgccgagcgcgggtcagcaccggccgctgccatcgtcgttgtcgtagtcatgctgaccatcctaacggcagcacgtcccgtcggagcccgttgccgggccggaatgagacggtcgaactccccgtcggcggcgagaacaagcgcgcgacgcgcagcatgccgtgctaccgtggctcgcgagacgggtttcgcctgcgttatgagacagaacctcgcgaaacacatgcgtatggcagtatggggtttgccagcaaacggaaaagggatgggaatatgccgggtctattaaatgcgatggaaggcttctgcgtcatcggcatcgtaatcggagtcggatatgtggccgctcgaatgcgcataggcgggccgagcgcccagatggtgctcaaccgtttcagcttcttcgtgtccagcccgtgtctgatgttcgcaattctgtcgaaagagccgatcttcgagatcttccattcgtcgatcatcgtggcgttcttctccgctgtactcgtcggcgcgctgttcctggtgctgaacaagctgttcttccacttggggccggcagacgcgaccgtcggcgcgctgaactcactgtatctgaactcgaacaacatcggcctgcccatagccacgtacatcctcggcaacggagccctggtggcaccgatcctggtcatgcagcaggcgatcttcacgccggtcggcctgacggtgctcgacgtgaccaccaagggcaaggtatcggtcaaggaaatcctgaagcagccgctgcatcagccgctgctgatcggctccctgggcggcatcctggtttcggcgatcgacgcgaagatcggctggttccccgtgccgaacttcatcttcgatccgattgacatgatcggggactccgcggttccgatgatcctgatggcgttcggcatgtcgctgcacggcaccaagccgctgcagcagaagggcgaccgcccggcgatcttcaccgtagccgtactgaagaacatcgtgatgccgatcatcgccttcctgctctcctatttcgtcatgggattccgcggcgcgacgctgtacgcctgcgtggtactggcggcgctgccgaccggccagaacgtctacaattacgccgcccggtacaacgttggacttacgttcgcacgcgacggcatcctgatgagcacgatgacgagccccatattcatcgcggttatcgccgctctgctgagttgacgctctcaaaactcgcagataggggggccttttaacgagaaaggccccctatctgcgagttttgagagcgtgcgatcagtcgtcggcacgccagtcggtgagattcaggctggcggcgacacggttcgaggcgaatgcgccgacggagaccagcgcataacacaacgctatgccgccgaagaagctgagcagcgtggcgggcttggtcatggatgcggcgaacagcgggaacatcagcagcatcgagcagccgccggcaacggccaccaccgtgttgagcggggtcagcacctcgatgaaacgcgcacggttcaacgttttcacgtccgtcccctccaacaccagcatgcggtattcggaaacctggtcgtagacgctgcccgcttgcatcactccggagctgacggccgccagcacggccgcgaatccgagcgtcagcaaccctccggtgccgatgtcgcggatgaaagccagtcccggttcgggtacgccttcgacaggcgcggtcgacgatgcgccgatgaacccgcagatcgaggtgatgccagcgatgaacaccgccagcgcgatgcccgacacattgcgccatgcccgcttgggattgtcgaggatgcgccgcatcgcgatcatcgtggcggcgtccttagggcggcgggaccgcaacctcgcccgtgcggtcaccacccatgagccgatcaggttcactagagcgaagcacagcgcgatgaacccgataatcaccgcatacatcgtcacctcaccgtaatgcagcaggccctgcgggttcttgaacagcacgatcgcggccaccagcacgaccaggaacacgattacgcgccacttcgtgggcagcggctgggcggtccgagcggtgacgcccagcggggtgatggcgacccgacgcagcgtcagcaatgcggagatcagcgccaggaccgtgaccaccaccagcacgacgatcagcgacagggatcctacccacaactgctcgaacgtgaacctctgatcctggaaattcagcagcatgatcagcggcatgatcgcgaaatagccgacgatgccgatcaacgcgccgatgagcgcctgtccggcggcatccaacgcggtcagtctggtcacctgactggtggtggcgcccgcgaggcgcagtgccgccaatcgcgcgtcccgccgcgatgccgccaatcgcgccgccgagccggcgagcgccacgaacggcacgatcagcagtatgcaggcgaaggccgccagcatcacgtacgtgctggcgtattgcgcccagtcgtgctggtccttgagccgtccggcccacaccgcccatgtgcccggcgcgcaggtcgacctgtcaatcaggcatttcagcgtatggtcggcggacgcgcgccagatgaacccgtgcacgccgcccagcacggtcaggaagatggccgtcgccgccgcgaacgcgacgatggccaacgccgatgtgtggccggaaccgccgcgccggcctgggcggtggaacagccgccatagtgcgaacgtgctcattgggcgcctcctgcgggaactgccgggtgcagcgagactgagggtggttcagcgctctcgggccgcccccagtcagcctgcggatgccgaaccccgccagcgggggcaaggccggcttcggccgtctggctgaggcggccgtcctgcatcgtcatcgtgcggccgcagaagccggcgacgttgggatcatgagtgacgatcaccacggcagcgccattatcacgcgcggcttccatgagaatgctcatgacctcgcggccggtggcctggtcgagcgcgccggtcggctcgtcggcgaagacgaccgccggctgtacggcaagtgcgcgggcgatggcgatgcgctgcatctgcccgccactcatctcgccgggccgctgcgaggccagctgccgcaaacccagccgttccagccacagcatcgccgcatcggtggcggaacggtagtcggcgccgtccagcatcatcggcaacgcgatgttctccaccgccggcaactcgggcaacagctgtccggattggaacacgaagccgaacgcaccgcggcgcagtttggtccggtccgcgtcgctcatcgcggtcagattcgcgccttggaaggtcaccgtgcccgacgtcgggcggatgatgccggcgagcgcgtgcagcagcgtcgacttgccggaaccggacggtcccatcacggcgaccgtctcgccgggagccaagtcgaagttcacgtgattgagcgctagcgtatgcacggcgggcatggcgtagccggttccgccggccgcatacggatgggggccgccggttccggcgcctcgcggcatcacgccggtgacactgtggtccgcctgcacacgggccatgcctgcggtgtagtccatgaccaggtcacgggcctcgatcaccggtgtccacgactgagaccgggcgcgggactgagattgcgatgttgctgtgttcatgcctccgagattacgcaggcggcacgcgaccggccatcgggcggcggtatgagccttgcggcgaaccggttctcccctcatccggaaggattaggggaagagagtggtggcactaccctgagcgcccacagggccgtgattgcagggcccgaaggtctgtcgcgaagcgagactaaggcccccagtcgctcgtctgcggtacggctcggcagccgtgaatatatattgcattatatcatgtagtactatgcgtaatataatgcatattttgttgtgattaaggtggtgacttacatggacatcaaggaacgtgcggaggcgttacgagagatctccacgccgggctctcgcatcgggttgaccgagttgtcccgttcgaacgcatggcgaaaggcgctggagcagcggggattgctggaaatcgtcgaccgcgccgacacagccggctatctggtgtccgtggactctctcaacgagatgctggatgtcatcaatgcgctggaatccgaggtcgaacacctcaccatacagcagatgttcaccgcccgaggcgataaggaacaatgggagaccggctccgaactgtcacagtcggcgcaggaaagcctgaagcggcgcaaggagaagattcacgcgttcctttatggcggtcgctgatggccgccgactacgcattattggagcaagccattgccatcatctcgtccgtccgcggtctgtatatggatccggatgcacttgcggatgatgtgattcttctggcatatgtctggcccgacgaaggcgaattcaagatggcggtggccagagttcaccgaaccctgacacagctcgtggagggcaacgtagaaggaagccctctcaagtacggtttcagcgggtggcgttccttccacttccaacatcgacgaggccaacagtcgcgcgccgacatgcgcatcgtgtatatgcccctcgacacgggaattcgcgtcaaaggattcggaaaccgccaccttccatccgacgacatctaccagcgtttggcgcaactgcagtaaccgtcacgaacaccgtgcggcagcggccagcgcgtgcaggcgctcggcgaagcgcggccagtctgtgcgcatcgcggtcaagagcttgcggtcgggcacttcgtcgatcggcacccattcgatttccatgctctcgtcatcgttcgcccgcggcacgacccggtgaccgggcttctcgaacgcgaagaccgtggtgtacgcccatggcccgtgatcctcacggtaggacccgaccacctcgatgtcttcgggcgtgatgttcgcctcctcgtagctctcgcgcagcgcaccctcgatcgggctttcaccgtcggccgtcgcgccgccgggaatgccccatgtgccgccttccgcgctccacgcggcgcgatgctgcatcaccacgctggtcacttcgccgctcttggggtcacgccgcgcgagcagcacgccggaggcaccgttcaatccccagtgcttgcgcccgcatgcgcagtcgatccagccgtcgccgggctgatgcacgttctccttgggcggcacgactccgccgcctccggtcttgtcttcgggcgccgattccccgcgggccacgttccacaggtcggtccagtccacgccgagcttgccgacgagtcggcgaagcagcggcagactgatgccgatgatgccgtgcgggtcgccgtcgatgccatcgatgaacgcgccgccaaaaccttccagcgtaaacgatcccgcgacttccagcggctcgccggtggcgatgtatcgttcgatgtcgcggtcgctgaactcgccgaaccgcacgacggcatgactcgcgccgcgctcgacgcgcccggacgcgaagtcgatcacgcagtgcccggtccacagctcgccggtggcgccgctcatgcggcgcagtcgctcacgcgccacctcgacgctgtgcggtttgccgtagcattcgccgtcaagcaggaacatcgaatcacagccgacgatcagcgggccgccgctcgcccgagtgagccccggctgcatggcaatcacattggatatcggctcggtgacggtcggcatgtccacgccggagaagtcacgggtcatcgcgatcggcgccttcgaatagtcaagcggagcgccactctggcgaggtatgtccgcgacgttcatctcgccgcgaagctccgcggcctgcaacgggtacgcgatcacgcgctcgcccgtcgcgctcgcggccgcgtcggcgacatcgcggtacgcctgatgcacggcctgcgctttggcctcggccaaaatcatcacgcgctgttcgacgttcagctggtcaacggtgacgccgcgctcggcggcggctttttccagcgcagccggctcatcgacatgggacacgcggatggtcgggcagatgccggccgcatacagcacatcccggcgcggctgggacttcgacgccagaatcatcggaatggacatgatcgtcacctttcttttgccgccgcaccagctgccgcaccacccaaccggcaacttcgcgctcccctcatctccggcccgaggagcgggcgaggaggcacgtgcggtattcctacttacgctcgacctgcacgccgaccgtgtcgatgggcaggtgcagcaccttccaatggccggaagccagctgttccgccgcgacctcatcgatgtccgccacggcgtcgccgtgatgcagcaccagcacgcacgggccggcgccggacaccatggcggcgaaaccacgggaacggaacgcctgaatcaggtcccatgacggctgcatgagccccttgcgatacggctggtgcaggcgatcctgcgtggcagcgtacagcagcgcgttcggctcttcgccggacgcgagcgcgcgcgggttcatcgccgcggccatcagcgccacgcgcgacacgttaaacaccgcgtcgcgataggcgacctcgccgggcagcgcctcgcgcgccttctcggtggacagttcgtagtcgggcacgaacacggccgccgtgacgcccggatcgaccgcgtacttgaccgtgtggaaaccgccgtgcagcgggtctccaccggggatcggcaccgagccgaccccttcggccgtgtcgaagttccatgagacggtcatgccgccgtacaccgccggcgccacgttgtcgggatggccttcgatggcggccgccagctcgaagatggaatcgcggttgagccggccctcctgcgcgaacgcggcagcggcggcgatgcccgccacgatggcttcggcggacgaccccatgccgcgcgcctgcgggatgttgttgtgcgcttcgaggatgaacccgaccttgcccaggccgaaggtctggcatgccttgcggaacgtggagacgaccagatgggtctcgtcgcgcggcagcgtgtcctcgccctcgccatagatcagcacttgcgcggcgcgattggacgggtcacggctgagcgtgaaggtgagttcgtcatgataatcgagggcgaggccgaccgtgtcgaagccggagcccagattggcgcttgtagccggcacgcggaccttgacctgtgtacagattggttccatgattccttgattcagcgattccgcccccgctgacggggaggggagcaaacgatagtgagatcggggtggtttcgcggaaacgccgcgaaaccacccccagtcggctttgccgacagcccccgacagcgggggcaggcaaccgtatgactagtcgagcacgcgcaggatggacggctctccggtgacgaagtccagcgtgcggacggcttcgacagtctcacgcagcgtgacctcgtcggtcagatgcgtgacgatgcgcagctgctggatctcgccgtcataaccaggatcggtcatcgtcggcttgagatcctgattgacgccgttgatcgacacgccgtggtcggcgaactccttggcgatggcggcgagcacgcccggcttgtcgtggatgaggaaccgcacggcgaacgcggcgcggctggcgctgatcggcgccttgggcagctcgtggtacatggggatggacgggccggtgcagccttgagcgatgtggcgggcttcggtgaccacgtcgccgacgacggcggaagcggtcggagcgccgcccgcaccgcggccgtagaacatgaggtcgtcggccgcctcggccttgacgaacacggcgttgaatgagccgtgcacggatgccagcgggtgcgattcgggaatcagcgccgggtagacgcgcgccgacacaccggcctcgccgttctccacgacggcgagcagcttgatgaccttgtgctcggcggcggccgcggcgatgtcgtcggcggtgatcttcgtgatgccctcgacgctcacgtcatcgatcgtcacgttggtgtggaagccgagcgtggccataatcgcggccttgttggccgcatcgtagccttcgatgtcgccggtcggatcggcttcggcgtatcccttggcttgggcgtccttgagcacgtcatcgaactgcaggcccttggtggtcatctcgtcgagaatgtagttggtggtgccgttgacgatgcccagcatgctggtcaccttgtcgcccgggcggtcacctcaccgggcgtgccggacacatcgaagccgaacggggtgttcagatgccatgatgcatccacgtccaccgcgcgtccggaatgcacctgactgaccagcgagagcccgcagccgatggatttcgcgagcgacacgcgattggcgagaatcgcctgcgggtcgtcgccgcccttgccgccgagattgcaatcgccgaaatcgccgtggctcaccccgcccaggcgcgtggtgtagacgacagtgacaccaggcgccagcgcgatcgggatcgtcactggaaccgggttgccctcctcgtcggtggggctgatggcgttgctgtccagaatctcatcatcaaactgcgtatcgctcatgattccttatcctatgtgattgcgtgctcttcggctcggcgattggcgtcaggcggctttgagggtggggtgcttggtgcgggagcggatcgcggcgttgaccggcacctcatgcgggcacggcatggagaacacgtgcgccggattgttgatggcttgcacccagttgccgtcggcgtcgcgaaggccgttttcgggcacggtgtagatgagtggcgcgtcgcccggcagcaggaattcgatctcctggccgggttcgatcttgttgcggctcatcagcgtgacgcgaccgccttcgtccgggctccacgacagcacttcgccgacgaccagccatgagcggaagtagccgctgcggttggtgttctcggtgaccttgcggtccgggtagtagaagccggtggagtattctcggtgagcgaccttgtagggttcctctttcaaccattcgggcagtgtgacgggcggcgcgggcgcgacggccgcatgctgccagccgttcgtgtcgatcggggactcgtcgcgcgtgttcgatttgcggcgcgtgctgcgggcctgttgttcaagatcggagatacggtctggggcggtggggctctggccgacttccaggacgccgtcgtcgccggggacgccggcgaaggcgacgtcggcctgttccatgatgtggtccgtgagatcggcaccggacagttccgccgcgtacgggtcatcgttcagccagacgggggcgggcgcgtcggtgcgaatcacgcggtcgtggaacgggcgcagcgtgttgccgtccgcggcctcgaaaccgcgctgcaccatgtattcgttgacggcggtcttgtaggcgttggtcatcgcggcgatgtagtacgcgcttttggcccggccctcgatcttgaggctggtggcgccggagtcgatcaggtcatccaggtgctccatcatgcacatgtcctgcgagttgaacaggtacgtgccctctttggtctcctcgaccgggaagtactggccgggacgcttctcctcgaccagcgagtacttccagcggcacggctgcgcgcattcgccgtggttgccgtcgcgaccggtcagatagttggagatcaggcagcgtccggagaacgccatgcacatcgacccgtgcacgaagcattcgacgtccatgtcgtcgggaatgttggcgcggatgtctcgcacggcctgcagatccatctcgcgggcgagcacgacgcgtctggcgccgaggtcgtacagcgcgttggcggcaccgtagttcgtgacgcccgcctgcgtggagacgtgcagttccagctcgggggcgacgctatgcgcggtcatgagcacgccgatgtcggtgacgatcagcgcatccacaccggtgccggccagctggctgatgtattcctggatggccctgacctcgttgttgcgcggcaacacattgcaggtcacatatacgcgggcgccccgcgcatgggcgtagcgggcgccctcttcgaagtcctccaggctcaggttcttcggagcacttctcatgccgaacgccttgccgccgcaatatacggcgtcggccccgtaatcgaccgcagccttcagcccgcgcaggttgcccgccggagccagcacttccggcttacgccgggccattcgttgttgagattcaagcaccccaccagtgtagtgcatggaatctggtgccaatgtcgcgcctctgacatcaggcgtcaagtaccccccccccctaacaaaatccgctcccggcgagttctagtgatcgttgcaacacctggcctaccgcagggaggatcaggtgaccgcgagccaccatgacgacgggacagggaccggccgctgggtgttccaggggcacggttatccgacgaggaaggcgatgtgcgaggccaggcgggccgagtacgtgcgcctgctggccgaggagggcgtgaacttcacccaggccgcccatgcggtcggggtgtcgaaacgcaccggcaaggcctggaggaacggacgcgcccgggccaccggcaggaacgagagaccatcggtggactggtatcgttccaccatggacaagcccaggaagatacacgcccgctatctgggccaggaggaacgcatcctgatcgccgaccggctgcgcctgggcgacggcatacgcgccatcgcccgcctccttgaccggaacccggccaccgtgagccgcgagatacgacgcgacacgaaccccctgaccggatgctacgagccgtaccacgcccagcaatcgagcgccgaccggctcaaacgccccaggcccaggaaagccgggccgggcacgcgcctgtggcgggagatactcgccggccttggacggcattggagtcccgagcagatcggcaaccggctcaggcatgacttccccgataatgaggacatgcacgcaagcgtcgagacgatctaccaggccatctacgtccagggcaagggcgagctgaaagccgagctgaaacgggccatgcgccagggccgcgcccaacgcaaaccccgtggcggcgcgggtcgcagaccccggttccgggatcccatggtcatgatctcggaccggcccgccgaggtcgaggaccgggccgtccccggccattgggagggtgatctgatcaccggttcggcgaacaggagcgccatcggcaccctggtcgaacgcgccaccaggttcacgatcctgctgcacctgcccgacgggcacgacgcaggccaggtccagcaggccatcgtccgcaagatgcggaacctgcccaggctcctgcgcaactcgctgacctgggaccagggttcggaactcgccctgcacaagcagatcggcgcgagcctggacatgcgggtctacttctgcgacccgcactccccgtggcagcgcggcaccaacgagaacaccaacggcctgttgcgccggtacttccccaagggcaccgacctatccaaataccccgaggactacctcgacgcggtcgccgaggaactcaacgaccggccacgcaagaccctcggcttcatgaaaccaagcgagaagatcatcgaactgctcgacgccgcgtgatagcctcaacaaccgacaacgtggccatggaaggccgctcaaacctcaggtgctgcaaccaccactagaatccacctcatgcaacgcatgactggggtggccatgccctggagtcgcaagactccagtgagactacaaaagcagactctcaaaactcgcggatagacaaggaaaaccgctattccaccggtgtatctgcgagttttgagagcctgtcgccttaaagcctcacaagctcgtcgggggtgagctccaaatcgccggcatgcaggctgtcgaggatggtctcggggcgatgggcgccggggatgacgaagacatggtcgcccttggcgagctcccacgcgagcacgacctgctggtaggagacgccacgagccgccgcgatctcgcggaacgggtcgaacttggtttcgtccttgggcttgcggaagccgcccagcgggctccagcacacgaagttcagaccgactttcgccgtgtattccagcgtatcggcggtgtcgaggtagatcggcgagtactggttctgcacggcgatgagcttgtcgccgaggatgccgcgcgcgatgtcgatctgctcgatggaagcgttggagatgccggcctcctgcgccacaccctcgtccaccagctgcttgatggcttcgacggactcgttgtacggcaccttcgggtcggggcgatggaagtagagcaggtcaatcgtgtcgacgccaagcgcgagcgcgctctccttgccgcgcttgatcaggttttcggggcgcccgtccacgtcccaggtggggcggccgtcggtgaagttgcggaaatgaccgaccttggtggcgatggtgacctcgtccttcgggccgttccaagaggccatggcctcgcggatcagcttttcgccggtctgctcttcgccgccggagcagtagtaggcccaagccgtgtcgaggtgacggcagccggcgtcgagtgcggcgtggatggtctcgatgcccttatcgtggccgaggttgttctcgatggtcagcggcatttcgccgaggccgatggcggtggtgccgaacggaccgaggttgcggtgcagtaccatgtgcatctccttgatggtcatatagtgtcgccctccacaatacgccgaggccgcggcggatacgaccccggtagcagcgaacggttctcaataagaaacgtgcgaggattccgcacaatttcgcacaatcgcacaaataggcaaagtcccggaattccagggctcagccgattttgatgttcatttcggccgacagcaggctcgcacctttcttattgagaaccgttcgctgctacaaatccgcccggagaccgctcatgtgactatccccacatttcacaccgacaccaaaaatccaccatcgctcaaaatcggcatcatcccaacgaaacactacatatagtgaccacacactgcgcgcgacacgacttgtaggggttcttgactgcaaattacaacgctgtagtctgagcgagtcaacacgttcaccccagcgcatcaagggagcaacatgaccgtcaccgtgttcaccaaaccgtattgcccgcagtgcgacgccaccaagcgccagctcaccaagcagggcgtgattttcgagaccgtgaacctggagcagaatccggagaccctggcacagctgcagcaggccggcttccagcaggctcccgtcgtgatcacccccgatgcatcctggaccggctaccgcccggacctgattcgcgagctggccaagaaactggccaagaagaccgcgccggtggccgcatgaacggccgcgcccccgccacccccggcacgccccagcctcatccgcgcagcaccccgatcgacctgaccgccgcgcacgccatccccgccgccgacagcaccacgcccagcacccccgagcagccggccggcaacacggtcgagcacatcggcgcagtcgtgtacttctcctccgcctccgagaacacggcccggttcatcgagtcctgccagctgagcggcatcggcatcgccgtgtaccgcatccccctcaagccgggctcggcgccgctcaacgtgcgcgagccgtacgtgctgatggtgccgacctacggcggcggcgacgcgaaaaaggccgtgccgccgcaagtgaagcgtttcctcaacaatccagcgaaccgcgcgtggatccgcggcgtggtcgcgtccggcaacaccaatttcggcaccgcatactgcgcggcaggtgacatcatcgccgcgaaatgccgcgtgccgttcctctaccgtttcgagcttatgggcacgcgcgaagacacgcgcaaggtgcgcgatggactcgtgcgcttcttccgggaccaccgcggctgaacgcgccacaatcaccgttattccagttactccaagggaaaactatactcatgactgacttcaccgacaccgagctgccgctcgacaacaccaccgacaccactgtcgagcagtacgatccggcgcacgactaccatgcgctcaacgcgatgctgaacctgtacgacgccgatgggcgcatccagttcggtaaggacaaggccgccgaacgcgaatacgtcaccggccacgtggccacgaacacgaagcgcttcgaatccaccggcgagcgcctgcgctacctgatcgaccaccagtattacgccccggcggtgttcgaacgctactcccccgagttcctggacgacttctacgcgcacgccgaatcctccggattcgagttcggcacgttcctgggcgcgttcaagttctacacgtcatacgcgctgaagacgttcgacggcaaactgtatctggaggacttcccgcagcgttgcgcggcggtcgcgctcgaattggcggccggcagcgagcagcgggccgtcgaatacctcgacgagatgctctccggcgcgttccagccggccacgccgacgttcctgaacctcggcaaggcgcagcgcggcgaggcggtcagctgcttcctcgtgcgcatcgaagacagcatggagtcgatctcgcgcggcatcaacgcggccctgcagctgtcgaagcgcggcggcggcgtggcgctgctgctcagcaatcttcgcgagctcggcgccccgatcaagcacatcgagaaccagtcgagcggcgtgatcccggtcatgaagctgctggaggactcgttctcgtacgcgaaccagcttggcgcgaggcagggcgccggcgcggtgtacctcaatgcgcatcatccggacatcctgcgcttcctcgacacgaagcgcgagaacgccgacgagaagattcgcatcaaatcactggcgttgggcgtcgtaatcccggacgtcacgttcgagctggccaagaagaaggccaagatggcgctgttcagcccgtatgacgcggagcgcgtgtacggcaagccgttcgccgacatttccgtcaccgagcattacgacgagatggtggccgacgaccgcatcaggaaaacctatatcgacgcgcgcgagttcttcacgacgctggccgaaatccagttcgaatccggctacccgtacatcgtgttcgaggacacggtgaaccgcgcgaacccgatcgccgggcgcatcacgatgtcgaacctgtgctccgaaatcctgcaggtgcaggaggcgagctcctacaacgaggacctgacctactcgcacgtcgggcgcgacgtgtcctgcaacctcggctcgctgaacatcgccaaggcgatggacgcgggcctggccggcaccgtcgagacggcgattcgcgccctgacgtcggtgtccgaacacacgcgcatcgacgcggtgccctcgatccgccgcgcgaacgatgaagggcacgcaatcggcctgggacagatgaacctgcacggtttcctcgcccgcgagggcatccagtatggttccgaggaagcgctcgacttcaccgacatgtatttcatgacggtcgcctaccacgcctaccgcgcctcgcacacgctggccgtcgagcacggcacggcgtttcgcggtttcgccgattcggcgtacgccaagccggccggcgagggcaattatttcgacaagtacaccgacggccgccgctccctcgccccgcgcaccgaactcgtgcgcgccctgttcgagcgtttcggcgtcgcgatcccgaccgaggccgactgggccgagctgcgcgacgacatcctgcgcgacggcatctacaaccagaacctgcaggccgtgccgcccaccggctcgatctcgtacatcaaccattccacctcgtcgatccacccgatcgcctccaagatcgagatccgcaaggaaggcaagctcgggcgcgtctactacccggccgcctacatgaccaacgagaacctcgaatactacaaggacgccttcgaaatcggctggaaggccatcgtcgacacctatgccgaagccacgcagcatgtggaccagggactctcgctcacgctgttcttccccgacaccgccaccacccgcgacctcaacaaggcccagatctacgcctggcgcaagggcatcaagaccctctactacatccgcatccgccagcaggcgctggaagggaccgaggtgcaaggctgcgtctcctgcacgctctgaggaatcggtggatgatgtatgcgtataccgcctttcttcggcgctcgacgtaccttcgtacgccttcggcctcagacggcggtctccacacacgtcatccaccaattccgctccacagccctgcgcacgcccgcaactcaaggaacccacatgtcgccaatgatctaccggctcatactccgtctgaccgcgccggaggagtttgaagacaaacccgccgacgacgagatcgacgtcatccgaaagaacgtaacagaccacccccaacaacgaaaggcagacaaccatggcaccaatctccgtaccgcgcaaaccgctcaagctcatcgaccgcgtctccgcgatcaactggaaccgtctggaggacgagaaggatctcgaagtatgggaccgcctgaccggcaacttctggctgcccgagaaggttcccgtctccaacgacatccccagctggcagaagatgagtgacgacgagcacacgctcaccatgcacgtgttcaccggactcacgctactcgacacgattcagggcacggtcggcgcggtctcgctgattcccgacgcgctcaccccgcacgaggaggccgtgtacacgaacatcgcgttcatggagtccgtgcacgccaaaagctattcgagcatcttctcgacgctgtgctccaccaaggagatcgacgcggcgttcgactggagcgagcgcaacgagttcctgcagaagaaggccgaaatcgtgctcgactactacgagggcgacagtccgctgaagcgcaaggtcgcctccacgctgctcgaatcgttcctcttctactccggcttctacctgccgatgtatttctcggcgcacgcgaagctgacgaacacggccgacgtgatccgtctgatcatccgcgacgaggccgtgcacgggtattacataggctacaagtatcagcgcgggcttgagcgggtgagcgacgcgaagcgcgaggagatgcgcgagtacacgtacaacctgctcaacgagctgtacgacaacgaggtggaatacaccgagtcgctgtacgagcgtgtgggactgaccgacgacgtggagaagttcctgcgctacaacggcaacaaggccctgatgaacctcgggtatccggcgctgttcccggccgaggcgtgcgacgtgaacccggcgattctggcggcgctgtcgccgaacgccgacgagaaccacgacttcttctccggctccggctcgtcctacgtgatgggcaaggccgaggagaccgacgacgaggactgggacttctgacggatgtgtgccctcgcacggtggctgaaattgcatcaccgcgcgagggcgcacagcgtgacggtaccctgaaaaccgttgcaaatactgggctctagcaacaccgtcactgtgagagggcacacacagtgacggtggcctcacacagtgacgctttgagcggtacccctgcgcccctcagcgcgacggttctttgcatgaggggctatcaaccgttggaatcgcaccggttacgcgcgtaggcgttcgccagcggagtggcggcgctgacggccacgttcacgaccgtgctgaaccgcggcgaccacgcgatcttctccgacacggccggcacgctgctgtcggtggacaatacgttcatctcgccgttcaacgcatggctcatcaaccgcggcttagtcacgctgccgctgcgcatgaggcagcacaacgcctcggcccaggccatcgccgaacacctgcaatcactgccgcaggtgcggttcgtggcgtatccggggctcgaatcgcacccgcatcacgcattcgccgccagccagctcgcccgcccggacgccggtttcggcggggtactcgcgttcggactgaacaccgaccatgacggacacaaccgtttcgtcagcaaactcaacgtcatcacgtcggcggtgtcgctcggccatgccgaaagcctcatcgtgtttctgggcgaagacgacgaacggcagtacctgtatccgtccgagttccatcagggtttcttccgtctcgccgtcggtctggaggatacggacgacctgattcgcgacatcgaccacgcgcttagctgaggttgcgctctcaaaactcgcagatagaggggctttccggtccaaaagcccctctatctgcgagttttgagagcgtgacttcagcggcctccgaaagatccgccgccaatgccgccggaggagcccccgaaaccgccgccgcccgagaacgaaccgcccgagataccgccgaaaccgccaccaccggacgtcgccgcgtggatgacggagccgatctcggagaaaccggcattcagccgcgcgccgaagtcaccgaagttcgcgctgaacgacgccgggtcgaaaccaccgccgacgccgccggcacccgccccggcggtcggaccgcccatatagccatacccgtacgggcggtagctccagtacagcagcgagccggcgccatgcgcgtccagccattgcggatcggtcacctgcgggtacgccttggcgaactccgccatcacgcggtccgaaatgccgaacgccgcggcatacaccagataccggtcccacagcaccatgtcggccaccccgcggtcactgaaattgctgaaatcctgcagataccggtacagtccctgcacctgtcccgcataccgttggccggaagacgtcagcgcactggacgcagcatatgagcacacgacgatcgacagcatcatgatcggtgcggaaatgatcagtgccagtgcgatattgccgccgaacaccgcgatgatgccggagaccagcgccagcgcggcgccgaggccgcccatccagctggccagcgtgccgccgttgcgcgtcgctccgagcatcgcgaactcggacgagcacgcttcggtgaacaggttcagcgccttgtacccgttcttccagtcctcgcaatgccgcttcatgccgtccagatcgaacacgggagagccgacgcgcttggagaccttctgcatcaggctcagcgcggcacgctcgctctggctcaggttgagctcccgcttcgcgtccttgtcgaatcccgccggcagcagcactatggtcatcgtcttgcccagcgacttcgccttgccctcgtcggcgccaatcatgccggccagacgcacgttgtcggcattgctcatatcgatgccccggtacaggctcgacggacccggatagatggcgatcgccttcttcgaggcgagcgacagcatcgtcgccgtcatctgcagcgagtcgacactgctcttggacagtcccatgacatccgccatcttcgcggccgaggcagggctcatgtccggcggctcacgccagtattcgatgtcgccgtggtattgggattcgcgatagctgcgcaccgccgcgaccatgccgatggcgaacagcaccaatccggcgaggactactgcgatccacaaggccacgcgcacgcgggccgggccggcctgctgttgccgccacgcgatttcctgctggtcttcggattgcttcagcttcggcaggtacgtgcgaccggtctgctggcgcacccacgcggcatcgccctgccgccatccggacggaggcttgacggcggaggcgtcgtaggccgccaccacgtcgagatactgcccggcgcgaacatcggacgcactgaaacgcagcgagccgtcgtccatccgggaggtttcggagacgccggcgtagtgcagccatgcccagctgctggaggcgtcgatgccgtcggggaagcgcacaattccggtgaccttgccgatggggatcaggttactgtcaccgaacggctcccactgccacgatgccacgtccttgtagagcgtggtgccgccgtggagcgtcatcgtcacgtcgaacttgagactgctggcttttttggtcgcggggatgttccagccgatctccacgtctttcgaccgccgcgaggtcgtgttgtcgctgatctcgtacccgtccttggcgggatcgaacggctgggggttctcggccccgtcggtcacgtccgcgatgtaccagtgcccggcgtattcgcggtcccatgacgtatcggaatggtcggccggcgatgccagcgcgccctgctcatagttttcgccggcggtgacgttgcgcacgctgatgtcggtgatgttggtcaggccgtcctctcgcagcgtgtacttctggtacagctgccgccatggtgtgtcgccgtcgcgcgtgcggagcttcatgtcgatgtgctgggtaaccttcaggctgccgtcggcttgaaccgcgacgtcatagtccagcgtgcggtagctcaggtcgggcgagcttccgctcagcatcaggccggcgccgatgacgatggcgaagacgacgagtgtgccggccaacgccgttgccagcgagcggagcagacgtttcaggttcatggcgatctccaatgatcagcagcggcgatggttccggcggtcggtgacgtcgggcgtcagaaacgcacctgcggcacctggcgggacccctcgtcggcctggaagtactgtgcctgctcgaagtggaacatgccggcgatgatgttgctcggcaccgtctcgatcttggtgttgtacttgagcaccacatcgttgtagaactgccgcgcgtaggcgatcttcgtctccaggtccttgagctgcgcctgcagatccatgaagttctggttcgcctgcagctgcgggtacgcctccatggtcgcctgcaggttgaacagcgcgcgggacagcgcgttttcggcggtggcacgctcgacggtggtcgcgttcgggttcgccgcggccgcagcggctccggcgcgcgcctgggtcacctgggtcagcacggaggattcatgcccggcgtaccccttgaccgtttcgaccaggttcagtatcaggtcggcgcgctgcttgagctgcacgtcgatctgtgcccagccgttcttcacgcgattgcgcagcgcgaccaacgcgttgtaggcaccgaccgcccacagcaccagcgcgatgatgacgacgatgactatcgccagaatgatccaccccatgtgcactccttcgtatcgttgttgccgccattgaagcatgactatgtgaaatgatacgtcaccgtgtcgccgtccatgtccttcactccgcacggtatcatcaaaggacgtggccgccctcgccggcgtcgcgcagagcaccgtgtcgtatgtcatgagcggcaaccggccgatctcgcagaagacgcgggacaaagtcgagaaggcgatgcgggagctcggctacgtgcccgacgcgcacgcccgggccatgatcagcaaccgctcgcacatcatcggtctgctcaccgaaaccacggagaccacgcaaggcgcggagctgttcccatcctgcgggccatccgcgccaccgcgaaggaacacggctacgacctcatcctgatgtcatcgacctgcacgaccgaagacctcgccgacatgcgtcggctgggcaaaggcaacctcgtcgacgcattcatcatgctggacatccggcatcatgacgggcgtctgaaatccgcaatgaaactcggcctgcccatcgtgccgtacggcgaccccggcgagccgtaccactaccattgcgtggactccgacacgaaggcgatcgtgggcatggcgttctgggagatgcacgccatcggcgcgaagaaagcggtgatcgtcgaggacccgcgcggcgaccccgagtttccgttcatcaacatcttcgaccgggagagcgtcatatgcgccgaacggcatgggatacagctggagcggttcgaggcaaaggacacgcgctggcaatcgttcgagccgctgacagggaagttcccggagtggaagggcaacggcgtatgcatttacacccgctcgccgcggacgcttgcgtggatagagcagatgatgctgctcaccggcgtcgccccaggcaaggacatcggactgatcggcgagggcggtcgaagtcgccatcgagcagatcgaaggcaaggaattcgagcccggcgtagaacgcacgccgccgagattcacccgccgcgagaccacgattctcggattcgcgggctgaggccgcacaaggggcatgcggcctttgccgcaggccacatccggaaacggtgccgcctcacctaccgtggcgaatgccccgccaggccggatcatccccaaattacgggttgaaattgtcgatatctgtgattccccgtgcgaaatcgccgttttagggcccgaaagcggcgatttgacacggggaattgcgaataacgacaatttcaacccgtaatttgacgtgcaggatgggcgcgcggcacagaaaacacaaaaacggggagccccgtgatggggctccccgtaagtgaggcgcaggctacccgcgttggctcagaggacgccggttctcggacgtcgagccgttagcgcgagcggccatgtcgcaagagatcagttctcgaacggatcgaagtcgcgacgcacgcggcggcgcggacgctcggagcgctccacgcggtcggcgcggtactcgtcgtagttctcgtcggtcgcgtaacgcgggttgcgatcgtaaccgccacgacggccaccacggcgatcatcggaacggccgccacgacggtcgtcgcgatcgtaatcgcggtcgtcacggtcggaacggcgacgcggacggtcatcgcggtcatagccgcggtcgtcacggtcgtcgtagtcgcggtcggaacgacgacggcgcgggcgatcatcgaaatcgtcatcgcggtcgtcacggcgggaggagcgacgcggacggtcgtcgtagtcgcggtcgtcacggcggtcatcgcggtcggaacggcgacgcgggcctccgcggcggtcaccacggtcgccacggtcgtcacgacgaccacggccggcgttgttctcctggtcctcgaaaccggggatggcgagcgagatcttgccgcggtcatccacgccctgcacgacgacctcgacggtgtcgccttccttgagcacatcctcgacggcgtcgatgcgctcgccgttggcgaggttgcggatctgcgagatgtgcagcaggccgtcggtgcccggggtgaggttgacgaacgcgccgaacgacgtggtcttgacgaccttgccgttgtaggtctcgccggcctccggcacgtgcgggttggcgatctggtcgatgatggccttggccttctcggccgcttcgccgccttcagaggagatgaacacggtaccgtcatcctcgatggcgatctcggcgccggtgtcctcctggatctggttgatcatcttgcccttcggcccgataatctcgccgatcttgtcgaccggaacggtggtggtgatgatgcgcggggcgtactcgctcatctcggccgggccgtcgatgcactcgttgatgaggtcgaggatcgtggtgcgggcctcgtgagcctgctgcagggcaccagccaggatatcggccggaatgccgtcaagcttggtgtcgagctgcagggcggtgatgaactcggaggtgccggcgaccttgaagtccatgtcgccgaacgcgtcctcggcgcccaggatgtcggtgagcgtcttgaagacgtgctggccatcgacgtcaccggagaccagacccatcgcgatacccgcgaccggggccttcagcggcacgccggcggcgagcagcgacagcgtggaggcgcacacggagcccatcgaggtggaaccgttggaaccgatggcctcggagacctgacggatggcgtacgggaactcctcgcggcttggcagcaccggcacgatggccttctcggcaagggcgccgtggccgatctcgcggcgcttcggggagccgacgcgaccggtctcaccggtggagtacggcggcatctcgtagttgtgcatgtagcgcttggactgcgggccggaaagcgcgtcgatctgctgctccatcttgagcatgttcagcgtggtgacgcccaggatctgggtctcgccgcgctggaacagggcggagccgtgcacgcgtggcacgatgtccacctcggcggacagggtgcggatgtcgcgcaggccacggccgtcgatgcggtagtcctcggtgaggatgcggcggcgcacgatctggcgctgcagctccttgaacgcgttgccgagttccttctccttctcggcatcgtccatgtcggtgaactcgttcgcgagcacctcacgcacgtgctccttgatctcgtggatgcggtcctggcgcggcagcttctccgcgatggacagtgcctcgttgaggtcctcgtgggcgatctcgtcgatgcgggcgtacagctcgtcggtgtactcggggaacagctggaagtccttggtctccttggctgccttctccttgagctcgttctgggcttcacagatcaccttgatgaacggcttggcggcttcgagaccctgcgcgacgacttcctcgtccggcttgatctggccctcgtcgtagatgaggtgccaggcgttcttgccggcaccggcttcgatcatggcgatggcgacgtcaccgttctcgatgacacggccggcgaccacgatctcgaacacagcgcgctcgcgctcgctccagcgcgggaaggcgacccactggccgtcgatcagcgccagacgcacgccggagaccgggccttcgaacggcaggccggagatcatcgtcgaagcggaggccgcgttcagggcgatgacgtcgtaggcgtcgtcgggatcgatggacagcacggtctccacgacctgcacttcgttgcgcagcgtgtgcgggaacagcgggcgcagcggacggtcgatgatacggcacgccaggatcgcctcggagctcgggcggccttcacggcggaagaacgagcccgggatcttgcccgcggcgtacatcttctcctccacgtcgacggtcagcgggaagaagtcgtagttctccttcgggctggaaccggcggtggtggtggacagaatcatcgaatcatcgtcaagataggctgccaccgcgccatccgcctgctgtgcgagacgacccgtctcgaagcgcagggttcgttttccgaacgaaccattgtcaataacggcctccacggccttgatttcgggaccctccatagggttcctccttttttttgttctattgtctgctgatatctgtaatccacatcgagacgccgaaatcccgatttgttcaagcttgtcggcttttctcattgacgcggcccgtcccggaccgcacccgttcattccagattcttcttcatcatcggccctcaaccgccgggccacagtatgtcatccgcgaattcgcaacatcctcatccacatgccgatatgcaaaacgcccgagcaaggaatgcccgggcggaagttctcttatcgacggagaccgagacgctcaatcagggaacggtaacggttgatgtcgacgcgcttgaggtaatcaagcatacgacgacggtcaccgaccatgagcagcagaccacgacgggagtggtgatcgtgcttgtgctccttcaggtgctcggtcaggtcggcgatacgcttgctcagcagcgcgacctggacctcgggggaacccgtgtcgccttcgtgcgtcgcgtacttggtgatgatttcctgcttttcttcagccgtaagtgccacggcatcctccttatggttgctgcgcggtgcacccggctttatgccggtgcgctctctatccgcgggcgaaacacgccaatgggatagtataggcaatgggtcggactacttccggcctttcgcggcagggtctcacaccgccgtcagcaatccgccgaacagcacaatgagcagcgccgcggtctcgatggcgaagaacaggatgaacgaagcccagctgcgcgtcagcacgttcagcggagagtccttcttgatgaggatcagcaggccgacccacacgaccgcatacaccgccacgccgaccccggccgcgatgattcccagattcgccgcattcggcagctgcgcggagtcgccgtacaccacgtacgtggagtaccagaaattcagtttgagcaggctcaggccggcgatgaactgttcggcggccagcccgaccacgaacacgatgcgccacagccagttgcgcgactccaccacggcgagaccgagtccggtgaacgttgtcagcgtcacggtccacgacacgaaggccacgccgcgcggggtgaacaggttcagatgggtgatcagccattgcgtgtggccgaccgccagggagcgtccgagccagtacggcgcgatgatggcggccagcaccgccacgatgaacaccgcccatggcaccgggtgcgactgccgccgctcgatatcggccagagacaggtcggtcaccgggatggatgggtccggatgcttggaaacgtcaacggtttcgacgtggtcaccgaccagttccgtcgcctcgttgttattggtttcgtccgccatgttcgcctcgctcgccatatgttctttactgacttccatgcacgacaatacgggctgaaatagacggaatccgggattcaccgtacaatatcgccgtttcggcaccgcgaaacgtaccatttcgtacggggaatcttggattccggccatttcagcccgtaattgccagcgtcgtccgggccggcgccccggctctcacgagcgagggcgaccgcccggactcatgccgaatcagccgatccgcttgcgcaggccggccatcgtcacgcccgccgcggccaacatcgtcattgcggcgatgagaccgaagacgtcggcgcccgtgttggacagcttgccgtcggcgccgggcttgttgacacccggcttctcaccgggcttgttctcgccgggcttgttctcgccgggcttctcgccaggccgctccggctcggtgccgtcgctcttgaccaggcccttgatggccttgtcgagtgcagcgcgcagcgcggtgtaggtggcgggatcgccctcgccgttcgggtcggccttcagctgcttgctcagggcctcatacgcgacggtgaacttggcatagctgtccttggtgtactcggaagccttgcccgcgtaaggctcggcgtcgttcagcgcgagctgcgcgtagtcgcgtgcggactggtcgtagcgcagcgtggacttcgcggcggtgtaggccgcttccagcgcctcgccgtcggccttcgccagatcgtcggcgttggccagcgcggcggcgaagtcgtcgtacgcggactggtacttgttgtagctcgcctcggtgtaggtggcattgtcgttggagacgtgctcggccttcagctggtcggcggtcttcgccgtgtaccgttcgacacccttcatcgccgattcgagcgcggcgacggcggcgtcgaccttggcctgcgtggcgtcctggtcggcagcgacggccttggcggcggcaatcgcgccggcgagagcctcgcggctcgacttggtccagtcggcggagtcgaccttctcggcttcggcgaccttggcgttcagcgcgtccttggtcaccgtaccgggttcgtcgatcttggtggcggacaggtcgtacaccttccaccacttggaggtctgggccaagttggtgatgcgcacggccttgacggtcgcggcggagtccagcgtgaagatctgcttctggttgccgttcacgtcgccgatcttggtccagttgccatctgcatcctggtattcgatcttgccgttgacgatcgtgtcaccgcccttttccgcctggatgaagcggaactccttggccttgcgggcctcggcgtaggtgacggtgagggcggcgttggccttgacacagtcgcagccggcggactgcatccagaagaacgtgctgtcgtcaccgtcgatgacggccttcggatcgacgttctcatgccatgccgcggcacccacgccgttcgtgctgaccgtggcgtcggagggcgtcggggtgacgctgccactggtcttggccttgacgaaggaatcgagcgcctgcacggtcgggcgcacgatgaccaggccgccacgggcgggcttgttgcgctggtagtaatcggcgatcgtatgcgtgtcggacttggcgaaagcggccttcgcggttgcgtaggtcgccttcgcggcctcggtgtcacccgcgagcgcctgcttggcggcggtgatgtagtcgatggcggaggcggtcaggtcgtcccagtagctgatccacggttcgatctggtcaaacatgttcttgtcgccggggttcgcgcggtagttcttcgcggcgcgctgcagcgtggtgtagacggtgagcgcctggctgaagtcggccgcggtggcggtgccgccgtccagcttgcccttgagttcggtcaggacgcccttgacgtcgagcttgccggtgtagtcgacggactcattgttgatccaccacttgttaacggcgtcatactcggcatccttgtgcgcgccgtcgatgccgccgtcgttgaggatgcgcatgttcatggcgaggtcacgcaggccacgggagcccttggacgcgatcggcgagttgtggtcgatgtagctgaaggagtcctcccaggactgttgtccgtccttttcgctctgccacaggttccagctgtagtcggcggccatgaagatgccctgcttgctcggctcggactgctgcatcgggttgagcatgatgccgtcgtaggtgccgtatgtggcaccgggcttgaggaagttgttctggcctcccatgaccaggtactggtaggcggtgttgcggttcatgtcggagcacggccagttgatccacatgaacggggcgcgaccggtgttcttggtgaacgtgtcggcgaagtccttgctggccggcgtggcgcaccacctcgggcttgatgtgcacgattgcgcacaggcccgctacgagtcgtaccaaggcgcgaagatcgaacccggcatgatcttcaccatcgagcccggcctgtacttccgcgaggacgacctgctgattccgccggaataccgcggtatcggcatccgcatcgaggacgacgtgctgatgaccgagaacggccccgaatggatttccgcgggcatcccgaagcagcccgacgacgtcgagcagtggatggccgacatggccgcaggctccaaggcctgattgttccgatacgatgccgcccctttcaacggggcagcatcgtcggttgtgcgcaatacaaggaggaatgcccatgccaacacccgaattcgtattggagttgcgcaagaagatcggccatgacctgttgtggctcaacggggtcaccggctgcgtgctggacgaccggggccgcctgctgctgggccgtcgctccgacaccggcgagtgggccatggtctatggcatcaacgagcccggtgagcagccggcggatacggtggtgcgcgagatcaaggaggagaccggcatcgacgcggtcgtcacagacctggtcgccgtcacgtcgtcgtcacgcgtgatcacctatgcgaacggcgacaatacgatgtacatggaccactcgttcctgtgcgctctcaagcccggcggcaatgccgagccgtatgtgggggacgaggaaagcctgaacgtgggctggttcgaactggatgatctgcccgagcccctggccgccagcactgtggagcggctgaagctgttccggcgctatctcgacaacaagcgccggggcgacgcccacgcgatgttcgtcgccgacggggtgcagcgctagcggcgggtctgtttgcgtttctaagtgcgcgccgaaacgacaagtgcgcgaacatagggacgcaaccggcccatttgcgtccctaagtgcgcacggttgtcgtttcggcgcgcacttaaggacgcaaacgagcgctacacggtcgtcataggggctgaccggtgtgacgtgccgtccgtctcactcgtcttccatgtcggcgagctcatgcgccgggcaggcaagcgcaagcacggccgtggtcgctatgaacgctacgccactgaggatgattgcccgcatgatccatctcctatcgcgtggtcttctcatcggagagccgaacctttccttatcaagtacagaaccatataagagctcgtttcatgggtcaggtcatacgaacggtcaatttttggtgacgacttcgtgaattacgccgtcatcgtgcctgcgattggcgtcgcaatgacgcggcggcgacctgctgaccggatattgccgtcggcatatgacaggacgaccattagaatggcgtaacggaaccattgacgagcaaacgaggtcgatatcagcatgtcttttgagcatccgaaccgcaacaacgagtccatccgcgacgtggagcgcgacatcatgcgccgcccgccggagcacaacaccacgaatctggatctggaccggatgaacctcatgctcgacgtgctcggccatccggagcactcgttccgtgtgatccacgtcaccggcacgaacggcaaggggtcgaccgcccgcatggccgaggccctctgccgggcgtatgggctgcgcaccggcctgtatacgtcgccgcacctggaacgtatcaacgagcgcatcgccatcgacgggcaggagctgagcgatgacgatttcgtggacatgtgggatcagatcaaggatctggtcgccatcgtcgacgcgaagatggccgagtccggccgccccccgatgagcttcttcgaggtgctgacgtcgatggccatctggaagttcgccgacgcgccggtcgacgttgccgtcgtcgaggtcggcatgggcggcctgtgggacgcgacgaacgtgctggacgcggacgcggccatcatcggcccggtcgacatggatcatatgcagtggcttggcgacaccgtcgagcagatcgccaccgagaaggccggtatcataaagccgaactgcaccgccatcatcgggccgcagccgcatgaggagcgggtcatgccgattctgatggaggccgccgagcgcaaccatgcgacgctgatacgcgacggctatgagatggaggtcacggaccgcgtgcctgcggtcggcggccagatcgccacgctgcacacaccgaacggggtgtacgagcaggtgccgatcgccaagttcggcgagcaccaggcacacaacgcgctcgccgcgctcgctgccgcggaggcggtcatcccggtcaacgggccgttgaacggcgacctggtcgggcaggcgctgcagggcgtcaaggtgcccggccgcatagagcagatccgcacgtcgccgacgatcatccttgacggcggacacaacgtgaacgcggccgaggcgctgcgcaaggccatcgaggaaagctacgacttcacacagctggtcggcgtcgtcgcgatgatgggcgacaagcaggtggaggagtatctcggcgtgctggagccgatcctgagccaggtcgtcgtcaccgagaactcgtggcgcgaccgcgtcatgccggccgaggaactggagaagatcgccgtccaggtgttcggccgcgaccgtgtcatccgcgaggacagcctgccagacgccatccagaaagcggtcgacatggtggacgtcgaggatgagaccggagtcggctacggccgtggcgtgctggtctgcggcagtttcgtcaccgccggagacgcgcgcacgctgctcaaggagcggatgaacgccgacctcgccaagccgaaggccgagcgtgtcaatccctcggtgggcgagcccgagccgcgcaccggcgccggagaccctgcacggtccggggtggaatcggacgccgacacggacttcgccaccgatgcgaaccccgatttcaacgagaacgacttcggcgatttcggctttgacaaggccgccaaggaggctgccaaggaggccgccaaggaggcggatgccgccgacggcggtcccaagggcggacaggcctagtcgacatgtatctcaaggaactcacgctgcgcggcttcaaatcgttcgcatctgccacgacgctgcgattcgagccgggcatcaccgcggtcgtcggtccgaacggttccggcaagtcgaacatcgtcgacgcgctcacctgggtgatgggtgaacagggcgcgaagaacctgcgcggcacgtcgatggaggacgtgatcttcgcgggaacgtcctcccgcccgccactcggccgcgcacaggtgagcctgacgatcgacaacaccgaccacacgctgagcatcgactacagcgaggtgacgatcagccgcaccatcttccgcaacgggggttccgaatacgcgatcaacggctcggcctgccgtctgctcgacatccaggagctgttgagcgacaccgggctcgggcagcagatgcacgtgatcgtcgggcaggggcggctggacgcgattctgagggccgatcccagcggccaccgcgcgttcatcgaagaggccgcgggcatcctcaagcaccgcaagcgcaaggaacgtgcgctgcgcaagttggcgaacaccgaaacgaacctgtcgcggctcgacgacctgctgagcgagatacgacggcagctcgggccgcttggccggcaggcgcgtatctcgcgcagggccgacagcatccaggtgacgttgcgcgatgcgcagagccgcctgtacgccgacgatgccgtcgccgcgatggcgaagcgcgacgcggtgcgcggcgagctggcttcggtgcgtcacgacctgcaggccgcgcaatcggagctcgtccgggtcaaggtgcgcatcgaacagatcgaatcgctgagcgcgcaatccagcccggcactcgcgcgaatcaaccagacctggcatgagatgtctcagatacaggaacggctgaaatcgttgtgctcactggccggcgaacgcggacggtcgctgctcgggcagctggtgacctctctcggcgaggaccccgacatgctgaacaagcgggcggaggaactggaatcgcaggcgcggcggcagtcggagacagtcaacgacatgcgcatcgcgctcgacaaggcgatacaggagcgcgccgacgacgagaaaaaactcgcctcggtgcggcagaccctggcggagctgcgcaaaagcgcccagcagcgcgacttgcagatcgcgaacctcaacgcgctgatcgcccgcgaggaggcgtccgccgaacttgcagacacacgagccaaggatttcaccgcgcagcgcgaaacactccagacccagttgtcgcaggcgcgctcgcagtgcgagtcgttggaacgcgaggccgacaacggcgacgatgacggcggcaaggcgctggaacaggcgcgggccgatctcgccaagcggcaggaggcgcttgacgacgcgctcgcgcggcaacgggacgtcgacggttcgatcatcacgctgcaggccaaagccgacgcgctgcgcgacacgctggaatcgcgcaacgcctccggcgctctcgaacaggacgatcaggtggccgcgatggggcggctcgccgatttcatccacgtcgaggaaggctgggaggaggccatcgcccacgcgctggacgcgttctcgggcgccatcgtggtgccgggggagcgcaacctcctgcatgcgctgcgcaaggcgaagcaggatcgtctgggcaaggccgtgctcgtgatgtccgatgtggctgaaagcggtgccggtgccccggaacaggtggccgccgctgaggagaacgatggttcgccatatcggacgccgtgtgcggccggcacgatggtgtcggcgaatccggatgcaccggacccgagccgagccgcgggggtcgtcggcgcggtgcggctgctgctcaacgacgtcgtcgcggtcgagacgatggatgaggccgtgcggatggtccacgacggcggatgggcgcaggccatcacccgcgacggggaggtcgtcaacccggtgggtgccgtgggcggttcatcactgtcgcaaagcgacctgtccttggcagcgaggcgggataaggcgctgaagcggattacggtgctgcaagggcagctggacgacatcacgcggcaggttggcgaggcccgtcagcggcgggaccaggggcgagtgctggtcgacaaggaatcgcagcggcgcattcaggccaagctcaagtccgaacaggccgcgaaggcgttgcaatcggccgagtcgcggatgaagggcgtggaacgtcaggccgcggcgatcgaggagaagctgcgcggcagtgtcgaggaacgccggagccatcagttgaagctcgacgatttgcggcgggcgctcgccgcgatccgggattccggcgcggaacatgccgacgtcgacgagctgggggagcgcgagcatcggctggaagccgcgttgaacgctacccgcgagcatgaggtcaccgcgaagatcgcgtggacggaggcggaacgcaaggtcgagtcgttcaagcggcaggccgggctgttgcgcgacaacgccgcggaggccacgcaacgacgcgcgcgcatcgaggccatgaacgagcgtcgcaaggcgcaggccgcgcacgcgcagcgcatcgccgacgatgccgcgcaggtcgcctccctggtggcggcgagcatcgacgatgtgatcgccaagcgcgaggcgctgcaggccgaggcatcgagccacgacgtggagctgaagacgctgcgggcgcagcgcgatggcatcgagccgaaggtcgcgggactgcagcggcgtgaacacgagctggatgtggatcgcgaacgattggccggggaattcgggcagttgacgcaaaaggtgtcggatgacctgggactttccatcgacgagctcacccgcgatttcggccccgagcggccggtgcccgtgctggacgagaacgggcgtcccgtgccgcgtgcggacgcttctgaacctgaatccgagtccgaaccaggctccgaatctgacggaggcgacgacccgagccggttcgaaaccgttccgtatgaccgtgcggaacagcgcaagaggctggagaaggcgaagcgcgacctcgccgcgctcggcaaggtcaatccgttggccggcgaggaatatgacgcgcttgagacccgcaaccaatacctgaacgaccagcgcaacgacgtggtcaaatctcgcgatgatttgatgaagctcatcagggatctggattccacgatggtgagcgtgttcaaatccgcgttcgacgataccgccgccgcgttcgagaagatgttcgccacgctgttccccggcggtaccggccgtttgcgtctcgacgaccccgatgacctgcttgccacgggcgtcatcgtcgaggcgagcccggccggcaaacgcgtcaagcagctgagcctgctgtccggcggggagcggtccctgaccgcgctggcgctgctgttcgcgatcttcaccgcgcggccgagcccgttctacgtgatggacgaggtggaggccgcgctcgacgacgtgaacctgacccgccttatcaacgcgttcaacgaactgcgcgaacacgcccagctcatcatcatcacccaccagcagcgcacgatgtcgatcgccgacgcgctgtacggcatcacgatgcgctccgacggcgtcaccgccgtagtcagccagaaactcagccgctgaccccacatcgaagaccaccctccggcaccgcgcgccacctcccgccagcgggaggattaccgattgccgacccgctggcgggggctgtcggccgtaggccgactgggggtggccgtgcatccggggatgtggctgttgctccgcccgaccgacctttttcgcctgcgccgactctagcggcggatggccttggcccggctgacggtgtcctccacgaggacggcctgggcgtcgatgatcggcagctgaggcagcgggaacgcctcgttgagcacggagagctcggtgcagccgagcattagcgtatcgcaacggcacgtgccggccggatcgagcatcgcctgcagcaccgactcgtagcgctgcagattcaggtcgccggttcccttcacgtcgtcgtagatcagtgacgtgatgcgctcctgcaactcgtcgtccggctcgacgaaggtgtagccggcctcctcgacggcctgacggtacacgcccgaagcccgcgagcccatcgtgccgaggaatccgacgcggtggaaacgctccttggggtattgcccggccatgtgcgcgacggcgccgcgcggcatgtgcaggatcggcaccggcgtcagcgactggaaatggtcgtagaagtaatgcgcggtgttgcaggtgagcacgatgaagctcgcgcccatcgcggtcgccttgtcgatgtcgtcggcgattatcgggaacgggtcatcgtcggactgcccgatgatgaacgcggtccggtcgggcacggccgcgtcgttgaacacgacgtagtcgaggaactcctggtcgctgtgggcgtgcgtctcacggttgaccaaccggatatagctttccgtggccagcgtgcccatgccgcccaataccgcaaaaaatggtcgtctcataaatgtcgccgtcgattccgaaaagtcagtcgttcttgccgagatacgtgtcgtagttcttcgcggtcagccggtgcagcctccacagcagcagccggcgcctgaacgacaggtcccgcccgtagcgcagcgtccagccggatttgcccgccttgtgcagcgcgattccgcggtcaagcgcctcccccggctccgcgtacttcttgagcgtcgagaacggcacctccagcagcatgctgtcaccgcggccgatgaccgtgtcgccctccatcgggttgccgagcaccaggtcgtcgacgaaatactcggccaggttgaagccgttaagcgtcacgaagaagttcgtgcggccctggcgcaggttgatttcgaacagcttgtactctccgtcgcgcgggtcgaacttgatgtcgaagttcgcgacgccctcatatccgatgctttccaggaagctcttgatcttcaggcagaatccctcgttgtagtcggggatgatcgccgcgtagttgccgatggcctccggcgtcgggtcggcgagcagcacgtggccgagcaccatcatgcgcacatggtggtcatggtcgacgtaggcgttgagcacgcgcatgttggcgtcggagccggggatgaagtcctggatgatcagctcggagccgtagccggcgccgtagatcgcggagacgacatgggccagctcctcgggcgtgtgcaggatgaacgccttcttgcgtccggggaagtccacgtgcaggtattcgacgctgttcgccggcttgacggccacggggaagccgaacggcaggtcgtgatacttgccggccgcggcaccggccttgtccagaacgaacgtgagcgggtgcggcaggtcatactgggcgcacagctcgtagaaggaggtcttgttgctcagacggtcgtgcaggtcggcatcgaccgacacgaccgtgaaatacggcttcagctcgtccttgtaccggctcagcagctcgctgtagtcgtcaccgcacgcgatgagcaggaacgtggtgtcgggtcgctcggacgtgagccggcgaccggcctcgaccatgtgacggcggaaggattccggctcggtgaagtccgcgaagaacgtcggctccataatcgaactgaatttggtgacggaaagctgcatacggccgtataccagcgatttcaggccatacgcgctgtggaacgcgcgggccatcgcgtaggcgcaggtttcactgccgagtagtacaggctggaaagccgtcattatcgatccttctgttggacgttcacgattgcttatgacattctacatactccgtgtggcgatgggaggccgtttcgtgcgcagagtgcgaagatgcggtcacgcgggccgttgcccctggcgcggggggacgatacattgaaataagacgtattctcccgatggaacgaggttggtcatggaagagacgacggcacggggattcgcggaacttcgtgaggcgttggcgtcccgcaccgggacgcggccggaggactggttcccggtcttcaaggcacggtacggcatgcaggtggcgttcgacgcagtgaggtcggttcgtggcgacggctcggtgctcacccagctgttcacctgctgcacggcggtcgatccgattgttgtgagcgggctgagaccgcggtatgcggatgtgggcgccgacacgatgggcattgacgtcgccaaggtggagtccatgccgctggggagcgacgagcaggtgcatgcgatggtgatgcagcatacgtttggcgcgatcgatgaggactcgtcccggcggctggccgcgctggcgggggagatgggggcgttgctcgtcgaggattgcgcccactgcgtgacccgcatggcccgtgatgctgcgggatggccgttggccgacatttccgtgcactcgttcggcgtggagaagatgctgccgaccagattcggcggcgccatctgggtcaatccgcggctgcgtgagcgggatgcggcgctggacgccgagacccgaggccggctcgccgcgctggagcagccgtcccatcatctggatacggtcacgaaactgtatatcaacgagaaccgcgtgctgtcgcgtctgggcggattcggcgggcggatgcgtgagcgactcaccgcttcgggctggtatgagccgccgatttccgacaaggagcgtcgcggcgcactggaatatgagccgatgacggtgacgccgtggatcgcgcagcaggcggtggccggcatctccgcgctcgacgccaatgagaatgggcggcgcgcagtcgtgaccatgtatcgcgaggcttttgcgggcgtcgacgggttggacgttccggcagtggtgatggacggcgaggcgcagccgctgttgcggtttccgctgttcgcgcgggataccgaggcggcggagcgcatcatcgccgcagcgcggcaggcgggtggctacgccgaacgctggtaccgccccgaactgttccccggcgtgaccgatccggccgcctatgggctcgacacgttggaccgctccaccgtgccggtcagcgaccgtctggtctccaccgcgctatgcctgcccaccgaactgggtgaagacgcggttcgccgcgtcatcgacgccgtccgcgccgccgtctgaccaccggcacgtctgaccgccctctggcgcgcagcgggcggtcagacgtctcacccgttacaccgcgccgggaatcttacttcttgagggtgttcttcagtgatttggcgagcttgagggagctgtagaaggccttcttgatcggtacgtcacgcccggcggccaccggggtgatttcctcggtgaacttgcacttgaattcgttgagaccgttgaggctcggtgccagctcggagccgatgcccatcagatcgtattcggtgatgccctgcgagccaaggatgcagcactcggtgtacagcagcttgtcggtcacgtgcaggcgcatcacgtcgttgcgcatgccggcatagtagcgtaccgcgtgcgtgccgttgacggtcacgattgaccatgccaccacgcggccctcgatgcgggccgcgaacacgcggcaatgatccgcgcccagcgcctcgatcatgtcggagtagtcggtgatcggagcgggcgtgaatccgtcgcgcttgccggtctccaccatcacgtcgtagtattccgcgaagtcggcgatcgcctgcttcgtctcgtcggcgatgtcggccgggcattcgcgcagcgacttgcgcacgtcgcggcggccgcgacgcttcatgcgactcaggatcgcatcgtcgccgccggtcacgtcgatcaccacggtctggtcgtacggcacggtcgacagcaccggcacggtgccgtcggtgaaccacgtgtcgatgcggatgaacgccacgtgcctgtccgctcggtgcacttcggtggcgatcgcgtcgatggcctcgcgttccagcgcctcgtccggcttgacgatccaggccgggccgtgcatcgaacgcaggtaatggtatccgtgcgtctccatgtcgatgaacgcaatgaacgcgacggtctcgccgtctcgctggatcatgtacacgccccaaggagtgcggccggggatgtccgcctggaagcgtgcccacacgtcggtctgttcgatcggcagcgtcacgccggcatcggccgccgcctgttccatttgctggtagtcggttttctgtaacgtaatcatgcttgtcttgcttgtctttctatcggttcgtgcgctttggcggctcaggcgaacatgcgctcgacgatgcggtcgtcgccctcgaacggcacgtgcttgttgtggtccttgatccagcgttcgtcacccttgccgatgatgaggatgatgttgaaccggtcggcgtgcgctcgggcgtcgtagatcgcgttcgtgacggcgctcgggcggtcggagatgacggtggacgcgatgccgggcacggtgatgtaccgttgcatctccatgcagatgtcgatgaacggttcggtgtccgtgtcctcggcggtgaagatgaagctgtcgatgcgatgctgcgccgcttcgacgatctccttgcgccggtcgtacgccttgttgccggccgagccggtgacaagcgtgatgcgcgggtgctgcgagccgaaccgctcgtcgacgaaatcgagcagcgcggtcacggaggcgtagttgtgcgcgtagtcgacgatcgccagcgtgttggactgcgggtcgtggaactgctccatgcggccggcgatgcgcaccggctccatcgcgtgcgtggccgcggcgtcggcggtcaggtcgattccggcggcatgcgcgatggccagcgccgctgccgcgttggcgtagttgaagtcgccgtccaacgccagacggaactcgccgagatcagcgccgtctgcggcgatacggtaggcgctgtgctcggcgttcgccgggcttgcggtgacatcggcggcatcggatccggcggggctctgcccgtccagcagctcgaacgtggtgaccggcacgccggcgtccgccgcgtcctgacgcagcaggtcggcatgatcgctggccgcgccaagcaccagcgcgtggctgttgcgcacgatctggcgcttgcaatacaggtaatcctcgaacgtcggatgctcgatcgggctgatatggtcgggggagatgttcaggaacgtggccacgtcgaacgtcagcccgtacacgcgctcgaccttgtacgcctgcgaggagacctccatgacgaggtacttcatgccgttgtcagcggcctctcgcatcatgcggaaagcgtccatcgactcgggcgtggtcaggtcggactcgacgtacgtgtgcccgtccaggcagttgtccacggaggagaacagcgctgccttgccgtgcgagtgggcgttcagcacggcctgggtgaagtacgcggtcgtagtcttgcccttggtaccagtgatgccgaccacggtcagctcgtcctgcgggcgtccatagaactccgcggacagcaggctcatggccttgcgcgcgtcattgacgatcaggccgggtgcgccggtctctgccgaaaaatcggtgtcggccacgtatgcggccagcccgcgctcgtcgatgtcatgcagatactcggccttgaaccgccccttgcagcacagcagcgtgccctcgcgcacgtccctcgtgtcataggtgatcgccgaaaaatcggtgtcagccccttcgatgtcgtgcgcatcaagcgtccaacgatccgcgcggatgatctcccgaagcagaccgtgccgcttgagcagttgcgccgccgatgccaacgttaccgtcataccaaaacctttcctcatggtgccgctgccattgtacaagcccgacgaccgcgggaacgatatgcgcgacatgtgctgataagtccatcacaaaaccgtgcccacgctcacaatttcaccgcacgtcttgcatacaatagtgagcgtgaccgacgaacagcaaccgaacgagaccacggcgcaggcgcgagcgagattcgagaagctcgccatgcccgcggtcaacgcgctgtaccgccaggcgatgaagctcaccaacaatcccgatgatgcccaggaccttgtgcaggacacgttcgaacgcgggttcaaggcgttcgacagtttcgaggacggttcgaacttcgaggcgtggatgaccaccatcgagcgcaacgcatacttcaaccagtacgcgaaggcgaaacggcggccgcagcgggccaacgactccaccggcgaatacgacgactgggacatctacgcggcgtccgagcactcctcggaggggctgaaatccgcggagcaggagtacctggacgccttcgcgccgcaggagatcatggcggcgctcgcaaaactcccgcccgagcgccggcaggtgttcatcgacgcagccatcgatggcaagtcgtaccagcaggtcgccgacgagcagggcgtgaagatcggcacggtgatgagccgcctgaaccgtgcgcgcacccagttgaaacgcgaactgtcatcgtacgcgctggcgcacggatacggcgacgcccgcaagcaactgccaagttcaccgtccgcgaactccagatccccggtgagcgttcataatggagatgacggaatgcgatccgttgcgacgagcgaaaggagcaggcgtgagtgaccctattgagcggcacagccatatttccatcacacggcagacgcctgtgggcatcgtccatgcggatatgcatatcacatcggtggagatttcgggcatgcccggtgacatgggcgatgatctggtcggggactgtttcgacccggattcgtgttgcgacgagcatgagaaggcgatgatcgcggcgctgcgtgcgtatctgcggcccgaggtcgcgccggaatgtctgctggcgcggttgcgcgacacgcttgaccgctgctgctgcgaggatggcgggaatgctgccggtgccgtcgacgagccgggacggtccgcgcaacccgcgcagcctgtacgcggcgctgcggtcgtgtcctgagacgcgatttcggcttgggcccctgtctcgaagctcggcaagcaggataaaacgggcctgcataataaaacggaataataagataacaaacgggtctgcccggctttcgctgggacagacccgttgtcgtctgttatgacaccgccgtatatggcgatgtctcgcggcgtggaatcacgccgtcaggcaagaatcaggcgttcggccttttgccgtggttggcggccttcttgcgacgatccttgcgcttgcgtccgcgcatgcccatgatggactcctttactacgattaataagccttgggaattatcacatacggggtagacgttgtgcaagtggcgaattgtcaccggccgtaggacggccgggtgtcggtcacttgaccgtcacctcgtagcgtaccacggtcgtgacgctcttgccgggctctatcacggtcaggtggtcgccgctgcggaacgcgttggccggggcggtcatcggttcgacggcgatgccgttcggatgctggtcgaacggggcgccggtggccgtgtagcattgccacgcgttgatggtctcgtcgccgaccagcttgatctccatgccatcggggcgggtgaacacggtcgttgtcgtgccgtcgtcggcgcggtggacgtccacccaggcgtcgtcgaacgcgcgtccgtccagaaccgggtcgtcgcgcagatcgaacttggtgccgtccacaggctcggtgccgttcggcaccagaccggcgtcaacggtgacgtgcgtgtccgcgtcgatcttcaggcggcatgcggccgaatcggcgtcacgctgctcgctggtctcgccgtttttgccgttcgccacccacgggtgcaggccgagcgcccacggcgccggctcgtcgccatcattgcgggcgctgaccgtgacggtcatgcccttgtcgttcagctcgtacgtggcggtgacggtgacgtcgaacggatagccgtcgaggttcgggaagcgcagtgactgggtgacgctgttctcggtgagcgattccagcttccacatgtactggtatgcgtagccgtggttcgcgttgttgcgcggctcgggatgatactcgttgaccggcgcgcagtagtgcttgcagttgaagtcgtattcgccgtccttgatgcggttcggccaaggcgcgaggatatagccgcagcaggtcggcgtcaggtcgtccggtccgtagctgcagaacacctccttgccgccgtagtcgaaacggcgcagcttcgagccgagctcgcagacgacggcggagaaatcgccatgatggatggaatactggttgccggtacgcggtgtggtgcccattgcttgctccatgatcgacagtgatattgttaccgctcgctatcatagtgtgcgctgggcttctgccgtgtgcggtcggggtgtcgcctgttgcccccgggcgttgtcatgtgccggtatcgcacgtgtagggatgttccggccgcacccgtgcgtgtgcctttgctacgctgagtcgttgtgattgagtgatgccgcatggcggccactgactgcatgaggaggatgatatggcgaaacgcatcgtgctggcggacccgcgcggattctgcgccggggtggaccgggcgatcctcaccgtgcagaccatcctgaaggccgcgtcggcgcgggtggatggcctgccgccggtgtatgtgcgtcgtcagatcgtgcacaaccggcatgtcgtcgaggatctcgccgcgcagggggccgtgttcgtgcaggagctcgcggagatacctgacgaggctgctgccgccggcatcccgatcgtgttctccgcgcacggcgtgtcgccgcaggtcaaggcggaggccgcacgccgcggcatgcacgtcgtggacgccacctgcccgctggtcagcaaggtgcatcgtgaggtattgcgtttcgtgcgcgaaggctacgagatcatctacatcggccatcgggggcatgatgaggcggtcggcgtggtgggggaggaccccgtgcacgtgcatctgatcgaacatgaggcggacgtggattcgctggatttccggccggagcagaagctggtgctgctcacgcagaccacgctcagcatcgatgagacggccggcaccatcgcggcgctcaagtgccggttcccgtggatgaaggagccgccgagctccgatatatgctacgccacgtccaaccgccaggccgcggtgaagctcgttgccgagcagtccgatagcgtggtgatcgtggggtcggcgaactcctccaactcggtgcggctcatggaggtcgcgcagggggcgttgggggagcgcgggcgagcgcaccgcgtggatgacgcgaacgagctcgacccgtcatggttcgacggggtcgaggcggtcggcatctcgtcgggcgcatccgtgccggacgaactggtcgcgggcgtcatcgaggccttgcgcgcacagggcttcaccgatgtatccaccgtggagaccatcaaggagaacatgcatttcgtgcttccggcggaactccgccggaagccctcgcaggcgcggtagtgcgcctgctcgcctcatcgccgctggcgggacgaggcgtatagcaaaccctatgtgagggtgttcaacgccaatgacggggccgccacggttcccggcatcgcggcgggggagtgctccacactcgcggtcgacggcaaggtgacgctgacgggaggctccacggtgaacgtgggcgctgacgggtatgcggcggcgggactgtccgccaccggtgcgcccgtgggcgccgtcgcgcttgccgaccgcagccgggtccttgctgcgacaccgtgaaaccagtggcccaagcggcggagaatccgccgaatagtcgaggccttcccgattcgcgctctcaaaactcgcagatacgaaaagccgtttgttggaaaatggcggtttccgatttcgtatcttcgagttttgagagcggtagtatggaagacatgggcaaaaaaacgaagcatgagaagggtgccggctccacgccggcgactgtgcagctggagaaggccggagtgccgttcaagacctacgagtacgagcattccaacgaccacatggatgacggttacggggtggaagccgcgaagaagctcggattcgatgagcatcaggtgttcaagacgctgatggccgacaccggttccgagcgcgtggtgggcgtggtgccggtcagcggacacatggatctgaaggcgttggcggcggcggtcggtgcgaagaaggcatcgatggccgacccgaaggtcgcgatgcgcgagtccggctatgtggtcggaggcatctcgccgctcgggcagcgcacgcatcacaagaccgtgcttgacgagagcgctctgcaattcgacgagatcctgctgctcatcacccttcatcagcgtaagtatgacaagctcgtcgtgttcaaaaaatcgatgcttgaaaaaatgttcccgaaagatggtgagtctgtacccgagattcgtttcgctggttttactgacccttgggaacagcgtaagttgggggaacttgaaaaagatgccaccctttacatgggcagagggagggtaatctccgcgaaggatatgtcgaatacaccgggaacatttccggtgtattcctccagtgctcttgataatggacgcatgggggcttacgggaagtacatgttcaatcaggagctaatcacctggtcgattgatggaggaggggctgtcttttaccgaagaaagcaccgtttctcggttacgaacgtatcaggctatatcgcagttaatccagagaagataaactgcaagttccttgcctacgcgatgtctcttgcgcattctcgaattaaatttgactacacggttaaagcgcatccgtccgtaatacggtcgctttatacgatgggtataccaatttcgcttcaagagcagcaagtcatcggctccttcttctcccgtcttgacaacctcatcacccttcatcagcgtaagttggaattgctgcggaacatcaagaaatccttgcttgacaagatgttcgtgtgaggggaggaatcgccatggaaccattcgatatcgcgaagctcgcctcatatcgcgagaataaccggatcgaggcgaagtccgcgaagggcggcctcccgcgcagcatatgggagacctactccgccttcgccaacacctatggcggtgtcatcctgcttggtgtcaaagaacgcgaagacggcacatttgaaacagtcgggctcacaccagtggaagcggaacatcttcgccaggacttttggaacacggtcagcaaccggtccaaggtaagcgccgtgctgcccatcgaatcggaagtcgaggtgctccaagcggatggtggcatggtggtggctattcacgttccgcgcgctccgcgtgacgaacgccccgtgtatatcaataatgatctcttcgggggaacctaccgtcggcgtggtgagggcgactaccgttgcacgcggcaggagatctcagcaatgctccgggatcagggagctgagacgatggattccaaggtgctggacgatctcactgttgccgacttcaatacagacacagtgcgggcatatcgcaatcgtttccgcgcagcgcgacagggcagctcctggaccgatctcgatgacgagcgttttctgcgtgctgttggcgcggcaatggtgagccgagaagacggtaagcttcatcctacgttcggcggtctgcttatgttcggcaacgactatgacatcgtgcgcgaatgtccgcattatttccttgattatcaggagactctagatccgacgattcgttggactgatcgtgtccattccggcgatggcatgtggtcaggcaacctctttgatttctttttccgcgtgaaccgcaagcttgccgaatccctgaagaccccgttcaagctcgacggcattttccgcgtcgatgacacccccatgcataaggcggtccgtgaggcgttggccaactgcttgttcaacgccgattaccatggcgtacgcggagtggtggtcagacgcacccccgacaagctggtgttcgagaatccgggtgatatccgaaccggcattgaacagatgcgcctcggcggggtgtctgatccgcgcaacggtcttgtcatgaagatgttcagcctaatcgatgtgggcgagcgagctggtacgggtgtccccgatgtgttcgccacatgggcgaatgcaggacttcctgaaccacggattgaagagaacttcggagaagctgatcgcacgatactcacgctcatgttggaggcggatgccaagcctgataacaatgagcagataactgacgattatgagcagataaatagttcgaatgagcagataactgacaataatgagcagttaaatggtttgaatgagcagataaccgagagacagcgaattgttctgcgttttgtagaaaagagccccagagcaacatatgacgacatggcacatgccgcgggagtttcatcagcgactgtgcggagggatgctgaaatactcattgggcgtggattacttaagcgcgtcggctcgcgaaaagcaggacaatgggaagtccaaaggggagaagaatcatgatattcgatagcgaatcggtgttcgaggaaaacgtcatcaccgtgcttaagcagcatggatggaaggacggtgtcctgcgctatccaactgagcgggatttgctcgacaattggaaagacatactgtaccgcaacaacaacgacatagacaggcttggcaaatacccgctgacggacggggaaatggcacaggtaatcgagcagatcgagaccctgagaacgccgctcgcgctcaattcgttcgtcaacgggcgtaccgtgtctatcacgcgtgacaacaaagaagatgtggcgcatttcggcaaggaagtcagtctctacatctatgaccgcaaggaaatcgcgggcggcaaaagcacttatcagatcgctcagcaaccggtctatccagccaagaacaagatgttgagctcgcggcgcggcgacctcgtgctcctcatcaatggcatgccattgatccatatcgagctcaagaaaagcggcatacccgtcagccaagcgaccaatcagatcgaaaaatacgcgcacgaaggcgtgttcaccggcctgttccgtctcgtgcagatcttcgtggccatgacccccgacgacgccgtctacttcgccaatcccggcgcggacaaattcaatccaagctattacttccattgggcggactacaacaacgagcctatctgtggcgggcaacacccaggcaaagacgaatggaagctgttcatcggcggcacctccggcaccgccggcctgctgtccattcccatggcgcaccagctcatcggcttctacaccatcgccgactcggcggatggatgccttaaggtgctgcgcagctaccagtacatcgcggcaaacgccatctccgatgtggtgaggaaatgtgattgggaacagcgaccctccatgccgggacgacccggcggctatgtgtggcacaccaccggttcaggcaagaccatgaccagcttcaaatcggctcagctcattgctgactcgcatgacgccgacaaggtcgtgtttctcatggaccgcattgaattgggtactcaatcgttgaaggagtaccgcagcttcgccgacagcgagacggaagtgcagggcacggagaacaccggtgttttgcgggacaaactcaacagcaccgatgtcaacgacaccctgatcgtcacctctatccagaagatgagcaacgtgaaagcaggggagcggggcgtcacccagacatggctggatcaacttgctgcacgacgcatcgtcttcatcgtggacgaatgccatcgctccaccttcggcgacatgttgcaagtcatccgccgttccttccccaacgcgctgttcttcggattcacaggcacacccattctgggcgaaaaccagaagaagaactccaccaccgccatggtattcggccgttgcttgcaccggtacagcatcgccgacggcattcgtgaccataatgtgctcggattcgatccgtacatggtgaccacgtacaaggattccgatgttagacgtgtggtagctcttgacaaggcgaaagctgagagtacggaagatgcacttgctgaccccattaaagctaaggtgtttcagcattacatggataaatccgaggtccctatggggccgatggttgatggcgctggaaaccgtatcagtggcatcgaggatttccttggacgagaccaatatggcatcgactccccgcatccgaacatggtggtctcggacattctcgaacagttcccggtgctcagccatgcgggcaaattccatgcgatgctcgccactagctccattcctgaagctgtcaactattatcacttgttcaagcagcaagcacctaagttgcatgtaacggcgttgttcgatcccaacatcgacaacaacgaaggagcaacggataaagaagatgcgctgactgaaatcatcaccgattacaacgaggcgttcggcaaagagttcatcatccccacatggccggcgatgaagaaagatatttcgtcgcgactatcgcataagagtccgtacggcggcatagcagcaaaccgcagtcagcagctcgatttgctcattgtcgtggaccagatgctcaccggatttgactcaaaatgggtgaatacgctgtatctcgacaagatcatcgactacgaaagcatcattcaggcgttcagccgcacgaaccgcctgttcgggccggacaagccgttcggagtcatccgctactaccgcaagccgcacaccatgtacggcttcatcgaagcggcggtgaaactgtactccggcgacaggccgcttgatttgttcgtgcagaaactgcccgcgaacgtgaaatccatggatacacggtacttggagattctcgacgtgttcacggataacggggaatcggacctcatgcagctgccggaatcggtggaggccagacgcaagttcgccaaggagttcgtagagctgaatcgttaccttgaagcggcgaaagtgcagggtttcgactggaacaccacggaatacaaggtcgatggcacggatgccgacgatgcggatgagaacgatggcgggaacggcgaacctgatatcgtgcgtccccaaattgacgaacgcacatatctgattctcgcccagcggtataaggagctgttcgatgatgacagctgcgccggagaaccggacgatgacgggagatgtgaccccgaagcgccttatgagctggaagggtatctcaccgaaatcgacaccggactgatcgacaccgactacatgaatgccaacttcgtcaaatggctcaaggcactcaaggaggacagtccggagttggcggagatgtccgcacagctgcaccgatccttcgctgcgctttcgagggacgaacaacgacttgctgagctgttcctgcatgatgtggagcgtggcgatgtggaagtcgaggaaggcatgacgctgcgggactacatcacgcgctatgccaaacgagagaaagatgagcagatcgacaagctcgtggatcatctcggcgtcgacaggtcgttgcttgaagaactcaccgtcagatatatcaatgagaaaagtctgaacgcattcggccgattcgacgccctgcgtgacaccatcgacgtgccacgggcgaaatcgttcttcgagcgatgcatgaatgtgacgctgccgaatttcaaagtgaaagtacaggcgtcgaaactgttgaaacagttcgtgctcgaaggcgggttcgacatcgacgaggagatctcgcactggcgattcgccctctgacggttttgtaacgctgtacggtgccattcctgctggtgcttgtgtatgtctggccgctcgaccggagagccgccacgggaatgtatcacaacgctgatagtctggcagacagtcgaaaccgcacgaatatgcccattctccaaggagtatcgcatggctgaaaacaccgaatacctcgccctgtggggcggccgcttcacttccggaccgtcgcccgagctggcccgtctgtcgaaatccacgcagttcgactggcgactcgccgatgacgacatcgccggttcccgcgcccacgcgcgcgccctcggccgcgcaggcctgctgaccgccgatgagctcagccgcatggaagcctcgcttgacgagctgcagcgccgcgtcgactccggtgcgtttgcgcccatcgaagacgacgaggacgaggccaccgcgctggagcgcggcctgctggagatcgcaggcgacgagctcggcggcaaactgcgcgccggccgttcccgcaacgatcagatcgcctgcctgatccgcatgtggctgcgccgccactcccgcgtcatcgcaggtcagctgctttccctcgcatccgcgctgatcgaccagtcggtcaaggccggcggcaccgtcatgccgggccgcacccacatgcagcacgcccagcccgtgctgctcgcgcatcagctcatggcacacgtgtggccgctgctgcgtgacgtgcagcgactcgtggattgggacaagcgcatcgacgccagcccgtacggctccggggcgctcgccggcaacacgctcggactggagcctgtcgcggtcgcccgagaactcggtttcggcaaggttaccgagaactccatcgacggcaccgcctcgcgcgatctggtggccgaattcgcgttcgtcgccgccatggccggcgtcgacatctcgcgtctgagcgaggagatcatcatctggaacacccaggaattcgcgttcgtgcgtctcgatgacgcctactccaccggctcctcgatcatgccgcagaagaagaaccccgacatcgccgagctcgcccgcggcaagtccggccgtctcatcggcgacctgacaggcctgctcgccacgctcaagggcctgcccaccgcgtacgcccgcgacctgcaggaagacaaggaggcggtcttcgaccaggtcgatacgctggaggtgctgctgcccgccttcaccggtatgatcgccaccatgagcttcgaccacgaccgtcttgcggccgaagcgccgaccggattcgcgctcgccacggacatcgccgaatggctcgtcaagaatggtgtgccgttccgccacgcgcatgagctttccggtgcatgcgtcaagctcgccgaaggccgcggccaggagctgtgggatctcacggatgacgatttcatcgggatcttccgtgacttcctgcccgccgacaaggccccgcaggtgcgcgaggtgctgtccaccgaaggctccgtgtccgcccgcaacggcaagggcggcacgtcgccggcccgtgtacgtgagcagatcgcctgcgccaaggccaccgtcgacgcgctgcgcgtgttcgccaactccgtgagcgatggtccggcctacaagtccccgaagtccctgcgctccgtcaccgactgaccgcctccacatccccgccagcgcgcgcgggttcatcctgaaggatgaacccgcgtgacaggagcctgacctagaatcatgactggaagagacacagacatacggaagacggattcgggcgaagggaaacagtgtgctgacgcgcaatcagattcggtcgttggtcaacgagcatgggcacgacatcatcgtccatgatcatatgcagcatatcgagcgcggatgctaccagcatggagcggtgacgacattcgcgcattctatccgcgtggcgtgcctcgccgtgtggatggccgaccgcctgcatctgtgggacaaggtcgatctgcattcgctggtccgcgcggctctgctgcacgattacttcctgtatgactggcatgactgggatgacggcgcccataggctgcatgggttcacgcacgggcaggctgcattgcgcaacgcagtgcgtgacttccgcctcaacgcgatcgaacgtgacagcatcgcatgccacatgttccccatgacgctcaagccgccgagctacatcgaaggctatctggtcaccatggccgacaagatcagtgccacgcgggagaccttctccctggagcggttctacaagccgcaactggagtccggtaaacccctcgccgcaatcgaaagcggagcatccgcagcgtccgcgcacgacgggcggcacaagccctcacggagccgggaggtgctggcctgatgctgttcgtggaaaaactgttcctgtggttcctgttctacagcttctgcggatgggtgtacgagtccattctcgtgtccatcctggagcgccggccagtcaaccgcggattcctcaacggcccgttgtgcccgatttacggtgcgggcgcagtcggcgccgtcgtggtgctgggacaggtacacaatcccctggtggtgttcctgctttcgatggtcggtgccagcatactggaatacgtcacatcctgggtcatggaggcgctgtttcatgcccgctggtgggactactccgactacaaattcaatcttaacgggcgcatctgcctgctgggggcgttcgtgttcggcgtgggcggcgtgctcatcacgtcggtgatccagccgcaggttgcaggtgtcaccgaccggctgccgctgcccgccatccactggctgtgcggggtgctgttcgtgctcacgctgatcgacctcgtcgtcacggtgtgcggcatcatgcatttcgagaacagtctcgacaatctcatggccgccatgacgcattacggagacgccatgaaggtcgccgtcagcgatgtcaccggcaagatgagcgaatcgtggaaatccggcaaggagatgtcgttcgacttcatgatgcgggtcagggacgcggcgatgtccatcttcaaccgtcagcagcgtcgaatgatcgcctcgttcccgaaactgcgcaccgaacgcaacaacgatgtgctggagcagctgcgccggattctcgaaagcctgtaccgtcactgacggccggattcaagcgacgaaccggggagcattccccgacgtttcgcgggcagtcgtcctggcgcatgctgtcgatatgttctgcgagactgatagatgcacaatgcccagaatttgatagggagtaccaatatccatggctcacgtcaccgatttcaaagaggccggattcgattccgtccttgaagaactggaatggcgcgggttgatttcccagtccaccgacaggaaacaactcgccgaagcgttgaacggggagccggtcacctattattgcggcttcgacccgaccgcggcgtcgctgcatatcggcaatctcgtgcagctgatcaacatgcgtcaccttcaggccgccgggcatcatccgatcgccttggtcggcggcgcgaccggtctgattggcgacccccgccagtcgggcgagcgcaccctcaacccgaaggacgtcgtcgccggctgggccgaacggctcaagcggcagatcggcggcattctggaaacctacggcgacaatccggtgcgtttcgtctccaattacgactggaccgcacagatgtccgtcatcgacttcctgcgcgacgtcggcaagaacttccgactcggcaccatgctggccaaggacacggtcgcgcgtcgtctgaactccgaggagggcatctccttcacggaattcagctaccaggtgctgcaaggcaacgacttccttcacctgttcgacgagtacggctgcacgctggaaatcggcggatccgaccagtggggcaacctgacctccggcatggacctgattcgcaaggtgcgcggcgtcacggtgaacgtgttcaccagcccgatcatcaccgacgccaccggaaagaaattcggcaaatccgaaggcaacgcggtgtggctcgatgccaccatgctcagcccgtaccggttctaccagttctggttcaaccgccccgacgtcgagatggaaggcctgctcaaggcgttcacgttcctgccaaaggccgagatcgaacgactcgccgaagaatcgcgcaccaatcccggcgcacgcgaagcccagcgcaccctcgcatgggaagtgaccagcttcgtgcatggcgaggccgcgacgcaggcggcgatcgacgcgtccgcagccctgttcgggcgtggcggcgaccttgcctccatcgacgaggacacgcttgaagccgccatcgacggactcaagatagaggacgagtccggtgccaagacgttcgcgtccgtcggcatcgacgaccgcatcaccgaggccggggtgaaggcaggcctgttcaagtctatttccgaggcccgcaagaccatcaagtccggtggcgtgtatctgaacaacaaccgtgtgaccgacgaagagcagacgttgggtcaggacgatttcctgcacggtcgtttcgcgctcatccgccgcggcaagaaggcgctcggcgtcgtcgagaagcactgattcattcctgctcccactggcggggagctgccggccagggccggctggggtggttgcgccggcatggaggctatcccgctcatcgtgacatcgcatcgcaacaacagactttgcattaagaaaggcatacacgtatggcagaagaacagggtcgctccggcggcaaatcatacggcaaccgcggttacggctccggacgttccggcggttaccgcaagtcgggcggttaccgcaaggacggcgaccgcggcggattccgtcgcgacggcgagcatggcgggtaccgcggcaagggcggtttccacaaggatggggagcgccgtgacttccacaagggtggtttccgcaaggatggtgatcgtggtggtttccgtcgcgatgaccgtcgtgatggtgaccgtccgttccgtcgtgatggtgagcgcggcggtttccgtcgtgatgaccgtcgtgatggtgatcgtcgtgatttccatcgcggtccgcgtcgtgacggtgatcagggcgggttccgccgggatggcggtttccacaaggatggggagcgccgtgacttccacaagggtggtttccgcaaggatggtgatcgtggtggtttccgtcgcgatgaccgccgcggcggcgacaacccgcgttaccgtcgcgatgaccgccgcgacttccatcgtgatggcgatcgcccgcgctatcagcgcgatgaccgccgcgacggcgagcgtcgcgagttctccgccgaggagaagcgcgaatatcgggagcagaagcgtcaggactatatgaacggtccccgtcgcaattccgacggcacggtaagctacccttcgcagaacccctatacggatcgtcgtccgaacgagccgaagatgcccaagggcatggaatggtccatgctgtccaaggaagagcgtgaacgcctgcgcggcctgtccaaggagcacgccgagaacatcggcctgcacatcctcgccgcctatgcgctggaggagaaggatcccgaactggccctcgcccacgccaagtgggctgctcatcaggcgtcgcgcatcgatttctcccgtgagacgcttgccttcatcgcgtaccgtcagggcgattacaagctcgccctgcgtgagttccgcaccgcgtaccgcatgaacggcttcctcgactacctgccgttcatcgccgactgcgaacgcggcaacggcgatcccaagaaggccatcgaagtggtgcgctccgacgatgccaaggcgttgcatggcgaggcgaaagccgagatgttcctggtctatgccggtgccctcgccgacctcaagatgtgggacaaggccatcgagatcgtccacacgctcggacgttccaaagggctgccgggcgaataccgcatgcgtgccgtgcaggccgagcagtacttcctcgacgagtgcggccgtaccgaggaggccgccgcattggacgacctgctcgaccgtctcgaaacccagtacgccgaagccgatgaggacgagaccgtggacgacgtgattatcgatcacgacatggagcacttcaccgatgacgagctcgacatgctcggcatcagcgaggacgacgcccagttcgcgcccgacgactacgacgacatgtacggcggctccgaagacggatacggcgacgagtcggacgatgccgaatcggatgactccgatgactcagccgatgccgaagccggccagaactccgatgccgaagacgaggcgtcccttgacggcccgctggccgacgaggaggagctgacggccaaggagaccgaagaaggcgccgaatccttcaccgaccccgccgaccagaacgccgatgacaccggcgaagccgctgatgaagccgaggacgcggaacccgccgaagccgacgatgcgcagacggacgaagcggaagctttggatgccgccgaaccggctgcggaagcgcaggacgagtgacgtgcatgaacgccatgctcaaatccaccgaccgtcccatatctcagacgtaccggctggcgctgctcgatctggacggcgtcgtctaccggggcaagaacccggtggaacacgccgccgattccatcagggcggcgcagcgtgcgggaatgcaggtggaatacaccaccaacaactcctcccgtttccagcgcgtcgtcgccgagcagcttcgaggcttcggccttgacgtcgaaccgcggcaggtcatcacctcgtccgtggtggccgcccgcatggtggcccggcacgttccggccggagcgcgcatcctcgtgctgggtgccgagcatctgcgcgaggaagtggccggtcaaggactcaccgtggtagaccatgccgaggacaccccggaggcggtcatccagggatggtatccggacatgacgtggcagcagatggcggaggtctcgtacgcggtggagcggggcgcgctgtatctcgtcaccaaccgcgacctgaccattccccgcgagctcggcatcgcgccgggatgcggttccatgatccaggcggtcatcaacgcgaccggcgtcgagcctatcgcatccgcgggcaagcccgagtctgccatgtacgacgaggcccgactgctggccgcgggaaacgagacggagccggtcagtcgtgaatcgtgcctggcgataggcgaccgtctcgatacggacatcgaggccggcaaccgcggcggatacgattccctcgcggtgctgaccggcgtcaccaacccgcatgagctgatgacggcgccggcgcatctgcgcccgtcctatatcgtccgcgacctgcgcggactgcaggaggcccagccatccaccgatgcgagcgacggcaacgtctggacgtgcgccgacgcgaccgcccggctggaagacggctcactgacggtgagcgacgcgaccgacatcaacgccctgcgcgcggcctgcgccgctgcatggacgtacgccgacaacggcggggacatcggttcggtctcattgccggaattctcactgtgatcatcgccgcccgccgcaaggccggcggcgttttccgtgacgtgcaggggcacatgaaacactgggcataaggagcggccatgccggacgatattaccgaacgttacccacagctcgccgaccttgacggcaaagacgacgaccagcgcatcgaggtcttccgcgacgtgctcggccagctgcagcgcgagctcgacgagaaccactgaaagacaaggtcgctggcagggaaaccaccggatgtgaaaggtgcaggaatggaacgtcttgacgcgctcatcgtcggtctgggattggtgccgagccgctccaaggcacagcggctgatccgtgacggccatgtgctggtcgacggtgtcgccgtcaccaaaccggccgcgaacgtggccaccgcgtcctcgatcaccgtcgacaagggcgacgactacgtgtctcgcggcgcgtacaagctgatcggcgccttcgacgagttctccggtcgaggcctgccttcgccgcgcggcctgcgctgcctggacatcggcgcctcgaccggcggcttctgcgacgtgctgctgcgcaggggagccgctcaggtcatcgccctggatgtggggcatggtcagctcgatagtcgtatcgcgcgcgacccgcgcatcatcgagatgagcggtgtcaacatccgcgacgtgaccgccgcgaatctgccgtatcggccggacatgatcgtgtcggacgtgtccttcatctccctgacatacgtcatcccggtcattgcgcgcatcgccgcgcccggagcctcagtggtgctgctcgtcaaaccgcagttcgaagtgggcaagggcaatctcggcaagggcggtatcgtggaggaccggcatctgcgcgatcaggcgctggagacggtcgtcgattgcgcgaaccagcatgggttgacggttgcgggaaccgccccgtcaccgatcgagggcacccacgggaacacggagttcctgctgttcgcccgcatggatgacatcgccgcaaaggccgactgaaaaacgccgcatcgcgcgcggattcgtcgttcgtgtcacgtattgcgcagatacacacgcttggcggcgccggataccagcaatacgctggacgtgctgtccatggcgagcttcgtgatgcacgaggcgcgttccacatgcgattcgtcagtcaaccgtatgaagacgccctgcatcagggtgcagatgagcctgctgacacgcaaatcgccgccgatgattcgtccggcgttgctcgtctgggtgaattccgtcataccgctgcgcccgaacatggcgcttgacaggggagtcatccgcagccgttcggtgcgcagctcgtccgcgtccaacgtgccctgcatattcaggtatctcgtgacgatgcatgaacggttgcgcagcagtccgcgaacggtcatgccgccagggcacatgacatcgccctgcacgatgatcttgccggtgaaatccagagcggagcaacgcaggtcgcctccgacatgcagttcgccatgcccgctgattctgttgacatgcatgtcgccgcggcagaccagacgcccctcgcaatgcacgttcccgccgtcgagcctcatcgcatcgaacgagccgcgggcacgcaaaccgtcgaatcgcatgccggcatcgcaggagcagctgccgttcgccgtcacgttttgatacgagccgtcgggcacatgcccgtcaaccatcgtgatattgcccattgcgccaccctcgccgccgccgtgtcgatacgttgcgacgactgtgccgcaacacctttttgactgtaccaattggatggcgctgcggcacgtgcctgcgttcagtatgtggtcatacgggggtatggaggggtgcctggcatcggtcagccgcgaatgaacttgtcgatgttgtcctgcttgcccatgatgacgagttcgtcgttgcggtgcatgaccagttccttggaaccgtactggaactcgctgccgggcgccttgatgccgacgacggtgacgccgtagcgttcgttgaccttcgcgtccgcgatggaatagccgaccacgtgcgaaggcgtgtggatcttgacgacggtgtgcgagccctcgatctcgatgtaatccagatagtttccggacaccagatgcccgacgcgcttgcctgcatccgtttcggcgttgatgatgtgacgcgctccgatgcgctgcaggatgcgcgcgtgctccttcgacaccgatttcgcccagatgtcgctgatgccggcgtccagcaggtttccggcggtgatcaccgacgcctcgacgctgtctccgattgcgacgacggcggtgtcgaaatcggacgcgttgagctgctcgacggcgagcacgtcctgccccatggaatccaacgtggtcgccaccgaactgccgaatcgtcccagtccgacgaccagaatgctcctgttgttgcgtgccatgccatcatcctttccgccgccgtgcgcggcgatgcgccggtgccgccgtcatggacgccgccgattctccgggcggcggtgaacggtaccgcttctacgtcatgatatggccatccctggccgtccgacaaaggcggagtcggcggcatccgtcggatgcagacggtatcggcggcgccctcagccgaccacgatgggctcgttggggtatcgtatcgattccaaggcgcggggcctgttgatcgcgtatgcgatcgtcatcggaccgagacgacccaccaccatcgccgtggcgaggatgaacaacgccgctggattgtcctcgcgcgccacgccgaccgaatagccgccgagcccgaacgccgaacaggcgtcgaacagggcatcggtgagcgagcagcccgaggcgagcatcaacgccagcgacgcgctcagcactaggaacaggcaggcggcggtgatgctcaccgcggtcatcgccgcgcgcgtcggaatccggcgccggaaggcgttgatgtcggtgtgtccggtgaacgcggcacggcagatcagtaggatgaccgcgaacgtcgtgacacggatgccgccggccgtggaggtgctgccgccgccgatgaacatgatgacgctcatgaacaccttcgtcggctcgctcacctgcggcacccagctcaggtcgaagccggagctgcgcggcattaccgccgcgacgaccccgtaacgcagccgcgtctccacgtcggcgcccttgaacaggaacgggttgtcccattccaccagcaggaaccacgccagcgacagcagcaccagcgagaacgtcgtcaccaaggtgatcttggtgtgcaggctccaacggcgtgggggagtgcggtggcgggcgcagggccggcatcgacgcgcagctcgccaagcgtgacaccaccgagaaccgcgagttcgcgctcggcgcccacgcggtgcgtggcgacgccgccgcgaaggagtgggcctggaacgaggcgctcaacaacgccgacctgaccaacatgcagctggaggccgtggcccgcgggttcgccgccactccgcgccccgacctggccgagccgtatgccgccaagtactacgacgtggtcgactgggtgtggaagaacaagagcttccacatggccgaggcgctgcttgagggcctgtacccgtactacgctgacccggccacgctggtcgaactcggccatcggtggctcgccgaccatgaggatgccgacaacgccctgaagcgcatcgtgcgcggcaatgtggaatcctcgcagcgcacgctcaaggtgcgcgacttcaacgccgcgctgtaaggcggcgcgaccgacccatacgaaacgcccttcgcgtaacgtgcgcctgcaaggccgccgttcgcgcgaagggcgtttcgcgtgcatgagtatgcaccgacggtgcggcagagtcgtcgttgccgtatcgccgtgttgccgtgattcgttgtacaactcccgcatatcagcgaaacgcagatgttgtgcacctacggcgctgtacaactcccgcagacgggcaaaatatacgtgttgtacagtgacttgaaccgcgaaatcgttgatttcaagccattctcttatcgcgcctaaatatctgccgtcgtacaactcctgcataatgcgtaatcgcggacgttgtccagcgtgatgtaccgtgccgtcacatgccgcgcccctgcgactgcgccgttcactgcccgtataccgaaatgtacgggaaaggggtattgctgaaagcttcatgagagtacactttcggattgtagggggttcatcatgaaactcctcggcgatatcatccaaagacggcgtgagccgggaagggcaggttcatggtttctcgttggtcgagggtgaaggccggatgcgcgttcgcgctggcatgcgtattgccttgcgcgttcacgcccggtgccttcgcggcggatgacgggcgttggccggtggtgaacgacacggtggcttccgcatggaagcagggcattgacggttccggtgtgaaggtggcggtgctggatacgcaggcggtcgaggattaccccgcgttgaaggacgccgacatcacgtacaggctgggccggttctccggtatggacggcaacgaggtcgagtgcaaggtgggcggcaggccgttgaccgcgacgatcaaggccggtgacgatgggtactattcatcgcacggcactgacatgctgtcatggatcgtgggggacggaggcaattacaccttggacaaggcggggatgctgggcgcggcgcccaaggccaggatactgcacatcacgaccatggggacgagcgccaccgcggcgacgacgttgtgcgacgcgaagaagctgggcgatgcgtcgagcgacaatggcgccgatgtcaggacggccgtggattggggagcccgcatcatcaaccggtcccagagcggcggtcttgacgatacggattatgccgggtatgtggatgcgctgcggcacggaatcatcatggtcggagcgcgcgcgaacgacaccacccccggcctggatgatctgaccggcgacccgcgcagcatggagaccttccccggcgtggtgatggtgaacagcgtggacgagtccggcaccctggcttccacctcggacgtcatggacggcaacgtggcggtgctgtcgtacggggcgaacgtgctcaagcccatcaattacgtcgccgaaggcgataaccgcgtgggcaacggcggcacgtcgaccgcggtcgcggtattgtcgtcgtacctggcgctggccatgcagaagtggcccgacgcgacgggcaaccagatcatccagtctttgatacgcaacacgaagagcggcaaaggcaagccggtcatcgacccggagcgcaaacgcgggttcggtgaggtggacctgaacgcgctgctgacggtcgatccgacgcagtacaaggacgtgaacccgattctggaataccagatgaaggccgccgcccaatacccggccctgaaggactggtatacacaggattgcaagacgaacccggacggcgttggcaccgcggcggataatgtcccgtgtgaggccgggctcatcgggcgggagtatgagcgtcagcaggcggcgtggaagaaggtggagcagtgccgatcagacggcggctccgactgcatgaaatactccgccacgaacaccgccgatggtgagaccaataacaccacgacaccgaacgggcaggccaagcccgaaggagacccgtcgcagagcgcttcgtccggcatgccggtgtggctgtggggcgtgatcggcgcaggcgtggccgctatagccgcgggcgtgataatcgccctggtggtgtctcggcggcgtaggacgcgcgcgcggattcccgtatccggtgtggcatatggcagtgttcgatcataccccaacggacccgtgccatcccgcccatattctggtggatcacaggggagtgggggccaggctccgcctgccgaaccgggtgccggaacagccgcctagccagccgcagcagccatatcctcagcaggtcccccggcaaggattcgctccgccgcaaccatacccgccgactgaaccggctcccggagttccagcccctgacaaccatggtggcaatggaaactccggcggacatggacggcattcagggtaatgaccacagcagagaaggccccaatcggccccttctctcattggcaaatgactcgcgaatctgcttgtattctctcacatgcctttctccgaaactggcaattgcgcgtgatttgggcagtattcatggatatgggtgcaatcactccgccggccggttacgatggtgctcggtatgtcgaagagacggcggaagccgtcgaagcaaaggaatcgcagattatgccgagattgtttggaaccgatggcgttcgtggattggcgaacagggatttgaccgcgcgtctggcgcttgatctgggggatgccgccgtgcgcgtgctgggcaacagtgccgtcagggaaggcctgccggagggccgccgtcgtgcgctgatcggccgtgatacgcgcgtgtccggtgattttctggcgtccgcgctgtgcgccggcatgtctgctggcggcttcgacgtgatcgacgcgggcatcatccccacgccgggcgtcgcgttcctgacctccgtgctcaacgtcgagatgggcgcggtgatctccgcgtcgcacaaccccatgcccgacaacggcatcaagttcttcgcgcgcggcggtttcaagctgcccgacagcaaggaggacgacatcgaggccgtgctcggtcaggactgggaccgtccgaccggcgcgggcgtcggccgcgtctcgcatgagacggtgaccgccacgaacctgtacatcgaccatctggtgtcgaccatcgccccgctcaacccggacaagacccagcccaagccgttgcgcggcctgaagatcgtggcggactgcgcgaacggcgccacatcggtggtcgctccggaggcgctgcgccgcgccggcgcggaagtgctggtcatcaacgcctccccggatggatacaacatcaacaagaacgccggttccacgcaccccgagcagctgcaggccatggtcaaggccaccgacgcggtgatgggcgtcgcgttcgacggcgacgccgaccgatgcctcgccgtggatgaggacggcaacatggtcaacggcgatcagatcatgggcatcctggcccgcgccaagaaggaggccggcaagctcgccgacaacacgctcgtcgtcaccgtgatgagcaacctcggactcaagctcgccctcaaggacatgggcatcaagaccgtgcagaccgcggtcggcgaccgctacgtgctggaggagatgctccgcggcggctacacgctcggcggcgagcagtccggccacgtcatcaaccgcgagttcgccaccaccggcgacggcaccctgaccgcgctcaccctgtgcaacgaggtcgtcaaatccggcaagagcctcaagcagctcgccgcggacttcccgcagctgccgcagcagctcgtcaatgtgccgaacgtcgacaagatggccgccaccaccaacgcggcggtgcaggccgccgtcgacaaggagtcgaagctgctcggcgacaccggtcgcgtgctgctgcgtccgtccggcaccgaaccgctcgtacgcgtgatggccgaagccgccacgcagcagcaggccgacgaggtgtgcgaccggctcgccaaagtcgtggccgacgagctcgcgctgtagaacgaataacggcaataccgcaataccaaggaatcattcgtatgttcggaaaaaacacgaaagtcgacctcgaactcaaccgtgaggtcgaacagctcctcaagaccggcggcaaggagcgaatcctgccgattgtgcaggccggcgaaccggtgctgcgccagcagaccgtgcaatactccggccagctgagcaagggcacgctgaacaagctcatcgacacgatgcacacgacgatgctggaagcgccgggagtcggcctggccgccacacagatcggcctggggctcgcgctcgcggtggtcgaggaccacgtgcgcgacgacgaggacgatccgcgcgaaatcgccgaattcccgttccacgtcatcatcaaccccagttatgagccgatcggcgacgcgacccgcagcttctacgaaggctgcctgagcttcgacggatatcaggccgtgcgtaggcgctggctcgacatcaccgcacgctgggccgacgagaacggcaagcagcatgaggagcgtctgcacggttggccggcgcgcattttccagcatgagaccgaccatctgagcggcgaactgtacatcgacaaggccgagattcgcagtctgaccacctacgagaaccttgaggatttctggtgcgacgaccccgtgccgaccgacgccgccgaggaactcggcttcgagctgtaagccggggctgggccgactctggtcgcggctggttacggctaactgctgtacaacttccgcattatcgatatttgcgcgtgttgtcccgcgaaatcaggacgccacacgcgcaaaacgctattatttcgcagaataatcgcggaaaaacgttgcagttaagccgtttttgctaaatcgtgccgatgtgggtcatcgctgccggctggacaactgccgcaaaagtcgataatgcgggagttgtccagccggcgaacgcgaagacccctcacgagccgattgcacacgaaccgtatacgtgctttaggctcggcgatccatcgcggcggacgagcgcgtcacaataccgccgcgagatcggcgcgggcgtcggggaacgtacggcagtagcgttctgcctcggcactcagccgctcgttgacgagcagccgctcgtaaatcggattgcgggcgtagcgtccggatccgtcatcgtacgccgtgacgatgctccgcacctgcccggcccaatcccggccgctgatcgcgcgcagctgtgcgatggtgtgcaggtcggaggggtcgtacgcctcgacgatgcgctcgcggtacatcgccctgagctcgtcccaacgtcccagcgcctcgaatgcggcctcgcgcagggattcccactcatacgcaaccagatcctccgggaacatcaccgtgtactggttcggccggtcgcgctccaccatgtcgatgaagccgatgagctcatcccagcgctccgccgcgataaggcgcgccgcgtaggcatccgccatggcttccgattcgtggtggctcaccaagaagcggtcggcgtcggccgcatcaccgctcacgcgcatcagatcatggcgcaggaacatgatcgattcctcgaactgctggtgcgccgacagcgccaccgtacgcttgatgagttccgaagcgtcggccgtcgagccggtcgcggcctcggcggcgatgacgccatcgtcgtgtgccgtttcgccgtcgcatcgcccgtcctcgtcgattttcgcctccttggcgaaacgatccatcgtgtcaagggcgctgttcagcgcatcataggcgaacatgcgcgtatcgtcccattgcgcgaacgacaggccgcacgacagcagctccaccatctgcgtcgcgttcagctggaaatcctcgttgcaggccacccgcgtgatcagtcgcagcgccttctccccgtcctgcgggtcggcgttgcgcgccacggaatccatgtacacgcgcacgttctggatgagctccttgagatagtcgaagccctcgccgtcccggtccgccgcgttgcccacgaatcgcgcggtcatctcgaccgacttcgccagattcgtggtggcgtcgacccagcgcgtgctcatcagcgcgttgccgaccacggcatccactcccgacaacgcctgcgaatcgatgcggaacgtgggcatgtcgttgcgcggcatggacacgccgtcctcggtgcgttcggcggtcggcacggtggatgagatggagtcgaagtaccattgcatcgtcaacccgatcacgtcggcgacctcgttgggagcggcgacgggcacattgttgcggttgtcgtcgtcctgggcggacgcgtcggagatcatatggttccacaggaacgtgggcccgtcgaaatccgttgatgccagccagctgtcattgacgaaatccacgacgtcgtcgagctgttgccgcggatccacgctgatcgaggtggttgagccatccatgattctgcctccctggttccgctccgtggttgcaagcgtacgtgtagtctatcgcgattgacgctccgacgtcggcaatggcggataatggagaccgtgagcgaacaaagcgtaaaccatgacgagcggcggcatgcggcgaaaggcgccggcgatgagatgacggctgcggggaaggccgagggaaaggccgcgaggaagaccggtggatccggcaaatcgggcgcgaaggccaagcccggcgaacggtatgagcggggcacgcgcagctacacgatgtcgcatatccgcgggaaggacacccgcatcgaagtactcgtgcgccggtacctgttctcgcgggggcttcggttccgcaaaaacgacaggcgctatcccggccatcccgacgtggttctgcccaaatggcatacgatcgtgttcatcaacggatgcttctggcatgcgcatcagggatgttccaagtattccattcccaaatccaacgtggaattctggaccgcgaaactgacccgcaaccatgaccgcgacatcgcgcagcacgccgcgctcgaatccgccggatggcatgtcatcgtcgtctgggagtgcgagctcgccaagcccgtgcgcgaggcgcgtctggaacggctctacaccgagatcaccgcgcctggttccattggcgtccaatgagcttgctggcctcgccaatgcggccggttccgtcaatgcaggcggttccatcgtataattccccgattgccggctccacatccggccatagtcccgtgaacgcccggtgaaacgggattttgccgggagggtggtaggcaattacaatcggtggcagtaccgaatggacggcaaagggtgatgcatgatgagcgagacgaaacagccgacgatgtcacgacgcgcacgcgaggcgcagccgttccgggcaatggtgttcggcgagagggccgacgagatgatcgcccgcagcatcagcgtcatcaagctgagtctgggggagccggatttcggagcgccgcccgccgtgcgcgacgcgatgcgagagcaatatgatggccgcgcgctgccgtacaccgctgcgctgggcctgcccgagctgcgacgcgccatcgccgacttctaccatgaacgccatcatgtcgacatcgacccccgccgcatcgtcatcaccgcaggcgggtctgccgcactgttgctggccaccgcgctcactgtcgaccccggcgacgaggtgatcgtcgctgacccgtcctacccgtgcaaccgcgaactgatccgctccttcgaaggcgtggtggtggacgtgccgaccagcgcggccacccgcttccatctcaacgccgaactggtcgaccgcgcgtggagcgagcgcaccaaggcggtgatggtcacgtcgccgtccaaccccaccggcacgaccatcgacttcgacgtgctcaaaggcgtgtgcgacctggcgcgattccgcggcgcgtggcgcatcatcgacgagacatacctcgacctcgccgaccgggagcccgacggcagcgaggtcaggtccgcgctgctcgccgacccggacgcgatcatctgcaacagcttctccaagttcttcggcatgaccggctggcgtctcggctgggcggtggtgcccgaatacacgatcgaggcggtcgacgatctggcgaccaactattatctatgcgcgcacacgcccacccagcatgctgcgcttgcctgcttcacgcccgaatcgttggcggtgtgcgaggaacgcagacaggagctgctcgcccgccgccgcatcgtcgtaagtggtctggagcgcatcggcctgccgctcgaagtggttccgaacggcgcgttctacgcgtatttcagcgtcgcgggaaccggtttggacgcgtggacgttctgcgagcgtgcgctggaagaggcgcatgtggcgctgactccgggacgggatttcggcccggcgaccgcggacacgcatgtgcggctgtcctacgcggcgtcgcgcgaggcgttgacggaggggctgtcccggctcggaaagttcgtcgcctcgctgcgatgattctccgataaccgcggccggccttgggtggaacaccgcgcgcatgctgcggccgcgccggtgatacagtgagatgctatggtgaatttgcgttcgcgcgtcactcgattgggcgtgcttgacatcggctccaacacgattcatatgctgatcgtcgacgctgcgcccggcgcgcgacccgatcccgaggccagcaccaaatccacggtgcggctgatgcagtatgtcaaggatgacgggtcgatcaagaagtccggcatcgaggcgattctgaccgccgtggatcagtgcatggaacttgccgaggaatacgacatcacgcaattgctcgcgatggccacgtcggccatcaaggaggctcccaacagcaacaagatcctgcgcaagattgaagagcgcatcgaccagagcgtgaccgtgctgtcgggaacggacgaggcccgcctgacgttcctcgccgcccgacgcgttccccaaatccaagcatccggcgcatgccgtgggcacgtcaaagacgttccgctcattggcacgtctggcgggtgcggtgctgcgccagtccgggcgcgaggacacgtggatcatgacgcgcgagcagctggaggactggattccccggcttgcggccatcgagccggagcagcgcgtggcgttgccgggcatcacgccggagcgcgcgatgcagatcgtcggcggcggcatcgtggccgacgagatcatgaggtccctgaacgtgcatgaggtcgagatctgcccgtgggcgttacgcgagggcgcgattctgcgctggctcgatcagttcggccgcacgcggctgggtttctgaccgttgcggtttctgcgcgcagcatctatatgccgcgccggtgacggggcatctactgctccaattgtgccagctgcgtgcgaatcttatgcagtttggcgtaaatctcgttgcgctgggcggggttcttggcacgctgatgatcacgcgacagcttctcttcggcggctttcagcgtgacgatctggtcccggcgggcgattcgcgcgtccagattggctccgtccgcggaatcgagaatcgcctgcgcgcacagcgaatcccacaggtcgtccatcgtcttcgcgccgccgtcggcgttcccttccggtagttccagcgtgacctcgccggccggcctccattcgccggagaacactttcgtgatcggcacatgaccggcacggaccggcacgttgcggcgcacggccagcgcacactcctcgcgtaccgtgccttcgaactcgccttcgtgcacgcagacgaacacgatgccggatttacgctgtccggcgatcagatcgatcacctcgacggggatgccgggcgtgttcacgcgcaggccaatcaccagcacctcgggcatcttgccgctgccggcgcccatcgccgtgttcgcgggccgcagcagcgcgagcatcgtgatcgaggcgatgtcgttgaccagtcgctgcttgagtttggacgataccggcgccttcgccacgaacaatcccttcggcagcgtgcccttctgctcgggaatcgccgccgaggccggcagtcccagcgtcagggcggatacctcgccgcagtgtgcgacggtcaggtgtgcagcagtcatcatcggcctccttgtgttcgcctccggcggcaggcccgcctgtgcgcattgctccaatcctaaccccatccgggcgcccgccggggatgaccgtcacaaaacggccgtccgtgtgctccctgcgcgaaataccgttcctccgttacgctatgctgtgcatacatcgacgagtcgggcgacgtcgcggacgggtgccgctgacaggggagaaggacatggctttcacggatgaccagctggagagatattcgcggcatctgattctgaaggagatcggcgtacgcggacagaagaagctgctcgccgcgcgagtgctggtcatcggcgcgggcggtctgggatcgccggccgcgatgtatctggcggccgccggcgtcggcacgatcggcatcgtcgatgatgatgtggtggacctgtcgaacctgcaacgtcagatcattcacggcaccggcaacgtcggcatgccgaaggtcgaatcggcggccgaaaccgtcacctccatcaacccagacgtgacggtgaagccgtatcacatacgcgtatctgccggcaatatcgccgagctgattgccggctacgatgtcatcgtcgacgccgcggacaatttctcgacgaaattcctcatcaacgacgcctgcgttcttgccgggaagccgtatatatatggtggcgcgctgcggttcgagggccagctcatgacgtatgtgcccgggcgaggcccctgctaccgctgcatttttcgcgatatgcccgcggccggcgaggtgcccagctgcaaggaggccggcgtgctcggcgcagtggtcggagtgatcggcagcatgcaagcggtggaggcggtgaagctgatactcggcgtcggcaagccgctgaccgcccggctgatgacgttcgacgcgctggcgatgacgtgccgcgccgtgccgttgccggagcgcgaacccgattgcccggtgtgcggcgagcatccgaccataaccacgctggatccggcgcgatacatccagccggcgtgcggcgtgtgaatgacggcgattccgccgtttaataacgcgccatcaccggcgtctatcaccacgctgcaacgggagacagacatctggcataggctcatgaacggataccgtgcgcctcggcggccaaaggcgcaaggcgcgcgcaggcgctggcatgagccacgaacatatgaggggagcatctgacatgacggacaagcacatcgattcaccgctggcggacgacgacggcgatgccatcaagcgcatcacgccggcacgattcgctgagctcgacaaatccacggtgacgctgctggacctgcgcgagcccgacgaggtgttggtccatggccttgatggcgcgatcaatatcccgtttaaccagatcggcacgaggctgagccaggtgccgaacgacaagccggtcgtcgtgttctgccgggtgggggattggagcgagcaggtcaccgagatccttgccgatcgcggctatgacgccatcaaccttgacggcggattccaggcgtatcgggagtatctcgcctctctgccgcaacagcgggagaacgacgtcgacgatggtgatgcccggcccgaaaaacaggcgaagggaagcgccgcgacgctctccatcccgaccgcggcgcagcagatatccctgcgcggccctgagcatgagagcaagtcgacgggggccgccgactcggccgcctcgcacggcagcaatggagatacggacggcgcgcagcctcacgcggtattcgttgacgccaaagggctcaagtgccccggtccgatcgtgaaggtcgccgacacgctgcgcccgctgccgatcggaacccgactggccgccgaggcgaccgaagacgccttcctgtcagacatcgcggtgtggtgcgaacgcaccggcaaccatctcgtctcgctcgaacgcgacgaaaacggcgtgattcatgtcgtcatcgacaagaccgcgcacatgccggcccccggagctccggccgccgcatgcccgtcgtcgccggccggtcgggcggtatcggccgagactcccgccgccgcaccgcagcagaccggcttcaacccggatggcggcgacgtccgccatgacaagaccttcgtcgtgttcagcggtgacctcgacaagaccatcgccgtgttcatcatggcgaacggcgccgccgcgatgggccgcaaggtcacgatcttcttcacgttctgggggctcaacatcctgcgcaagcccaagcgcgtgcgtgtcaggaagacgctcatcgagcgcatgttcggcatgatgatgccgcgcggcacgcgcaagctcggcctctcgcgcatgaacatgggcggcatcggcgcgaagatgatccgctggatcatgaaatccaagaacgtggaatcactcgaatcgctgatgaagcaggcgaccgatcacggcgtgcgcctggtcgcatgccagatgtcgatggacatcatgggcatccatcaggaggagctcatcgacggagtggagctcggcggcgtctcaacgttcctcggctccggcgagaccagcgacatgagcctgttcgtctgacggggcgcggcgaggccggttgacagtcgccataggtgtgcggcgtagaatacggaaggcgaaggagacccgcatgacacgcaaactcattctcgatttggataccggcatcgacgacacactggcaatcgcgtatgcgctcgcaagcgaacaggccgatgacgtccggctgatcggcatcaccggcacctatggcaacgtcaccgtcgagaccggcatgcgcaacgcgctcgccgtcaccgacctgcttgggcatcccgaagtgtcggtgtatcccggtctcgaccgcccgtcgaccgcaccggaaaacttccgctattcgccgtcggcaggaacgcggcgcatccacggcgacaacggcatcggcgacatgacgatccccgattcgcggcgctcgccggaaacgacggccgcggcggatttcatcatcgacgcggcgcacacgtacggcaaggacttggtcatcgtgcccaccggcgcgatgaccacgatcgccgaagtctgccgtcgtgagccgcgcatcggcgagctcgtcggttccatcacgttcatgggcggtgcgctgaccgtgccgggcaatgtgacacccggcgctgaagcgaacatcatgcaggacccggaggccgccgacgccatcttgcgcagcggcgtggaaaccacgatgatcggccttgacgtcacgcatcaggcggtgctcacgcggcgcgacatcgagcgatggcggcggctgggcaccgcggcgggtgatttcctggcgggcatgacggatttctacatcgacgcgtattcggcgacgcagcccgagctggaggggtgcggcatgcacgatccgcttgccgtggccgcggcgctcgacccgacgctggtcaccacgctgggcatgaacctgcaggtcgacttggagggcgcgtatcgcggcaggaccatcggcgaccgcgctcacgaccggctcaccgactcgcacaagaccacgcaggtggccgtgcgcgtcgacatcgcgcgattcaagagccagttccttaaccggatcacggcgctggcctcccactgatcaccgcgagacgggcggctgctgatcgccgcgcggcgcttgaccattccccgccctcttcccgcgaaagtcccatgtacattggtcgtgatgggactttcgcgggatggcggcggagccgagccaaggcgagccgggtgaaggggggggcggtcagtgcaggatgtcgaccggcgtggcgttcttgttgcgctcgatgatcgcgcagacctgccccggggtctcctgcgacacgtaggcgccgccgcgaagcgtgtacgacacggtgctcggcgatacccccgccgccttcgccacgtctttcagcgttgccatgcgtcaccgtctcatccgtcatcgtgagagatcatccatttccccggtggccggttggaatcatcatccccgctgcgctgccgccctcctcatgccgccttggcccgtcctgtcggcggcggtgctggaggtgacgcgcacggggatgtcatgcatgatgccggtcggtcactgttctgcacgcatgctatcgggcgtcactggaaggcctgtgacgacgatgtcgaaaaatggcgctctcaaaactcgcagagtgacggtaccctcgcacagtgacggtatattcccgaaatgtctcgtatggtatggatgcgcggggattgggatccgggcgatagactcgatagttattcaaggatgaccgaatgattcggtaaaccgtgcccgttgatatcagcgggcacggttccgctcgttctgctcgggtcttccagtcgaatgggtgccccggatgcgattcgaacgcacgacacccgctttaggagagcggtgctctatcccctgagctaccggggcaacgaatgaccattatacatgtcgggcggatatgcgcgtatcgtgcgcagtgtgaagcccgcaggccgccgcgcatacgtgccggaatggggaatgattctcgggaacgatggcgtccgcggttccggggcgttatcgtatgagcttgtatgcgcgacggctggaagaatacatgtcgttgcgtaccggttgacggacgacaggggagtggcgaatggcaaacgcgcgaggatcatcacggaacgtctacggctcggcggctcggcggtccggcgcgtcgtccggcactgcgaaaaggcccgccgcgaaaacaagcgccccacgcggccgacgccaccgtctccttggcgtcttgtcggtcatattcgccgctctcgcattggcgtgcagcgtcctgcgcatgctccccgagaacctgcaggcgctgccgtacatccccgtgatcgtatccgcgacgccgtggttcgtgattctcgccgtgctcgcgctgatactgtcgatcatctcgcgccgctggatcgccatgctgatggcgctcgcctgcatcggcctccaggtgtggtggcagtggccgttcttcagcgcgtccacgaagctgccggcggccgtcgacgcggccatggcatcgacccgggcggacaccggcgacatgatcgcccgcgtgatgaccttcaacgtctacaaaggccatgcggacgcgaaggccatcgtcgacatcgtgcgggatcagcgcgtcgaagtgctcgcgttgcaggagacgacgaacgatttcgtcaagaagctcgacgaggcgggcatccacagctatctgccgtattcgcaggtttcgtcgtcggacggtgtctacggcaacggcatctggtccgcgaccgagctcgggcgtccggtcgatgacgaggtcgggtcgagcgcgtcgttcatgccgggcggcaccgtgacgttcggcggcggcaagttcttgttctcgcgggcgtagtgagccatgaagtagatgccgccgttggccatgtgcttgttgtagatgttgccgtccacgtcgtggatgttcaggccctcaagcgtgacatggctcatcgttgtgccgttctccgcgatgccggccacgccggtgcggtccatgcggtcggccgagcggtcgagcttggtgccatccgaatcggccgtgtcggtccacttccacgtgtcgatcgggtcgtagacgtcggggtcgtcattggtgatctccaggttcttcaccgtgatgtacgacacgtccttgagcaggatggccgaggagacggtgcccttgttctggtggttgccgaccgacgcacggtagttctggtaccaccggctgcccttgacgccgttcgccgcgatgaccggcttggcggaggcgtcgccgtaatcggcgatggtgatgggcgcgtcggcggttcccgacgtgtccttgatgtgcagatactggtcctggaacgtggagccacgctccagcagcacggagtcgcccggcttaaggtcggtcgcgatggcgttgaccttgtccagcgtcttccagggatggttctgatcggtgccggcgttgccgtcatcgccatgcgtcgatgacacgtaatatgtcgttccggtcgacgccgccgctggcgtcgcatcgcccgcgagcgccgaagacggcgcgatcaacgcgaacgccgtccccaaagcgaccgatgctgcgatcatccgtgatcctacatgaggtttcatcgttgtccttactgttattggagagtctccgttcccctcctcgttgcggggggacatgtcggcgatccggtcatccatgacgatgcccccttccggggtcattcacggactcgccacaccaccaatatgtaaagagactttacaagttcacaagtatagcggtacccataggctacggcaatgggggtatggcgtattcggcatttcgttaactgtcataacgtcacccttgtaccccctgaacggaacccgggaaatcagtcgcaatgtccagcattcggacgcaaaccagctatcgattctttgtataacggcaccgccgtggccgatggaatctacaggtacgatatgccccatgacgacaccgagaatcagttacgcgcatctgctcgccaagccgaatcccaagcacatcgacagtctgctgcgattcttcgaggaaggccgttccaaacgcggcacgggcggtttcggcgtggagatcgaacatcttccggtgcacaacggcgacgacaccgccgtcagctactacgaggagaacggcgtcgaaacgctgctcaagcgcatcgcgccgtactatgacaaggagaaggagtactgggagaacggccatctggtcggactcgggcgcgaaggcatcgccgtgtcgctggagcccggcggtcaggtggagtgctcgctgggcatcctcaagacgccgcaggaactgctgacgctgtatcgttccttccggcgtgacatcgatcccgtgctggacgagctgggcttccgtctggtcaattacggctaccagcccaagtcgggcttcgccgacgtcaaggtcaacccgaaggaccgttacgacgccatgacccactacctggggcgggtaggccagttcggcccgtgcatgatgcggtgctcagcctccacgcaggtgagcatcgactacgtcgacgagcaggattccatcgacaagctgcgtctgggcaccatcatcgggccgatcctcgcctggtacttccgcaatacgccgtatttcgagggcgcgccgaacccgtggcccctgctacgccagcgcatgtgggactatctcgacccccagcgcacgaacgtgattcccggactgttcgacaagcggttcggctgggaggagtacgccatcgacgtgctgtccacgccgctgatgttcgccgatctgacgcatacgccggaggccaagggcctgagcggcaaggagctgcatcacccggcgttctatgagaacgccggagaggtgtatcccgaccgcgagctcaacccgtacgagatcaaccacatcatctccacgcatttcaacgacgtgcgtatgaagaacttcatcgagctgcggcattgggattcgctgccgatcgagcgcgccgagcggctgacggagatcatcgcgtccctgttctacatgccggggaacagggagcggctggaaagctacttcgaggatatccgcgaagaggacgtgttcgaggcgaaggcgaacctgcaggcgcgcggcgcgcaatcggcgccgtatggccagccgctcgaattctggaaggagttcctgggattggagggcctgttggccgacgagcccggcgatccgaagcatccgaacgtattccaggaataaccggaatccaaggcgacgaccgacggacatgattgtgggggcgttcctgcgcaatgcgggcgacaccccgcaatcatgtccgtcgcgtatcatgacggcatgaagcagtcacgaaaacgcggatcaggctctcccagcaaggcaacggacgggagcggccgtgacgccgcgaagatggggacgaaaaccaatacgagaacccgcgcgatcatcgtcgtcgcggccgtcctgctgattgcggccatcgtcggcaccgtctttctcgtccgttcactcacggcgagccccgactcgtcaaagacggacgacgcgcaagccaacgcgacgcaggccttcccgaaattctccttcggcgacaccaccatcacgcaggccgaattcacccaggcgtggtcgtcgcagcgcaccgccgccgtcagctatttcaagcagaagcacgacgtcaacctcaacgcccgggacgccgactggaccgcctcatacggcggcgagaagccggtcgaatggctgacgaaacagactatcgacacgctgcgcttccgtcacgcggcgtacctgatcgcagtctcgtacgggctggtcgacgacgactcgtacaccggcatcgtcaagcgcatggaaaccctcaacgcgaacaaccggcagaaacgtgaagcggggcaggtcatctacggacgcagcgaatacgacatcgcctcatacatcgactacgagatgaccgcgctgaagaacgactacgtcgacgacgccacgaaaccgggcatgaacccgagcgagaccgaggtgcaggagttttacgacgcgcacgactggaccgtggacggggtcgagggcaaggcgccgctcgccgatgtgaaagccaatgtgaagacggcgctgtgcacggaacgctaccgcgagagggttcagagcaaggccgacaagatagacgtgtcgaccctgccatggaagaggctgtacgcctacgcggcgaccctggtcggctgatcgccgggccgaggctgatccgtcagtcggccgcggtcagcttctggtggttcttcttcgccgcggcgatcatcagcttgatgcggttgagctgattggcctgtgaggcgccgggatcatagtcgatggaaacgatgttcgcgtccgggtgcagacggcgaatcttgccgaacatgccgcggccggtcacatggttgggcaggcaggcgaacggctgagcgcagatcacattcgggcagccagactcgatgagctccaagatctcggcggtcagcagccacccctcgccggcctgcacgcccaccgaggtcacctcggaggccttcttgaccagctcaggcatcggcaggtcctggctgaacttgccatgcgccagatcgatggccgcgcgcaccgggttgaggtaacggtcgagaccccagcgcatgagcgagtacagcttcttgttgccgcccatgccgaggttcttctcgttccagtcggtgatgtacggacgcgtggtcatgaactccatgatgccggggaccacggcctcgcaatcctgcgattcgatgacgtcgaccacgtggttgttcgcgtcgggatggtacttgacgaggatctcgccgacgacgccgacgcgcaccttgcgcgggatgtcgcgcagcggcagtgcgtcgaacgatttgacgatctccttgagcagcgtctggtacggcaggtaatgcttgccgatcttcttcttagcggtatcggagaagccgtggtgttcgatggtctcgcgcacgatggtgtcccacatctggtacagcttgtcggcgctgcccttctcgacctcgtacgggcgcacgcgcatcaggcatttgagcagcaggtcgccgacgaccagcgccttgatggcgcggtgcagcagcgtgggcgtggccttgaagcccgggttgtcctcgaagccctgcgtggacagcgcgatgaccggcacctgcgggtagccggcgtcgatcagcgccttgcggatcaggccgaagtagttcgtcgcgcggcacatgccgccggtctgcgtgatggcgagcgccacatggtcgggatcgtacttgcccttgacgatggcgtcgacgagctggccgatgaccatgatcgccgggtagcaggcgtcgttgttgacgtacttgaggccgagttcgacgtcctcgcggctcgcggtcttgaggatgtcgaacttgtatccgccggagcggatgaccgactcgaccagcgacatgtggatcgggctcatctgggggccgacgatcgtgtagtccttcttcatcgacttgccgaacggcaccttgttggcgtacttcgacatggtcgcggtgttgtggccggatttcttggcggtcttcctcgcggacttgccgttcggcgaggtggcggcgagccgcgactcggcctgcgccgcgcggtgggaggcgtccttgacggccttggtgagctgcgggttgctcttcatcaccgtgtcgagcatgacctgacggccgggcgtgggcgcctcggatccggtcttgcggaagcccgtggaatgcggggccggctgctcggcggcgttcttctgcttctccgcggcctcgacggcggcctgcgcggcggcgagctggtcctgggcggccttgagctgcacctcggcggccgcgagctcctccttggcctgacgctgcgccgcaagctcggccgcactggggccgaccggttggtcctgcttgttcggcagcacctgctggcgggattgggactgggcctgtgcggccagacgccgcttgttggcctcgcgctcctcgacggcggccttgagcgaacgcaggcggatcttcgccgctccgaggttgctcacctcatcgatcttgagcagcgtgtacacgtcggccttgtcggcgaggatctcggccacctgatcggtggtgatggcgtccaggccgcagccgaaggagttgagctgcacgagttcgagaccagggtaggatgccacgaaatgcgccgccgcgtagagccgagaatggtaggcccactggttggtgacgcgcagcggcatgcgggagacggtcaccttgcggtcgccgacgtggcggaagccgttcgcgttcttcttgcgcgggtcctcctcgccttccgacaggtagtcgctcagatgcaggttctcccccggctgcagttcgcagatcgaatcctccgagagcacgaccatgccgagcgcgcagatcgtctcggggatgccgtggttgacctcggggtcgatgtggtacgggcgtccggcgagcacgatgccccggcagttgtgctccttcatgtaggcgagcgccttgaaaccttcctcctgcacgtcgttcttgaagatcttgtcctcggcgtacgcggccttgaccgcggtctcggcctcctcgcggctcacgttcgcccaggcgaactcctcgacgatgcggtcgaccatgagctcgtggttggcgaggttgaagtacgggtgcatgtagcggatgccgtcctcgcgcagttcgggcatgttcgcgccgatcaccaccgggtagttggccacgaccgggcagttgtagtggttgtccgtattgggcacgaggttgtcctcgtagctcacgcacgggtagaagatgttcttgacgcccttgcccagcagccacttgatgtggccgtgcaccagcttggccgggtagcagatgttctcggaggcgatcgattcgatgccggtctcgaacagctcgtgcgagctgcggccggagatcatcaccttgaagccgagcgaggtgagcagcgtgaaccagaacgggtagttctcgtacatgttgagcacgcgcgggatgccgatctcgccgcgggtggccttcttgtcggtgagcctgcggtaggcgaagcagcgcttgtacttgtagtcatacaggttcggcctgtcggagcgcttcttcttcgcgtcgccgccgcgctcgcagcggttgccggtaacgtagcgcgagccgtcggcgaacgtggtgatggtgagcttgcagtggttctggcacagcttgcacacgtcgcgctcggaggtcatcgacatgttgtcgaggtcgtcgccggacaggatgttggacgccgtgtggtgcacgccgtcgatgacgacctcgtggtcgtgctccgcgctgacatcgtcgctgccggccatatcggcggactggcccgcggagacttcggcgtcgtggtcgtgcgcgtcgtcggccacgtcctcgtaatgcatgcgcgcggtcagggcggcgccgaacgcgcccatcaagccggcgatgttcgggcgggtcacctcgcgctcggtgagcagctcgaaggcgcgcagcacggcgtcattgaggaacgtgccgccctgcacgacgacggtgtcgccgagctcaccggagtcacgcagcttgatgaccttgtacagcgcgttgcgcacgaccgaatagcacaggccggcggcgatgttctccatcgacgcgccttccttctgtgcctgcttgacggacgagttcatgaacaccgtgcagcgcgagccgaggtcgaccggatggtcggagttgagggccgcctgggtgaactcctggatggtcagacccatcgactgcgcgaaggtctgcaggaacgagccgcaaccggacgagcatgcctcgttgacggcgatcgagtcgatgacgccgtcggtgatggccaggtatttcatgtcctggccaccgatgtcgatgacagcggtgacgccggggctgaccatttcggcgccacggtagtgcgccatggtctcgaccacgccctcgtccaggtgcaagccggtggtgatcagtccctcgccgtagccggtcgcgcaggatcgggcgatccacgcgccttcgggcagctcggactggatcttcttgacgatgttgatggcggcggtcaacgggctgccttcgttggtggcgtagctggaccatacgatctcgcggtcgtcgttgacgagcgtcgccttgatggtggtcgaacccgcgtcgataccgaggaagtgcgggcctttcgcgccttcgagcgtgccgatgtggatgtgttcgcgatggtggcgctcgttgaacgcctcgcgctcctggtcggaggagaacagcgggggcatggtcggcgtgttcgccggcaggttcttcaggtcgtcgagggcggcgatgatgtcgtcacaggtgcgcggctcgaaatgcacgccgtcgacgtcgatgccatccggctccccagcgatcagcgcggagccgtatgcgacgtacaggtgggcgtcggtcggcacgatgaactcgtcgaccttgccggcgagcgcgcggtggaacgcctcgcgcagctcggacatgaagaacagcgggccgccgaggaagatgaccgtgccgtggatcgggcgtccggaagccagaccggcgatggtctgcgtggccaccgcggtgaagatcgacgcggccagatcgggcttggcggcgccgtcgttgattagcggctgcaggtcggtcttcgcgaacacgccgcaacgcgacgcgatcgggtacagggtcttgtagtccttggcataatcgttgaggccggaggcgtcggtgtcgagcagcgtggccatctggtcgatgaatgcgccggtgccgcccgcgcacgaaccgttcatgcgctgttcgggagtgggcttcagatacgtgatcttggcgtcctcgccgccgagctcgatgatgacgtcggcctgcgggtattcctcgtcgatcgcgcgggtctcggcgatgacctcttggatgaacggcacgtgcaggttgtcggcgagcgtcaggccgccggaaccggtgatggcgagacgaatgggctcgtcgccgcggccgaggtcgacgagcgtctgatggatgtccttgagcagtccagccaccgtggcgcggacgttggcgtggtgacgtcggtagtcggagaacagcacgtcattgagcgcattggtctgatcgagcaccacggccttgaccgtggtcgatccgatatccagacccacgcgcaacggcttactatcgtggctttcggccgcggtattcgctgtatccaccatctgttacctctgtcttcggttcaggacttcccgctacttccttatgtaatgtagtccgagacccctcctaacgagccgtcgtatggcgtgatttcgctaacaaacgcaaaacggaaactcgacgggttccccacgattgcggcgttacccccattatcgcgcattcggggggtgagccgagcatgccagcaggctggtggtcttatggactagtgctattgcccccagtcccgctcaaatccctgatatggcggccatgatggtgacgacggcgggccataccccggccgcagtatccgagccctccagcggaccgggcacgccgctgcccgcgaaaacgtcgaccacgccgtcccgcacgccgcgcatatacagagtcgtccgccccaatccggtgcccagtatgcgcgatcacccttcccggaaacagagcatcatcacatggaacagcggactcacgcgaggccagatgaatgcggggagaagcaaggccatgccgatggcgggcgagaccgtcaggatggccgcgatcaggccgacggcatcgaatccactggatggatggcaaggccggcggcgccgtcacgacgcctgcgcgccctcgccggcctcgcgatccttgaggtacatttcggggatgtcgcgctcctggtcgtggagcttgtcccagacgacaggcctgccggcggccagcgaacgcggtacgtcgaggatgcgctggtttctggatccgcggaactgcaggagggagtcgtgctggtccttgaggtagcggccgtcgacgaggatgtcgatgagctgcaacagttcgagcttgtccggcgtctcaccgggacgcatcagctcctcccacgtgtagccggtccagcaccagatgtctttgtcgtggccgaactcgccgcggatgcgccgggcgagcggcaacaggacgggcgtattcagcatgggttcgccgccgaggaacgtgatgccctggatccacggcgccttgaggtcgtcgacgatcttgtcttcgagcttctgcgtgtattcgtggccggcctggaaatcccagatcgacgagttgaagcattcgacgcagtggaacgggcagccggagacgtacagcgaattgcgtacgccttcgccgtcggtgacgatgaaggtcttgtagtcggcgatcatgcgcttggacatgcgccgcccgtcccactggccggaacgggggttgttggtcagtgatgacggcactccgggtccgcggccggtctcgccggctgcgaaatcatgcagcgtcgacttcctgtccatcatcatcctccctgtccaaccgtaacgttgcgcgcaacgggcgagggtcgccggtatatgttgtctgaccgtaagcttggccgaacggccttgagcgtgtcagacaacatataccggcgaccctcgcggacagcacaacgcgcggtaccggcagttacttggcctcttcgaaccactcgcgctcggagccgtccgccagcgtcacgtgaccggtctcgccgctcatgtgcttgacgcggtgggagatctcctcgtgacggccatgcaccatcgggcgctgcaccgggttgccgaggtagccgcaggtgcgcttggtgacgttgcacttgtcagggtcgcagttgccgcattcagggcacttgaagccctcgtcggtcggctcgaagtcgccctggaagccgcacacgaagcagtggtcgatcggcgtgttggtgccgaggtagccgatgccgatgttgtaggcgtaatcccacacggcctccagcgccttcgggttgtcctgcaggcacgggtactcgcagtagttgatgaagccgccggacgcgaagtacgggaagtccttctcgtagttgagcttctccatcggggtgggctgcagccacaccgggtagtggaaggagttggtgtagaagtcgtggtcggtgacgccctcgatgcggccgaacttctcgcggtccatgcggttgaagcggtcggtgagggattcggccggtgtggagtacacggagtaatggtagccttcggccttgctccactgcttgcacagttcgctcatgcgcttgacgatcgacagcgcgaactccttgccctgcgggtcccagccgtggtcgcggatccagtccttgccgtagaagacggcggtggcctcggccaggccgatgtagccgagcgacacggtggcgcgctcgttcttgaacagcgtgtcgacgttgccgctcgcgccgaggcgaccgaaggcgccgaagcggaacagggtgggcgcgttgaccggggtggcctgcttgcagcgcatgatgcggaactgcagcgcctggtgggcgacctccatgcgctcgttgaacagcttccagaagcgctccttgctgccgtgggattcgatggcgatgcgcggcacgttcacggaaacgacgccgaggttcatgcggccatcctcctcgtccttgccggtctcggggttgatccagccctgcaggaaggagcggcagcccatcggcgccttgaaggagccggtgatcttgacgatgttctcgtagaacacgacgtccgggtacatgcgcttggtggcgcattccagggcgagctgcttcaggtcgtagttcgggtcgccggggtcggcgttcacgccgtggcgcacggtgaacacgagcttcgggaagattgcggtgtggtggtccttgccgaggccgcggatgcggttgagcaggatcgcgcgctgcacctcgcgggcgaaccagtcggtgcccaggccgaagccgacggtgacgaacggggtctggccgttggagacgcggttggagttgatctggtactccatcgtttgcatggcgtcgtagatggacttgcgcgtgcggaccttggcgaggatctcacgctcctgctccagctcgtcgacgtcggtgtggaacggcgtgtccatgggcagcggctcgcgggagccgaagtgcagcttggcgggctcgttggccttggcgttctcgacctgacgacgggcgaactccaccggcatgccgtcggggatggtctcgcgggcctcttcgaggaacttctcgtagtccttcttcgcgtaggcggcgaggtgctcgtcggcgcggttggcggtctggccgccgtactggctggaggccacgtccttcatgatctgggtgatctgcgtggcggcgatggcgatggacttcggggaggccatcggcgcgttgccgagcgtgaagccgttggcgagcatgtcccagaagttgggcagcgagcagttggactgcgcggtgaacggcgagtagtcggcgtcgtggaagtggatgtcgcccttcatgtgcgcgttcgcgacggccgggggcaacatgttgaacgcggcggccttggagacggcgccggcgagcaggtcgcgctgagtggcgtagacgttggcatccttgttcgcgttctcgtggatcagcgtcggatcctggttgatgaagcgggagacggcctcgttgacgtccgtggccttggcgcgctggatgtccttgtcgagacggtagttggtgtaggcgcgggccacgtcgtacaggtgggcgtcgatcagggcgtgctcgacgaggttctggatgtcctcgatcttggcgggaccgttgtagcgctccgtgatctcgccttcgatctggtcggcgaagccgcggatcagcttctcctcctccgggccgacctgcttgtcaaggtcggcgaaggcggacttcacggcgctgatgatgtttatcgggtcgaagtcgacgacgcgaccgtcacgcttctccaccagcaccttggaggaggtggcggtactggcgttcatcagcagagcatccatgtcccaatccctgtcctttcgtgattcccggcatgtcttgcggcggtcgccgatccgaaatcacacgtgtgtaagttgtttgttctctgatgactatacgacatgccacccctagatatagtggggaaatgccgaaaacaatcctagatatgcacatttcggcggaatagagccgaaaagaacatccgtgtgatttacttcacggtatgtcgtcagcgtgtcgcggcgagaccatcaccgaaaagccggccaacaatgataccgtccgacggcgacgctctcgcaggcagaaaaacttgtcctttctgtacgtaaaccttgaaggcatgaatcaggaacaggaccttgcaatcgcgacgcagcggccgtcggagggcggcggggagcgcatccccaagcccttcgaccaactgccgcgcctggcagccgagaccaccgcggacaacccctggccggtcagcgtactgagccagaaattccataccgcggtggagcgctggcccgccgcgtggatcgccgggcagatcacggagatcaacacgcgccgcgccggctcggcgtatcttacggtgcgcgatgacgtggaggacatcgccatatccgtgtccggctggcgggcgttcgcctcgaaggccgcctcattcaagcagggcgaccgcgtggtcgtgcatggcaaggccgacatctgggtcaagcagacgcggttgagcttcatcggcgacgacatccgcaagatcggctccggcggcggactgaaggagcagatcgaccagttgcgcatgaagctcaagggcgagggcctgttcgacgcggaccgcaagctgccgctgccggaattcccctcctgcatcggactgatatgcgccccgcacgcacgggccgaaggcgatgtcatcaccaacgtgcggctgcgctggccgacggtgcggttcaacatcgtccatgccttcgtacaagggccgcagtgcccgcaatccatcgtcgaggcgattcaccggctagacgccgacccggacgtcgacgtgatcatcgtggcgcgaggcggcggctcgttcgaggacctcatcggattctcggacgaggcggtggtgcgcgccacggcgggatgcgagacgccgatcgtctccgccatcgggcatgaggacgactggacgctgatcgacctggcggcggacctgcgggcctcgacgccgaccgacgcggcgaagaaggtcgtgcccgacgtgcacgagcagtggcagctgatcggcaatgccatcgaccgcatgcgcatgcgcatcgacgcgcgcgtcggcaacgagatacggctggtcgaagggtacgcgaaccggcccagcctgacgcagccgctgaccatgctggagccgtaccaacggttcgtcgacgacgcgcgccgccgcatggacatcggcctgacgcgcatcgtggacgacgccagcctgaccgtggagaagctgcatgccagcctgaccgcgctcagcccgcaatccacgctcgaccgcggatacgccgtcgtccagaacgccgacgggcacgtcatcgacgacgccggaaaggtgagcgcgggagaccatctcacgctgacgctgcgcaagggggtcatcaccgccaccgcccagtagcggagtgccgcacggcagcagagtgcggggcagatatcagccgcataaccatatatatatgaccgttatccaatcgaatacgacacgcatacacgacagaaggagaccatcatgaccagcaagaacgcatcggcggcgagcgagccggcgaccagcctgaccgacaaggagcgcgaggccatcgcgcagatgccgtacgaggaggcccgcgacaagctcatccaggccgtgcaggcgctggaggccggcggattgaacctcgaccagtccatgcgccagtgggagatcggcgaagcgcttgccaagcgtgcgcagagcctgctgaacgaggtcaaggccaagctcgacgccgcccaggccgagcaggccaacagcgccgacaccgccggcacccagtccaacctggactgacggggcaccctacgcgggacgttgcgtccataagcgcgcgccacggcgaagtccgcgcgaacttatggacggaaaacacgaggtttgcgcccatatgtgcgcgcagccgccgtttggacgagcacttatggacgcaacgatggcgtgccgagaccatctatgtccccatatgcgtggcgacgcaccgccgtagtgccacgcaccgtagtcgcactacgcggcatccgtcatcggccgacgcctaccacaacatgacaacgtcgccgtaaggtaccgccccaatcagccggccgtcaccgccgtcactgcacgacgatggtggcgagcagcgcggcatgatccgagccggcgaccgacttgacctgcatctgaccggcgatgatgtccttgtccagcacgatatggtcgatgccggcgaaccgcggcagcggcagcttgttggacggccaggtgaacgtgaacccgtgccccgactgccgcgcggcgtccgagaaccggttccccaggatgttgcggaacggcgtgtggtcggtcgtggcgttgaaatcgcccatgaacacgtagcgcgaaccttcgcgcgagcgcatggatgccagctcgtccaacgagcgcttccaccggctccagtagccgggaatcggcgcggtggtatgcacggagacgaatcgcagctgggccttgccgccgccgaacgtcacggtgccgcccggcatgaacgacgcgctcgacccgacctcgtcatcgaccggacgccgctcaacggcgaggacgtgccgatggcaagcggcaccactgcgaacctgattcacggcatccccgagcagatcgccgcgatttcctcgttctcgaccctgctgcccggtgacgtcatcatgaccggcaccccgaacgcctccggtcacctcgatcccggcgacgagcccatcgtccacgtagccggcatcggttccctccgcaacgtggtcgtgcgcggctaggcgacagcacagtgtgctgtcgcggcgcacgagccaagcgacagcgaggccagattgggtcggccgcaggccgtccgaaattgcgggaccgtgcgcggcattgcccgtcgcctcgaccgggacgttgatgattggctcggggaatccataccgtttgagcagcaggcgcaagtgggtctcggccggggagtcggtgttctcgcgaatctgggtgagtgccctgatgcattgtttttgcccttggaacgagtcgcatgagtggatgaattctctgagttcggccagagtggtccgtctgcgtgcggggtcgcggcataccagcgagtcgccgaattctatgaggtcttcgagggacagctctttggccatttgggcgaacagcgcctcgggggaggtgcataggagcccatgcacctcgatggttgcgcccgaggcgtccgtattgggccatacgcggggaatgatgtctttcgcgcgcgtccgccgcgtggttttgaacgtgacagtcgcggcggggcggttcttcgttgatctcaaacatgaccgctctcaaaactcgcagatacgagaactgttttggcggaaaatggcggtttcgggtttcgtgtctgcgagttttgagagcgtgtcgcacggatttgagttatccacattgcgttttggcgcttcaaaatcagtgcaaaacttgagtcgcgtgcgctcaactttcgggaatagaatgggtgccgaatcggttgtgcgtatcagacacagacggaaagcgctgtgcggggcggttcggatgtcgtgggccgcggccgccaaggcgcatgagacatacggaggttgatatggaacagaagttcaccaccatggcccaggaagtcatcggtgatgcgattcagagcgcgtctgccgcgggcaacgcgcaggtcgagacactgcacgtgatggatgcgctgctgcgtcaggaaaacggcgtgattcagggactgattcaggcggcgggcggcaacccgcaggcgattggcgccgcggtgcgcaatgctctggtcaagatgccggcggcgagcgggtccaccacatcgcagccgcaggcgagccgccagctgacggcggcgctggcacaggccgagaaggagatgcagcagatgggcgacgagtacgtctccaccgagcacttgctcatcggcatcgccgcatccgcgccgaaccagagcgcggacatcctcaaggcgaacggcgtgacggccgcggcgctgcgcaaggccgtccccggcgtgcgcggcggcgccaaggtcaccagcccggacgctgagggcagctacaaggcgttggagaagtactccaccgatctgaccgcccgcgccaaggagggtaagctcgacccggtgatcgggcgtgatcaggagatccgccgtgtgatccagatcctgagccgccgcaccaagaacaacccggtgctgatcggcgagcccggcgtcggcaagaccgccgtcgtggagggcctcgcccaacgtatcgtggccggcgatgtgccgaccacgctgcagaacaagaagctcatcagcctcgatttggggtcgatggttgccggctcgaagtaccgtggcgagttcgaggagcgcctcaagagcgtgctcaacgaaatcaagaacgccgacggccagatcatcacgttcatcgacgagattcatacgatcgtcggcgctggcgcggccgaaggctcgatggatgccggcaacatgctcaagcccatgctggcgcgcggcgagcttcgcctgatcggcgcgaccacgctggacgagtaccgcgagaacatcgagaaggacccggcgcttgagcgtcgtttccagcaggtgttcgtgggcgagccgagcgtagaggacacgatcgcgattctgcgtggcctgaagcagcgttacgaggcgcaccacaaggtgacgatcggcgatgacgcgctggtcgccgccgcgacgctctcgaaccgctatatttccggccgtcagctgcccgacaaggccatcgatctggtcgatgaggcggccgcgcacctgcgcatggagctcgactcctccccggaggagatcgacgaactgcagcgcaaggtcacgcgctacgagatggaggagatgcagcttaagaaggccgaggatccggccagcaaggagcgcttggagaagctgcagaacgagctcgcgaacactcgcgagaagctgagcggcctcaaggcccgctgggatgcggagaaggccggccacaacaaggtcggcgacctgcgcgcccagctggacgccaagcgcgtcgaggctgacaagttcacccgcgagggcaacctggccgaggcgtcgaagatcctgtacggcgagattccggcgattcagaagcagctggacgcggctgagaaggccgatgcggaagacggcgcgacgggcgagaccaagcccgagccgatggtgcccgaccatgtggacgccgattcggtggccggcatcgtctccgagtggaccggcatccctgtcggtcgcctgatgcagggcgagaacgagaagctgctgagcatggaggactacctcggcaagcgcgtgatcggccagaaggaagcgatcgcggcggtgagcgacgcggtgcgtcgttcacgcgccggcatcagcgacccgaaccgtccgactggctcgttcctgttcctcggccccaccggcgtgggcaagaccgagctcgccaaggcgctcgccgacttcctgttcgacgacgagaaggccatggtccgcatcgatatgtcggagtacatggagaaggcgtctgtgagccgtctgatcggcgccgcgcccggctacatcggctatgaggaaggcggccagctgaccgaggccgtgcgtcgtcgtccgtactcggtggtgctgttcgacgaagtcgagaaggctaaccccgaagtcttcgacgtgctgctgcaggtgctggacgacgggcgtctgaccgacggccaaggccggactgtggacttcaagaacacgatcctgatcatgacctcgaacctcggctcgcagttcctggtgaaccaggacatggatgcggacgccaagaagaaggccgtgatggacgcggtgcacatgaacttcaagccggagttcctgaaccgtctggacgagatcgtgatgttccatccgctgacccgtgaggagctgggcggcatcgtcaacatccaggtcgctcaggtggcctcgcgtctgacggatcgccgcatcaagctcgacgtcaccgacgcggctcgcgaatggctcgccaacaccggctatgacccggcgtacggcgctcgtccgctgcgtcgtctggtgcagaccgaggtcggcgaccagctggcgcgcatgctgctcgccggcaaggtacacgacggcgacaccgtgctcgtcgaccagaccggtggcgagcatctggaactcggtaccatgcccgaggatccggatgccggttccgatgccgacgtcacggtcgaagacgtcaccgaagacaagtgatggccggatgatggccgcataatggccgagtcgcgatgaagggaggccgggctcaatacccggtctcccctcaatgcgtcataagtgcgtcacgctgtgcgggtcacgtcacgcggcgagcgctcgcacagcgtgacggttcgtgagaagccttatttttcaacgtttttggagtatgcgtcactctgtgcgctcgctctgcgtgacgtgacccgcacagcgtgacgctgcatggtgcgtgtgtaggcgctgtggtgcccggattcgcgcgtaagtccgaacgcgccgcgacccctattcgccgaccgcggcgcgctgctccacgaactcgcatccagctatcgcgcgggccatggcgtcgcgcatggtggacaggaacacgccgtcgcgcgtgaacgccagcgcctgcacttcgatgccgtacggcgaaaaaccggtgagcttgacgagtggttcactgccgggttgcgcgaattcgacggtggccgtggccaccgcgcgcttcaccgcctctgtcacgtgcgccgggtcgctgccggccttcgcggtgaacgtcatcgtcacgcatccttcattggacggcgtgagcttctccagcgacgcggtgttgagcacggaattgggtatgaccatctcgttgccgttgcgctcgcgcaccactgtctgccgccacgtgatgtccttgaccacgccggccgtccccgcgaccgacaccagatcgcccggctgtatcaccttgccgagcatcagcccgaagcccgagatcacgttcgccacggtgtctttcagacccagcgacacggcgatgccgccgacgccgagcgcggtcatcagtgttgtcgggctgatgccgaacaccggctgcagcacgatggacgcggccagtatccacaccagcacgcgcatgatgttgatgaatatcgacgcgctcggcatgtccgtccgatccagcaccttgcgcatcactcgtgccagtcccttggtgatcaacagcgcggcgacgatcgccaccagcaggaagatgattttcccggcgttcgcctcgaaccattgcagtatctgatccatgtcgcctccagggtcgcgttcgcgtcgcgcaccccgcggcggcgactgctctgcaagccactttagtgggcggttttgaaatctcctggaatgtcgcctttgaaaatgcggctccagtaggccagcatgttctccttcgacatcgacaggtacactcccatggcgagcacggcgacatcctcattgagcaggtcgtcgaccgagagtttcttgctcagctccggccaccgccgcagtaccgcgaggataccgccgacggtgaagtcgagcatcaggtcggttttcagatccaggttgtcggcgtcgagctggaggtcgttgatgatcatcagacggccgaagtccttcagcgactcgatgagctcgggcgagctatggctgccggcgagcagtgccagacggtcgagccgctgccgctgaactgggtcgttcatcaccagggagcattggcgcctccattcgatgtcgggattgaggtcggcgcgtggcgcctgcacggtcgagtgctccacggcgtgcatgatcgccgaatcggccagctccggcaggctggcgtaatggtagtagaacgagttgcggttgacatgcgcctcgcgtacgacttcggtgacggtgatcttgcggtattcgtggtctgcgagcagctcccagaacgcgttttcgaggcgttcggtcgcggagagtatctcggaatccttgcgtgggcgcggcatgatggttcccttcctgcgtgacgtgcggctatcgtttattgggcactatgtctatatgtgtgatatggattattgtagggcggattgtgaggcggatgatcggaaaataggcgaactgtccatttttctcggttggcgaaacagagttcgggcacgagacggctaccgcgaggaacgggaccggaccgcggccatgagcagccccatcgcctcgatcagatgacggcgatccgcctccgacagacccacgaacgtgttgatcatcgtgggaacggccttcaggccggccgccatgagatcggaaatgctgtcggcatggctcgaccgcagcacggagaacagggcgtccaccgcgcgctcgcggtcctcggtgctcaacgattccagccagccgttcaacgaccggttgaacagctgggaactcggcgatacctgcggcagatattcgaaatcattgcccgagacctgccaggagaacgtcagatgctgcatcacgcccttctggtcggagcgtacaacccgcatcggctcgggcgtctccagaatcatgccgacaatcgaggagtccggtacgatcttcacgatgaggggcatgacgctccgatacggatcgctgccgacgatctgcgacgggaaccccggcccgtccagcgaatacaccgccgtgacacgccgctgcaccggctcgggcgcgttcatcgccgcatacacggccagattgccgcccttggaatgccccagcagcaccatcgggccgcgccacaggcgcgccacggcgcacacatactcacatgccgcatgctgtgcgggcaccgggtagcgaaacgccatgttgaaatcctctttccaacccacgagcgagtcgtccgtgccgcggaacgccaccgccagcgtgccgcccggcagcagcatggtcacggcagcgaactgcatctgctgttcctcgctgaaatgctcatcggatgcgtccacgcgaacgcaggcaaagcgcggattgactccgatggcggcgtacagctcctgcgtcaggcgtgggtcggcgaggccattatggccgctctccacatgaaaatcatcgggggtcagcgcctccgacaccgaagccagcgttgcgtcgccgaactccagggcggccaaatggcgaatcgagcgcactggatggcgcacgtcgatgctgctcagacgtctgcggaatgtgccggatcgtgcctcgacatcggccagagtccgcacgcatgccggcatgtcctgatagacgagcgacgccagcaccagcgcgtcgacggcgttgaacggtgcgtcgacgccgaacgggcgggtctcggaacgtgcataatcgatgatgttgggcgtcgtgcacctcctttccgccgcggcggggctatgcttgtcgtccggagccgctaagggccgggcgggtgaccggttacccgtcaatatacccggttcccaacccgcgcgaacccaacaacaaccggcgacatgccctgttgtgcgtggtcggtggtaaaaacgaaaccagagtccaacggggaggttgtgccatgatcaacgaaacatacaaagccatgctcggcggcaaatcggtcattcgaaccctgagtgaatacgcgaccgcaaggggcaccgaaatcggatacgacaacgtgttcgactattcgctgggcaacccgagcgtgccgtgcccgtccagcttcaccaaggcgatgatcgacatgtacgagaccgccgatccggtcgcgctccacggatacagcccgtcgctgggcaacccggaggcgtgccgcaccatcgccgaaagcctcaaccggcgtttcggcatggattacacggccggccacatcttcccgacgacgggtgccgccggtgcgctcgcccacgcgctgcgggccgtcaccaagcccggcgacgaagtgctcacgttcgcgccatacttccccgaataccatccgtatgtcgaaggcgcgggcgcacggctgaccgtcgtgcccgccgacatcgagagcttccagatcaacttcgcggcgttcgaggcggcgctgaaccccgaggtggcggtcgtgctcatcaacacgccgaacaatccctccggcgcggtgtattcggccgaaacgctcgaccggctcgcgggtatcctgcgggcgaagcaggccgaatacggtcacgacatcttcctgatcagcgacgagccctaccgcgagatcgtgttcgacggcggcacgcagccgtacccggccaagttctacgacaacacgctgacctgctactcctggtcgaagtcgctgagcctgccgggcgagcgcatcggctacgtggcagtcaacccgcgggcgaccgacgccgaactcatcgtgccgatgtgcgggcagatctcgcgcggcaccggccacaactgcccgagctccagcatgcagctcgccgtggcgaagatcatcgacgagaccagcgacctgagcgtgtacgagacgaacatgaacctgctgtacgatgcgctgacctcgatcggcttcgacgtggtgcgcccgggcggaacgttctacatcttcccgaaggcgctggaagccgacgcgaacgccttctgcatgaaggccaaggaatacgacctgatcctggtgccgtccgacagcttcggcgtgtccgggtacttccgcatggcctactgcatcgacaccgacaaggtgaagcggtcgattccggtgctggagcgcttcgcgcgcgaggaatacggattgtaggcgaaaccgcgctctcaaaactcgcagatacagcaacaaaatgtcgattctggggctgtatctgcgagttttgagagcgcgttccgtctaagagcatccagaaagcatcagaaaacattcgaaaaccgttccgcaaggttgcaggacggttcaacgtcagacacaggggccgctaggaaagccgtcgttcaatggagtcaatccaaggaaaggacgacgaccatgaaaccccatgacatgcaaccccatgcgagccccggcggctcgcggcggcgtcgaccgccggtaatcgcgacgaggcggatggtcgccctcacgggtggcctgtgcgcgggcgccggcggcatggtgctgattcggcacctctcggccggttccgctggctccgcctcaaccatgcagccgccgagcggcaacttcggtggcagcgccaacaccatgcaatacgactattccggcagctactcggtgtcgctcaccgtcggcgaagactccaccgccgtcatcgacggtaccgacatcaccgtctccagctccaggtcgaacggcgtcttcgccaccgattccgggacggcgctcgtcaacgacacatcgattgagaccatggccgacaattcacgcgggctggacgcgacctacggcggcacgatattggcgaacaagatcaccgcggacacgcagggcggccacagcgccatcgtcgccaccgatcgaggcggcggatcgatctctctcgccgatgcgacgctgagcaccgccggctccggctccccgctgctgtattccaccggcgacattcaggtgaacaacgtctccggaacctcatccggcagccagatcgccggcatggaaggcctcaacacgatcctgatcaaggattcgacgttggaaagcacggtcaccggcaaaaccgcatccgacccgatcgccaacggcatcatcatctaccagtccacctcgggcgatgcggaaggcagcaccggcgagcacgccacgttccagtcggtcgattccacactcagctccgccatcggatcagggtcgatgttctacttcaccaacacgaccgccgatgtggtgctgcagaacactgagcttgatttcgacaccgacgcggcgacgctcacggacaacgcggcggccggctccggcacgggcacggcgagcgacgcccccatcactgtgaatgtcgacggcacgtccacgtgggtggtgacgaaggatacgaccatttccgcgctcaacgtcgcttccggcggcggcgacggcaacaccgtcaccatcgtggcgaacggcaagaccgtggtctccggcagcggcgacgtgaccgtcacggtgaccggctcgtattagacctcggtctcggccgggagcgacacggagctgtcgagcgacaccatcgaccgcagcgagttcgacagccggttcggcacatcgacagcgtggacgatggcataaccatggcggcgtgccagacatcaacatcagcaatcacttcatcagtcagttgtcaaaggagtcatcatgaccagcaacaacagcaacaatgtcaacaatgcgaatggcggcgagagcggcaacagcgcggatggtgccatcgagggcgtcgctatcgaggcggcggcgaacgtcaccggttcggagcagcgtcaagcggctgtgaatgacgccgctgtggctgatgtttcggtgactaacggttcggcgggcggctggggcgtggagcccggttccgcggctggtcgggccgatggtggccgggctgcggcagacaacggcggtacagacgagtatgcggggaatcgtgcggctggtctgggagacgccgaatgggctgccgggaccggggctgctggatgcggaaccgccggatacggctcggctgggtataggctcgcggcagctccgggcagttccggctatgcgccgaacggtccgatgccggggagctacggcgagggatcgcgtgcggcgtggtacgcgcagaatgcgccgacgcaggcaatgaatccgcagccgggaaatatgcaagcggtgagtggccagaacatgaacgcgcagggcgcgaacgtgcgaggcgcgaatacaccagatgcgaacgcgcagggcggccggatgccgttgtgtgcggattggaacggccgggggccggtgcctggagcaatgggcggtcaggtcccgacactgaaaggctcgaagggcggcgaacacgcgttgagcggtaagacgtgggcattgctcgccgtggtgtctctggtctgtggcctcgtgggcggcgtcggtggagcgctcgcggtgaacgcgctgaccgacgacgaagatggcacgggcagcagccagcagatgcagatgcccggaggcatggggcagctgcccagcggcggccaattcggcaatggacagtctcagcagtatggtggctcaggggagtcggacagccagctcggcagtggttccagtggctccggcagcagctccagcggttccggttcctcgtacagctccgacggcagtgatgtgaccacaatgtaagccatgagccgggcaaggctcagcgcgaagtgaaagcgttcaaccgcaatcgctgcccccccccctatctgccccatcatcctcgtcaaattacgggttgaaatagccgttctgggcaattccccgtgcgaaatcgccgttttgagctcgaaaaacggcgatttcacacggggaattacggatttcggctatttcaacccgtattttcgcgttctgttcgccctccacagcccgtaaatggcccagccggtcgggctttacggctcatccggccagcgcatcgctgatgaatcggtcgaccgtcgaccgatgcggcccttgcctcctcggctgcatcacggcgcacgccctccagcttggcgccgggaaccttaccggccctgaccagtttcatcatcgaaagcggcgcctgcgtgtcaaggacgaatcggaacatgaacgccgacgtggccagcgtcaacgcgcctgcggacgccgcggcgatgccggcgattcggcatccgcgccgtacccggccggcgcgtcgcgagcgaaatgagtcatgccgatgcgcgaaagcagccggcgcaaacgcagcgcagcttcccatgcggataccctgtgccgactggattccaagccggctgcacggcccaagcgcggccggcatgctcgggaagagcgcgaaaggcgaaaaatcctcacgacctctagcgaaccgcgcgaacggttgttagtgttgatgcacagacgatttcggtcgccgcggcgcgccgaacgccgcatataccgcttggtgcgcaccagacgtagagcggcggtctccaaaaccgcaggtcgttggttcgaagccaaccgcgtatgccagtcacttgttttttcggggtctgcctccgccgacgccccgaccgggacgcttcgcgttccatccgtctatcgtctccgggagccagccgcgcgtgcggcctatcatggcgtcgggttcggggagcttgaggttgagcaggccgccactggttatgccgaggcgttcggcgacctgcttgacgccgagagatatgcagtccgagaacacgcgacacgcagtgaatcttaacgaccgcaggactaggcaaacaataaatggcactacgtggatgctcatacacccactgccacctgcccgtcacccgcggccaagcacgggacctcggacataacgaccggcgcgacggatacaacggacccgaacacgcgagctgcaaccgcaaagcgggagcagccaacagcaaccgcatgcgcgaacactggaacaagcaaacaggaaacaacgtggcgactgcaggccgggtgagcctacttcttcttcggcacgtagatcacagtgtcgatcagttctcggtagtgcgcgacgatctgcgcgcggcgggtcttcaggctggccgtcagcatgccgttgtcttgtgtgaactcgtcgggcagaatctcgaacttgcggatcgactcggcgcgagacacgccctcattggcctgattcaccgcacgctcgacttcggtgtgcacgatcggattgcgggccagcgacgccaggtcggactcctcctgagcgccctgcgatttcagccacgcgttcgcatcggcgagatccaatgtgaccagtgcggccacgaacggcttccggtcgccgatgaccaggcactggttcacaaccggcgatgtcatcacggcggcctccaacaggccgggggagacgttcttgccgccggcggtgatgatcagatccttcttgcggccggtgatcgaaatgaagccgtcctcgtcgatgtcgcccagatcgccggtgtgcagccagccgtcgacgatctgctcggcggtcacatcgggatggttgtggtatccgcggcagaccagatggccgcgtacgcacagttcgccgtcgtccgcgatacccgcggtgacaccgctcatcggcatgccgatcgtgccgatccgattgttctccggcaggctcacgcacaccggcccgcaggtctccgtcatgccgtagccctcaagcagcggcatgccgatgccgttgaagaagtgcgaaaggttggcgtccatcggggcgccgccggtgatggcgaagtcggcgttcgggccgaaaatcgtgcggatcttcttgtacaccaccaactcgtagaacccgtgggcgaggcgcccccgccacggcagtttctcgccggcctgctcggccttcgaccaatcccgcgccacgtccgccgcacgcaggaacatcttgccggcgatgcccttgccggcgcgctgcgacgctgcgttatacaccttctcgaacacgcgaggcaccgccagcagcagcgtcgggccgaacgactcgaaatccttgacgatcgtcttcatatcggaactcagtcccaacgtcagcgtgccgcagaagctcagcagctccatgaaccgcgcgaacacgtggctcagcggcaggaacagcagcagacggcggtcgggccacgcgcaggcgcggggcatgtactgcatggccgacaggcacaggaacgccagattgcggtgcgacagctccacgcccttgggggtgccggtggagccggacgtgtagacgatcgtcgcgaggtcgtcgccgtgggcgtcgttcttgcgcgcccagaactcctcgtcgctcacttccttgccatacgcctgcaaggcttcgagcgcgccggcatcgatcacgaacaccttgcgcagcgactgcacctcatcgtggatggattcgatcttgtcgcgctgcccgtcgtcctcggcgaacgcgatcgtggcctgcgaatcgttgaagatccagcttacctgagcgtcggaattcgtctcgtaaaccgggacggtgagcgccccgaccgccatgatggccatgtcgagcgcggtccattcccagcgcgtacgcgacacgattgacacggcgtcgcccttcttcacacccaagccgatcagacccttgcccaaggcgatcaccaggtcgcggaattgcgtcgcggagaacgacttccagccgccgtccgccttgtattcgacggtcgagccgtccgggtcgcgctgggcgcggcggtcaaggaaatcaaacaggttgatatcgtcgtcgatcggttccttcagcggattggtgaactctttgaccatggtcgaggaatttactgtcatactctcttgaatactctcagcgtggtacaaaaaccgcgcgacaggcggcattcgggggggggggggggggggggggggggggggggcgggggggggggggggggggcggggggggggggggggggggggggggggggggggggggggagagccggagctagctacatccgctgtcagccgacagggtaactggcaccaagcattgccggatacgatatcgcggcggtatggacggcccgcccgtcaatcaggaaatcggcctcatggttgccgacacgggtcagcgtgacatcagccgtcgcctcgcgcccatcggcatcgggggcctcagccgaaaccgatgtgcctgccggctcctgctgcgcgcggtcatttgccgacggcctgccattgccggccacgctcgcggcctcttcggcgacggtggtctgcatgtcgtcgtcggaggggaagaaccgacgcagttcgggcgccagcccgaaatagcgcactccggtgccttccggcacggccgaagcgaaacgcgcgattcgcggatcctcacggttgagcaccacggtgcccgtcgtcgcttcggcgacacgctccagcagacgcgcggtgttgtcgatctcgccgaaccggtcgagctgatcgcgcatcacgttgagcaacagcgcgaaccgcggcttcacctgctgcacgaatttcaccgcatacgcctcgtcaagctcaagcacggccacgtcggcgtccagcctgccgctcaacggcacttcggtcagcagcgccgagacgacgccgcgcgtgaagttggagccggtcggattggtgaacaccttgagtcccagcgtctccagcatcgaggcgaccatgcgcgtcgtggtggtcttgccgttcgtgcccgacaccagcaccacgccatacggcaggtcggcgagcgtgcgggcgaggaaaccagggtcgatctgttcgacgatcttgccagggaacgcgctgccgccgtgccgcagcagccgagaggcgccgcgtacggctttgccgatcagcggcgtagcgaacgcggtccatggacgcgccgcatccgactgcccgcccagcgcctcgcgccgtgtttcacgcgatgtttcacgaggctgggatccgttttcctcacccatcgtcacactccttgatcgctgttgtagtcctgcggcatgtccttgaacttcgagtatgcgcccagaaacgccagatggaacgtctccgtcggaccgttacgatgcttcgccatgatgatatccgcctcgccgggccggtcctccttgtcgtagaaatccggtcgatgaaccagcaacaccacgtcggcgtcctgctcgatcgagccggattcgcgcaggtcggacagctgcggcttcttgtcgttgcgcatctcgggcccacggttcagctgggacaacgccacgaccggcacttccagctccttggcgagcagcttcagcgctcgcgagaactccgagacctcctgctgtcggctttccacctgcttgccggatgacatcagctgcaggtagtcgataacgacgagcttgaggtcgttggtctgcttgagacggcggcatttcgcacggatctccatcagcgacatgttcggcgaatcatcgatgaacagcggcgcgttctgcaacttgttccagaaattgttgagcgtgttccaccggtcggcggtgatgtcgtcggcgcggcgcatcgccgcgagcggaatgttggtctcggcggagatgatgcgctgcgcaagctccaccttgctcatctccagcgagaacacgatcgacgtcatattgtgatgcagcgcggccgcacgggcgaaatcgatgcccagcgtcgacttgcccatggcggggcgccctgccacgaccaccatctggccgggctgcagaccctgggtcacgtcgtcgatatcgcggaaacccgtcggcacgccggttttcaggtcgccgttctgcagcttgtcgagctgttcgagcgcatcgtgcaccaccgggccgatggcctcgtagtcctgcttgacgcgtccggtactcatctcgtagacctcggcctgcgcgaggttcaccacgtcttcggcctgcgagccctccgccgagtagccgagctgcgcgatcttggtgccggccgcgatcacgttgcgcaatatcgcccgctgatgcacgatctcggcatagtacgtggcgtttgcggcagtcggcacgaacgcgacgagcgtgtgcagatagtcggcgccgcccactttgtcgaggtttccgtccttcatcagctggttggcgacgatcaccacatcgacgttctgcgagttcgagaacaggtcgatgatcgcctcgtatatcgtctggtgcttcggctggtagaagtcggtgacgtcgatcatctggctgacctcgccgatggcgtccttgctcagcagcatgccgccgagcaccgccatctccgcctcgtcgtcgtgcggaggcacgcggtcgaacacggcgtcgcgtcccggcgaccccgcgtcgccctgcacatacgagccacctgattgcgggcgcggccctccccaattcgtttcttctgctgccataagacttgagtatatatcggagcttttccggtggaagatatctggcgaaaaatgcacagggccatctctcggacggcatgtcgcggtaagcggacgcgacattcgtcaccgtcacgcacggcttgctcgcaagtcatattcagccggcgtttacctgcgcgacacgcacgggtgacgtcatgtggacaaaaaagttgagttatccacatttaggggataactctggggataacatatgcagttatccacatcagggggataactctgtgcataacatggggataagtccataaacgcccccactcgatttgccaaacacgtcgtcatgcgatataagcggcgccccattcggctcaccgccgcgctttcagctcttcgatgccgcatacgcgcccgcccatatgagctacagtgtgcatgtgcacacccctgacccacaatcatccgatcctgcgaccgccggcacggcccgcaccggtaaccgagccgcatacggccgcatactcgcgctggccctccccacattcggccagctcatcgccgagccgaccttcgtgctcatcgacacggccatcgtcgggcacatcggcgtctccgccctggccggactgtcaatcggatcgaccatcatcctcaccgcggtgggactgtgcatcttcctcgcctactccaccaccgcgcaggtggctcacctgcttggtgcgggccgccgccgagaggggctgcaggccggcatagacggactatggctggctctcggcatcggcatcgtgctggcggcggctctgttcgcaggggcccggccgctgtgcgtggcgctcaggggcacgggcgagacgctcgaccaggcggtggcgtacacgcaggcggtggtactcggcgcccctggcatgctgctcgtgtacgcggcgaacggcattttccgcggtttgcagaaggtacgcatcacgttggtggccgcggtgtgcggtgccgtgctcaacaccatgctggatgtgctgttcgtgttcggattcggctggggcatcgccggatcgggcgcggcgacgatgatcgcacaatggttcatgggactgttcctgacggttccggcggtgctatgggcgaaggccgacggcgctgcgctgcgaccacgcctgtcgggcatcgccgccgccggaggggatggcctgccgctattcatccgcacactcgccattcgcgccgcgatggtgatgacggtcgcctcggcggcccgattgggaacgacagtgctggcggggttccaggcggtgaactcgtcttggaatttcgcgatgaatatgctggattcggtaggcatcgccggtcagaccctggtgggcgcggcgatgggcgcaggagaccgcgcacgcacactgcgactgacccgggccacgggacgagccggattggcggccggagccgctatcggctgcggattcgccgtggccggcctgttcgtcggccgcctgttctcgcccaacccgcacgtccagttgctggtcgccgccggcatggtgacgatgggtgcgttcctgccactacaggggtggatgatggcgctggacggcatactgatcggcgcccgcgatttccgctacctggcgattacctgcacactgaccgcaacggtgtatatcgcattgaccgcgatctgcgtggatgcggccgcgcccatgctgcccggcgacctggcctcgacagtgctgctatgggcgatgttcaatatcgtgctcatgggcggccgcggcctgttcaatggcctgcgcatacgcggcgaatcatggctcggtcagaccgccctctaacgaccggcccgcgacagccctcgctgcactgcggaacacccaccttgacatcacctttgcctcagctgagcatcatatgataatggcatcggctcccgaagatgggagacgccacgcggaaggagattccgccccgaatcagatgacatccgaatactcacagataagcaaagcatgatcgacgtgcgggagaaggccgccaagcagttcagcgcgcgcctgaccggtcgcgggttcgaaagctgggtgcgagagggcaacgacacctatgtggtcggcggtcaggaatacatgccgcaggacctggtcgtggtacgcgccctcgacgcggcgggcaatcccgtgtcaaccgaagtcaacgtcggcatagccaccttcaacctgtacccggatactctcacgggcggcgctgtacatggcacgcaccagactttcgcgccaatggctccacccgtatcgcttggatatctcctcaccggccgtagccccgagcgacgacccgtcggcgcgggtcaggtcatacagcatgtccagcagcatcggatcacggtccacgcaacgggcgagcgactcccccacggccggatcgttcgggttcttgccggtcgcgaactcagagagcgtcagatgctcccgcaccaggatgcgcacccatcgcgcgatgtccgcgtcgaatcccatgcgcttcatgatcaccgcggcgtgacgggcgccctctgccgcgtgatcggtcacgaacggacgtttgccgacatcatgcagcagtccggccaatagcagcgccgtgtagtgacggtcgtcataccgctcgcctcgcgccgccgaaacccgcgcgagccgtgacgtcacctcgacgctgtgccggtcgatggtataccggtgcgctgcagacgcgctcgggcgattgcgtatgcccagccattcaggcatccatcgaccgggtatatccacgaaatccagttcctcccacacgcgcatgagcgccggcccggaggccagcagacgcacgaacagttggcgcgactcatcatcccacacggaatcgcggatcgggcagcgccgcaggttctgcaaggtgaccgggctgatcggcagctcgaactcggcagccgccgcggccacgcgcaacggcagataccggtccggctccggttccacgcccggagccagcacgatttcctgctcgtgcttggccacgccgggcgcgacctgttcgaacttcggggcctctcgcctgcctccaccgcgcggcgacagcatctggaagaacgagaaacgcgggcgctcatgcgtcagcgaatgctcggcacgcgacgccgtggaatccagcgcgaacgcgatctgtcggcctatgcgggcgagccgggtctgcaagtcctcgatggaacgcgcctcccgctcccccggcggcagtgtcgggtcggcaagaccccgcatcgccgccacctgcgcctgatatggggcgagcagccgattcgcgtccttgccggcagccagatgaatgcaatcgcgcacgtccagcaacgcctcgacctcgtcgtcataccggccgtgcggtcggtcggcaagccatgacacagtcaacgcggagaccagcaccgaatcgcgcagaccgcctcgcgcctccttgatgtcgggctggttcaggtaggcgagtcgtccgaactcgtccagtcgcttgcgcgccgaattcagcagttccggcagccgcttgcggaccgctcgacgccagcgttccagaatcgacgtggccgtcgccgaaatcagcgccgtatcgccggcgatcggcttgacatccagccagcccatagcggccggcagatcggaatcggtcacggcctcgcactgctgccgcgtgcgcaccgactgatcgaggtcaaggccgctgtcccacaggggataccacagtttgttggtcagctcattgagctgttggtcgttgatcgtatgtggctcatagatgatgaccagatccaggtcggagctcgggccaatctgcccccgtgcgagcgacccgaccgcgccgaatccgatgccggtggacggcacgtcgaacggcaccgcggccaccgcgtcactccacaggcggcgcaggcaatccatggcgagctccgttcgcgcccggcgcttcgcggagccaccccggtacacgccgtcagcatccggctggctcatgtccatgaaccgttgcttgagatgatcgaccgccgaactcaagacacaccaccttcaccaaattccgccccgcaggcgggggctgtcggtggagtcgacgggaggtggtcaaacccacccgggtgcacaagaccaccctcagtctcgctacgcgagccagctcccgccagcgggagcaatttcaatccttgccctccgccaccggaggcaaggatgtcgatatatataaagagtccccgcatggtcaggtgacggcgtgcggggacttgtcttaccgataacccgcgtccggcggaaagcgccgaaccacgggccgctttcagatcgcggcggagccggtctcgccggtacgcacgcgggtcacggaatcgagcggggcgacccacaccttgccgtcgccgatcgtgccggaaccggcagacttgacgatcacgccgaccagggtctccgcgtccgcgtcatcggacagcacctcgacgcgaatcttcggaatcagatcgaccgtgtattccgccccgcggtacacctcggtgtggccacgctggcggccgtaaccgttggcttccgagaccgtcagaccgtgcacgcccgcagcggcgagcgcctccttgacgtcatcgagcttatggggctgaatgatggcagtgatgagcttcatctcacctcacctccttgagaaccgagctggcagtaccagcaaaatcataggcacgttcgccctgatcggccagatcgatgccgccgacctcctgggcttcggtcacacgccagccgatggtcttctccagcgcgaacgcgataatcgcggtcaccacgccggagtacagcatcgcgcacagggcgatgatgacctgcacggccagctggcgccagtcgccgccggcgagcagaccagtgccctcgccgaagaagccgatgagcacggtaccggtcaaaccgccgacaccatgcacgcccaccacgtcgagcgaatcgtcatagccgagcttgaacttcaggccgcatgcgaagcagcacagaacgccggcgatcgcgccgatgaccatggcccacaacggtgacaccacatcggccgcgggggtgatggcaaccagaccggcgacgatacccgaggccgcgccgatagccgtgtaatgaccggtgcggatcttctcagtgaagccccaggcgagcatggcagccgcggtcgccgcggtcgtgctcatccacgcatagccagcggtgccattggccgcgaacgccgagccggcgttgaagccgaaccagccgaaccacagcaggaacgcgcccagcatgacgaacggcacgttgtgcgggcgaatcggctgcgtgccgaaacccttgcgcttgccgatgatcagcacgatgataagggccgccattgcggcgttgatgtgaacgaccgtgcctcctgcgaaatcatgcgccgcggcgccgatcgcggtggagatcgggccctttgcgctcagaaggccgttattccacaccatgtgcgccatcggcgcgtagtcgaacgtgacccacagcgccacgaacagcatccacgtgctgtacttcacgcgctcggcgatcgcgccgcagatcagcgccacggtgatcatcgcgaacgtgacctggaacgacacgtccacgctgctcgggtacttgttgccgttcgcggcaaggccggcggccgtgtactgacgggtgccggcgtcgaacaccatcgtgtccttcagcaggaacccggtcgcagggtcaccgaaaatgccgccgatgctgctgccggcgtatgcgatcgaccagccccacagcgtccatacgaccgcggtgaccgacagggccgccgccgacagcatcagcatgttcagcacggctttggcgcgcaccataccgccatagaagaacgccacgccaggcgtcatgaggaaaaccaaggctgcggatgtgagcatccatgcggtattaccggagtccatcgttaccttcctctcttgttcgttcccgccgccgcgcatcttgaccgcgcgggaagcgggtcgttaccacttcatctgacatcccctgatagggggaatcaacacaacgatatgcaacgctcgctgagttttcaacacgttacggcacgttacgctcatgtaaagcggatgacgcgggtcttggctttcggccggattccggcgcaggcaacggttccggaatgcaaaagccggctgtccacgttgtggactgccggcttgcagggttcatgtccgacggtttgcgaacaacctcacgcgagaatgccgtcgacgaatccttccgggtcgaagggcgcgagatcgtccggtccttcgccgaggccgacgagcttgaccggcacgccgagctccttctgcacggagatgacaatgccgcccttggcagagccatcgagcttggagagcacgacgccggtgaggccgatcgcctcggcgaacaccttcgcctgcgccatgccgttctggccggtggtggcgtcgagcacgagcagcacttcgtcgacgggcaggttcttttcggtgacacggcgaatcttgccgagctcgtccatcaggttcgatttattctgcaggcggccggcggtgtcgatgatgagcacgtcggcgtcgtcctccttggcgcgggccgccgcctcgaacgcgaccgatgccgggtcggcgccgtccttgtcactgcgcacgacgggcacgttgacgcgggcgccccaggtttcaagctggtcggctgcggcggcacggaacgtatcggccgcgcccatgacgaccttcttgtcttcggagacgaacagacgggccagtttgccggccgtggtggtcttgccggtgccgttgacgccgaccatgatgatgacgccgggcttgtgcgcgtccggcttgtcgacgttcagacggcggtcggtgtcgcggcctaccaggtcgagcaggttgtcgcgcagcgtggcgcgcacctcgtcggggcttgccttgccggtgatgcgcgcatcgcggcgcaattcgccgactagctgctcgcttgcttcggcaccgacgtcggccagcagcagcgtgtcctcgacgtcctcccaatcggattcggagaggttgtctttggtgaggatgttgaacaacgccttgccgaacggattcgaggacttggaaagtttcgccttgagccgctgaatgcgcgagccggatttttccggtacatcatatgcgggagccgccggcttggccggggcggcctgcgtcggttcgaccggcttacgctctccctcacttcgaggggaggcggtttcgccctcggtttcgggagcagaaagctgcctgtcaactgttgcggcgaccgtctcgggttcttcacccgcacgacccgcctggcgcggcgatgttgcggtttccgccggccggccgacgacttcgttcttacgcgacttgccgcgtactacgccccacacaatgagcaggacgacaatcaccactgcggcgacaatgccgataatcagattcgtatccatggctccagcctaaaaaccgcaacggacagctgccggaataccacatacgtcgcgttgttgcagccaagtcgacgactaattgggctgctggcacagacgctgcccctgagtcgtccctacatatcgaaccggggaagacgctggtataggcaaatctgccaccaatgcataaagcggcataccggacggcaccggattgccagcggtcccatgatattcaacatagaacaagtcgggcaatggtgccccaccctcatcgtggtaatactcgcgaccgccaccgaaaacacgtatcaaacaggacacgcacgacacgatgtcatggttgtcgaactcgctcaccatcatcgacggggccacatacgtcttcatgatcgactctcctcagccgcacgacctaccgcgaaaacgtagaccccgacaacatttcggggggtataggcgctaggcaccgcgaccactacactggagctcatggccaatactgcaagaatgacggcgctgcaacgccgcgaacagctcatccgcgtggggcgagcgttgttcgcatccaaggggttcgaggcggtgagtgtcgaggagatcgccgcgaacgcgaaggtcagcaagccgatcgtctacgagcatttcggcggcaaggagggactgtacgcggtaatcgtcgaccgtgagatgcgcgagctgaccaatgcgctcatcgaggcgctgtccgacaccaaggcgcacccccgccagatcgtggagcgcgcggcactcgccctgctcacctatatcgaggagaactccgaaggcttccaggtgctcgtgcgcgactcgccgaccaccgacccggccggatcgttcaactcgctgctgggcgacatcagcctgcgcgtggaggatctgctcaccgccgcgttcaaacgccggaagctctccgccaagggcgtgccatactatgcgcagatgctggtcggcatgaccgtattcaccggtcaatattgggcggaccggccgaaggtcaacaaggagcagctcgccgcatacgtcgtcgacctcgcatggcacggcctgagccggctggattccaagccgatcctgcggttcgagagccagaaggcgaagcagctcgcagccaaggaagacaaagaacgtcgagacaaagagcggagcgagacaacggccccggacgagccggacgctcctgtcgagaccgccgaaccggacgaaccggcatacctgcccgcgagcgccgactgatcatcagaaccgcacacaagccggaagccccaaaaacggcggaacggacgacgggacttgcctgaacgccgcttagtgatagctttgcttgtagaggttagactcgctgcaacatccgaggcgacgtgtcgcacgtcatccccgcgacacctgtataacgaggaactatggaacaatcgtcgaaaacactcaccttcgtggtgcccgcctacaacatggaaacgtatctggagcgctgcgtggagtcgctgctctccgcgacggacaacagcgacatcgaagtgttgatcgtcgatgacggatcctcggacggcaccccggaacttgccgacatgtacgagcggcgctggcccggcaacgtgcgggcaatccaccaggtcaacaagggccacggcggcgcggtcaacaccggcatcgccaacgcgaccggcatgtatgtcaaggtcgtggacgccgacgactgggtggacatgccctccatcgacacgctcatgggcacgctgcgggtgcagcgcgtcgccacggatccggtcgacatgatcgtcaccaattacgtgtacgacaaggtgggcaagcgcgtcaagcacacagtgaacttccgtcatgcgatggcggccaacaccgtgctcggctgggacgatctcggctgcttcggcgtcgccgaatacatactgatgcacgcgctgatctaccgcacccaggtggtgcgcgactccggcatgcagctgcccgagcacacgttctacgtcgatttcatctacgcataccagccgttcccgtgggtcaagtcgatgctgtacatggacatcccgttctaccactacttcatcgggcgcgaggggcagagcgtacagaccgacgtgatgatccgccgcgtcgcgcagctgcggctcgtcaaccagcgcatggtggaggccactcccgaaccgggaaccgtgccggacggcctataccgttatatgattcatttcctcgcgatcgaaagctcggtcacgtcggtgttcctgatcctgtcgaaagacaaggcaaactaccgtctcaaggacgaactgtgggcggacatcgacaaggcgtcgccggccatcgggcgtgacgtgcggcgcaagctggtgtcgcgcgcgctgaacctgcgtgggtctgtcgggcgctggatgatccgacgcggctatgtcgtcgcagagaaggtcgtcggcttcaactgacgtgccgcgcggcggggctgccagctgatattcgcccctctatcaccgatcaggagaacgtccatgatgcaattcaccatgtccggaaccatgctgcgcttcgatgagacgacgctgcggttctcattcagccgcgacggtgcgacctggagcggctgcgacggcatagagccgcagttgacgcgcgaggatcgttcattctcgttcgccggcgccgctaccgtcacgcatgagcggatcgagaccggcaccggagtcggcgtgcgcagcgtgttcgccgggttcgcgggtgcggattacgcttttgagacgtatatctggatcgagcggtcgagcggcgacgtgctatgcgaatgggtgccactgcgcgagtgtggggccgagccgcgcatcgacagggtgctttggcctgcgccgctgtccttcgaccgtgcggacgcgcatgacgtgacgctcatcacccacgagcagggcgtgatgataccgaataactggcctaccgaggtcggcactgatacggtctccttcggcgggcggttcgagactgcgggcgggtacatgccctggttcgcgcagttgcgcagcgacgggcatgcgtacatcgccatctgcgagacgccgtggaacgcaggatatgacatcgaccatccggccggcggaccgtacacgcacgtcggaatgtggttcgagccaagtctcggccgcatggattaccgtcgtgtcgtgcgatatcgtctcctcgaccacgccgaccataccgccgtctgcaagacgtaccgcgcttacgtcaacgaacgcggccggctgcgcacgctggcggagaaggcggcgcgcaacccgtcggtgcgtgacctgctcggccgttcatgggtgcatgtcggcatcaagacgaaggttcagccggactcgtcgttctatgatcccgcgcagcccggcaagaatgattcgctcgtcacgttcgcgcagcgcgagcggcagatgcgcacgctgcacgaaatgggtgccgggcggctgtacctgcatctggacggctgggcgcagcccggctacgacaacggccatcccgactatctgcccgcatgccgcgaggccggcggctggaagggcatgaaatcgctggtcgacgcctgtcatgagcagggagacctgttcggcacgcatgaccaataccgcgactattacttcgccgcgcgcacgttcgacccgcgcaatgcgatccgactggcggacggcacgatgcccgagcacgcgatgtgggccggcgggcgccaaacgtacctgtgcgccgagcttgcgccggattacgtgcgccgcaacttcagtgagatcgccacgcacggcatcgcgctggactgcgcgtatctggacgtgttcacctgcaatgaaggcgacgaatgctcgcatcccgagcaccgcatgacccgccgcggatgctacgagcgccgcgccgaatgcttcgaatacctgctggcgcacggcattctcacctcgtctgaggaggtgtccgactgggcggtgccgagcctggtgttctgccattacgcgccgtacgacttccagatgcgctcccccgacgcgcctcggcacggcatcccggtgccgttgtacaacctcgtctaccatgactgcgtgatccagccgtggatgatggatcgggtggccggtggcgacgactacatgctgtacgcgctgctcaacggcggtgcgcagcatcatgttgccgaacagcgagatgccttgcccggcgacgagcaggatgaaattgcgggagcgcagcggatgcgcggcctttggctgcgcttgcggttgcggttcgggggaagtgttgggttgctctgtttcgtgctgtgccgcgggaagctgtgtttcggagggttgtgccggtgtggtgggcatggtgggttcctttgctgctggtggcgagttggtctcggtgttttgcgttggtggatttggcgtgagtttgatggatggtacggcaatgtattggggcggacgattttgacgccggagttggtggttcatcggcaatcattcataccgactgacggtatgtaaatcggtgctggagcaggggcgaaacattcgtgccgcgtcctgccccggagtcagcgtcgtctagtgtgcgtcgcttaccggactggtgccgcctccgtcttgttgctcggcggcgctgccgctgccgtcgccggcgaaggccatcatgccgtccgtggcgagatcgatgagatgctggtcgaagaccggcgcgtgcagcgcgtcgagcatggtggcgaggcattgcagacgataccgcagctgcgtgcgcgtggcggggaagaagcatggcatcagccaatagttgcatagcagggccagcagctgcgccacttcgcgcgggtattcggtggggatggagccgtccagctggccttcctcgatcaatggctcgaagtttttcggcagctcggttgaccagaatcgcatgttggcggtgaatgtggcgggatcgtcgaagaacggcacggtggccttgacgagcgccaggtgcgcggcgtctcccagcgagttggcgaacagcgagcggagcttttccatcgcgttcatgtcgtcgcgtttcgcgatctcgtcgcacagggcctggctggcgtgccagtcgtcggtgttcagtcgttcgaggatggcctctttggacttgaagtggtggtagatcgcgcctctcgacaggtctcccagcttatcgatgatgtcctggatggaggtcttgtcgtagcctttctcggcgaacagctttttcgcggcggcgaggatgcggcgttccgtcacctcggggtgcgggttgcgtgccatggttcctcctttcgatatgtcatcagtatacataccgacagtcggtatgtatactgcgtgtcatgattgcggccgtctgtagggccttttcggggtggcggcatcgcgcaaaatgggcaaaaccgtattggatatcggttatatgctatgttggtcaatgttgggcgttggcgcttgaccgaacgaaagaaggcacatatgacagatcccaatgccggtttccccactggaaacaactcttatggagccccgcagcccgctcagccggcttcggacgcaaacgcggcctatcagcagccgcagtacaccgcacccgtgccgcctgcccagcccgtgccgcctgcccagcccgtgccgcctgcaggggcaccctatcaggcgccggcaacccccgattacgcggcgaacatccagaactccgtcgccggtttcgcccagaacctgggtggcaagaacgtgaccgtcggaggccagtcattcgacttcatttccatcatcacctacgtggccggcgtgctggcgatcatcgcctgcatcgtgccgttcgtgtcggcgtttggatacagcgccagcctgttccaaggcggggacggatggattgtcctcgttgcggttcttgccatcgcggcgctcacgttcttcaagaagcacctccccgcaatgatcatttccgccttggtgctggtactcagcatctttgagatggtgtattccaagatcaagatcaacagtagcttggacgagttcggcagcaactatggcagtctgggaagtctcgcgtccggctacgcgaagaatgcggtggctttcggtattggtgcatacttgctcatcatcgcggcgctgggcctgattgtcggcaccgtgcttgcgttcggcaatcagaagaaggccgcgaaggtcgcggtgccgggtgtttccgcccagccgcagtatgtgccgacggcattccccggtgctccggtcccggcacctgccgcccctgtgtccgatgccggcgttcctcaggctcccactgcaccgcaggccccgaccgcaccggtcgcctcgactgcgtatgagcagccggcgcctgccgctccggtttaccagcagcccgattcggacgcttcctacccggggcagaccccgcaggcctgatttctaggtcttccgcgttccgcgcctgatcggcgtgaagcgtgaccaatgagccgctgtgcacatgcatagcggctcttcacatatgcgacggatccgagcccaatgaccctgccgataatccgggaaatatgaacggccgcacgcacccgcgatgccgcgatattgtccgctctcataggcataatagaaaagttgtgtctggaggatacgtgtatgcgaatccgctagcacagcacagcaatatacgttgcgggaggaatccgccgcgggcgaccgccgcgggtgccgacatcaccgcttcatagaaagaagaaccatacaatggctcccaagaagaaagtctcggcgctgatcaagctccagatccaggctggcaaggccaatcctgccccgccgctgggtccggctctgggttcgcatggcgtgaacatcatggacttctgcaagcagtacaatgcgcagacgcaggacaagatgggtcaggtcatccctgttgagatcaccgtttacgaggatcgctccttcaccttcattctgaagaccccgcctgcagcggctctgctgctcaaggccgccggtatccagaagggcaccgaaaacccgctgacccacaaggtcggctccgtcaccaaggcgcagctgcgcgagatcgccgagatcaagatggctgatctgtccgcccgcgacgtcgaggctggcatgaagatcatcgcgggcaccgctcgctcgatgggcatcacggttatcgactgagaggagaaggacacatggttaagcgttccaagaagtaccgcgaagcggctgagaaggtcgatcgcaacaacctttacaccgccaacgaggctatcgctctgctcaagtccatgccggcctacaacttcgaccagaccgtcgaagccgtgtaccgtctgagcgtggatccgcgcaaggccgaccagctggttcgtggcaccgtcaacctgcctcacggcactggtaagaccgccaaggtcgccgtgttcgcccgtggcccgaaggccaccgaggctgtcgaggccggcgccgacatcgtcggtgacgacgacctgatcgagaaggtccagaacggcttcctcgacttcgacgccgtcgtggccaccccggacatgatgggcaaggtcggtcgtctgggccgcgtgctcggcccccgtggcctgatgccgaacccgaagaccggcaccgtgaccatggacgtcaccaaggccgtcaaggacatcaagggcggcaagatcgagttccgcgtggacaagaacggcaacctgagcttcctcatcggcaagctctccttcgacgagaccgctctggacgagaacttcaaggccgttgccgacgaagtcaagcgtctgaagccggccaccgtcaagggccgttacatcacgaaggtgaccatcacctccacgatgaaccccggcgtcccggtcgatccggtggctctcgcctgatcaacgccaatcggctcaaccttcataggggcttcccgcacgcgcgggaagcccctatgtcgtatttcgattccctactagactccccagtttcgctgcgcttgacagccagcgggggcaaagtaaaccgcccgccgctggcgggggctgtcagtctttgactgactgggggtggttcttgccgccgcatatacaaaagccgcccggcacacacatgcgccgggcggctttcagctactgtcgcggtcgcctgtcagtaggcggccagaatatcgaccacgaagatcagcgtggagttcgcggggatggagccctgggcggtgtcgccgtaacccaagttcggcggaatcaccattagcacctgcgagccgatcgtctggccgaccatggcctgctgccagccctcaatcacctgatggttgccgccgctgtacgtgtcggcctcaagcgtggtgttcttgtcccatgacgagtcgaactgggtgccgtccaacagccatccggtgtacttcaccttgacggtgttgttgttcgtgacctttttgcccttgcccttgatcagcgcctgcgagaccagcttgctgcttcccttgtacccgttcatgttgatggacggcttgccgttcttcgctcgcgtgaccttcggcagatcggacgggatgtcggtgacttcgtcgcctgtggccttggtgagatccttcgacttggaaacgtaggtcagcgccatgatgtacgacgtgccgttggagttggagtcattgacgccgtacgcgatcgtcgtgttgagcttgcggcccttcagcagctcatagtaggcgtcgctcaccgtgcccttttccagcaccagggagcaatcgggtgtgttcttctcccagctgctcgcaagctcggtgccatccttgacgctgatggcgatgccctgcgagcacagacggtcgccatcagcgatagtggcgccgttgccttcctgcagcacggcatagctgttgttgtcgacggtcttcggtgccttgaaggagaccttcggtttctcgcccagcgtacccgtggcggtgatgccggcgatcttcttcatgttcttcaatgcgctggagtcggaggactgcgaggagtcgtcgccggatttctttgacgacgagccggaatcgccggagccgcacgcggcgagtgtgacgcacaggccgaccgtgcacacggccgcgagtacgcgcttgaacgtggatgtctgtgtcaacttacgcatggtcaccacactagcggaaaaccctgatttttctttggaaacgtctttttcgccggggctttatgccctgcattgtagaatgggtgagttatgaagaaacagacatcaaaagagcgcaagcgtgacgagcgaaagtccaagtcggccgcccgtccgacgcgccatgcccgcatcatgcggggcgtggtgacgcccatccttggtcttctggctgtggcatgcattggtctgggcattatgaacgccacatattggaagcccagctctcagatcgcggccagtgccgcggtgaaggggacgcaatatatcgttaccgatcccggcgtgctgccgctggtggacaatcaggtgacggtttccgccgatgccggttcgtccgacagggaagtatgccttgctctggggtcgaacaaagatgtgatcggttggctcgccgggcagccatatgtgcgcgtcaccggcttgaacgaatggacgacgctcgcgacgacgaaggtctccgcgcaggggtctgcggccgatgcgggcgatgacgcagtggcgttcaaggactccgatatgtggacttccgtgacgtgcgggacgggcaccgtgaaagcggagaccaaggtcgcgtccgacagcggtaccgtagccatcatcgacttgggcaagtcctcgaacgcgacggtgcgcatgaactgggtgcgtcagactctacctgatttcgccatgccgttctatttcgccggaggactgctggcgctgctggccgtactggccgcatccctgttcgccatgccgccgcacaagcgtcgcaagcgcgtggtgagtggttccgcagccgaaaagcaggcagaggaggtcgccgtttcgcaggcggtggcgggcagtgtcgcgagtctcaaggcggcggtcagtttcaagccgaaatccaagcgccgccgtcatgccgcgcatcgtgggaaacccggtgcgggcacgccggcaaagccggaaatctcccagccgaaggtcgtcgatcccggcagccgcaaccttgtcgccgaccagcagaacgcgcaggccatggaccagcccgacgattcggcgacgtcggtaatcaccgccagcgagctgcagacgtatttcgcgcggctttcgcaggaatccgatgatgacacgaaggggagctccaatgaataaacgcataaccaccgccctggcggcgacgatggtctgcgctctgacgctcggccttgcaggctgcgaggggcaggtgccacagaccgtggcgccgtcggtgaaggacaacgagatcatcgatgtgaccgtcgcacaggagaagcagatccgcgggaagatccttgacgtgctgaaccaggcgaacgaggcgaaaagcaccgacgggctcgccgcgcgcgtgtccggctcgcaactggagatccgcaccgcccaattgaacattgcgcaatacacgcagcaggatgtcacgccgttggcgactatccccagtgatgtgacgcaggtggtcatcccgaccgacaacgcatggccgaggtatattttcaccgtcaccaccaccaccgaggaccagcaggcgaagcgtctgctggtgatgcggcaggagtccgcccggcagaactacaagctgtgggctgtcgcccgactgcttgaggacgtgtcactgccgggcttcgcgcccgctaagcagggcaatgtcatgggcgatgccaacgactccaatctggtcatgacccccaagcaggcggtgcagcgatacgccgatgtgctgcagaacaacacgaacagcaaatacgcgggaagcttcgaggatgaccagttccgccagtcgctagtcaagcagcaggaagaaagccagaagggtgtgacccagaacaagggcacgcagcaggaggtgttcgcgccggtcgtcgaccagatcgccgtgatgcgctcccctcgtggcggtgacctggtcgtcgcgcagatcaactcggagtggacacggtccatgagcgagggccgtgagtcgttgccggggtccccgaacgaggatgcgctgttcaagatgacgaatcagaaggccaccagttcgctgaaagccacttatgtgaacgttgtggcgatattcgtgccgctggccgggtcggatcagaaggtgaccgtggtggcgggcgatcgtcaggcggtcaaggtcgaggcgcagtagacgccggactcgggccggcgcacggacttgccaagcaccggaatcgggcgcttgcagcgtaaccggaggcggtgagacgccgtggcctatatagtggtatgcgtcaacgatgttcgcgacggaatcgacggtggtcgcaggtatgcggccgcgccgattttcgcgcggcatggatgtgacggaacggcgtgcggcgcagaccgcgggccggtatgagtcgtgaaaacggaggcatgatggcacagcagcaggagtttcatccgggattgtcactcgcgggcgcggtggatctcgaatcgttgaagcatcaggtgaaggcggagccggggcaggccgggggagcgccggccgcgggcggctatgtcatcgacacgaccgagaacacgttccaggcgatggtgcagacctccgccacgttcccgatcctgctgctgctgtggatcccgaccgatgaccgtctgttcccgatggcccgtacgctcggcgacgcggtgaacaagctcaaagggcagattcagctgtcccgcatcgacatcgcaagctacccatcgatcgcgcaggcgttccaggtgcagggcgcaccggcgctgttcgcgctgatcggtggccgcccgatgccgattcttcaggggctgccgggcgatgacgagctgaagcagatcgtcgatcaggtcatccccaagctaatttcggtggccgcgcagtccggcgtgaacggtactgcgccgtattccggcgacccggactcggccgacggtgacggtgctggtgccggtgacggcgcaggtgcggcggctggtgccgacgtggtgccgcccgagcatcaggaagcgcaccagcttgcggcgcagggcgattacgccggtgccgccgcggcctacgagcaggtgttgcaggcgaaccccaatgacacgctcgccgcgcgggagcgcgcgaaggcgctgctgttggcgcgttcggcgaccgctgacgtgcgcgaggtacgcaaagccgccgcagatcgtcccgatgacgtcgaagcgcagctggccgtggcggatgtggacatgatcggcggccagatcgaggacgccttctcccgtctgctggattatctggcggacggtcacaccgatcaggtcgagccggtacgtaagcgtctgctggagtacttcatgattcccgaagcgaccgatgagcgcgtcaagcgtgcccgtcgccgccttgccacgctgatgtactgagcgccatcgcgccaaaatatgtcattatgctgaaaccgccgcggtgccaattcttgcatcgtggcggtttcagcggttttgggcctgtggtctacgccttatagtcccatgcggttacggccaaactgggtttggaatcggggcccgtcccggtgcagctcggcgtcgaagtccgcggcccactgcgagaacggccgcgaagccagtccgtcgttgctgaaccgcgcctgatcggtgatctccgtcacgcagaacgatggaatctgcagattggtcacgggtccgctacgctccgcctcggcgacgaccagcggggcgttcgcgccgccaaatatgtcgaggctccatccgtcctcgccgatccatgcggagaaccggttcttgataatcggacagcctccgcgcatcaccagttccgcggctatgcgggcgtcgatctcccgttcggcctcataacgggtgccgcccaccgacggccccttgacggtgacgaacgcctcggtgaaccggtctcggtattgcctcagtacggctatcggatcggtgtcggcgttcatatcgatgcgcaccccgtgtgtctgtagccgcactcgcaacgcgtaattaccgtcgtgcacataatagctctgcacgatcagcatcggctcgccgtcatccagttccggcggcagcgccctgcagaagaaccgacgttcatattcgaaatcgttcatggcgatgtccataccactccagtgtagtcggtgcgggagcgcgtaaacccgggaattccgcgaaattgtcgacatgttgggagtgggatggtgtacagtaatacagttgcttgccgcaaggcgagcgatgtctcgggttcgtagctcagtggatagagcgtctgtctccggaacagaaggtcgagggttcgaatcccttcgagcccaccagcaaaggttccataccatcggcatggagccttttttcgtggtctatctgcgtttcgagggggtgattcgggatgcgccggacatctatctacgtttcgaggggttgatagccaagtataaacgctacgggaaccgcatgattccagcaagaatcaggtcgaaatactctgcatatcgtgttttggcaaccccttgaaacgcagatagatgtccccagactgcaaaatcaccccctcgaaacgcagataggagatgttgcggcgaaagccggtcgcggcggttgtctccgcctcgcgaccggtcagctcttcttgggggcggtggtgctttcgcggacgaccaggcgtgtgggcaggatcaggtagtggtcagcgacggagcctgcacgcgcgtcgagaatcatgtccacggccttgcgggcgatcatgtcgaacggctggctgatggtggtgagcgccgggtacaggtattgtgccgggtacacgttgtcgaagccgacgaccgacaggtcagcgggcagggacaggccgcgttggcgggcagcgcggtacacgttgagcgccgtgacgtcgttgcatgcgaagatcgcagtcggccgtttggcggcgggcaggtcgagcagttggcatgcgcactcgtagccgcgttccggcatgtagtcgccgtaggcgaccagctcggggtccagctggatcccggcgcgacgcagcgcggtggcgtagccactgtagcgggcctgagcggattctgcgttctgcgggccggtgatgatgccgatgcgctgatggccgagtttgatgaggtgctcggtggcgatcagcccgccggtccagttgtcgatgcccacgccgagcgtgtcctgcgacccttcgccgatggagtcgataatgacgaagggaatgttgcgcgaacgcaatagtgttttttcgcgttcggtcgcgttggacagcagcaaaatgacgccgaggggattgcggttgaggatttcccggaagctttcctcgctgcgcttgccccgcccggtctgcgtgatggtgatgccgatgggcatcgatttcacatattcggaggtctccgcgatcatcgcgttgatgccgttcgccatgacctcggtgagcacgagctcgatggtctgtgatgtcttcgtggtgacgagagacttggagtacccggattcctccatgattttctcgatgcgcgcccttgtggagctggatacgccctctcgcccgttgatgacctttgatacggtcgcggtggagactccggcaagcttcgctatctcactgactcgcggttttttcatatcgcctgccatcggttgctccgtttcttccgtacttcattgtgggtgtgtctgcgttcgttgcagacgcacttcacactatagtaaagcgtttcgagatagatgaaagaaaatttctagaataagtggtgatttttctaaaagatgtgtatgatgggaacgaaacacaatacatcgagaaccattgaggcgaaggagccaacatgggcaccatcatcggagtcaaaacctacgacctgcgtttccccacgtccagcacgctgtcgggctcggacgcgatgaacaaggaccccgattatcctcggcatacgtcgtcatcaccaccgacgcggatggcggcctgagcggcagcggcttcgttttcactgtcggccgtggcaacgacgtggtcgtggctgccgtcgactcgctctcccgcatgctcgtcggccgcaacgtcgagaacctgctcgacgacatgcgcgccgcatgggacatgttcgtccacgactctcagctgcgctggctcggcccggagaagggcgtcgagcacatggccatcggcgccgtgctcagcgcgccatcgacccgatcgcggtcgccaacggcgagcagatgcagaaccgcatcatggacaagcagtatctgcaggcgggcagcttcaaggtcatgcagatcgacgccacgcgcgtcgccgggccgcaggagatcgtgctcgaatacctgctcgccaacaagttcggcgtgcgcgtgtgcccccacgccggcggtgtcggcctgtgcgaggcggtgcgccacttcgccatgtccgattacctggcggtcagtggacaatgggatgatcgcgtcatcgaatatgtggacaaccagcacgaatacttcgtgcatcccactgagatcgtcaatggtcgttacaaggccccgaccgctccgggctcgggcgtcgacatgaaactcgaagccgccgaacggtgcctgtacaagggctgatcgcagcgccgcggtgccgcggctcgcacggacacgaacacaacaaaggacactgaaacatcatggatttgcatctggaaggcaaggtcgtcatcctcaccggcggtttcaagggcatcggcaagggcatcgccctgcgactggccaaggagggggccatcgtggcggttatcaaccgagacgacggcgccgccgagcagttcgccgccgaaatgaaggccatcaccgacaactaccgcacgtatctgatggacctcaacgacaccgacgacatcgcgccgatcgtcgaggatgtggtgaagacctacggccatatcgacggtctggtcaacaacgcgggccgcaacgacaacctcgacctcgaccacacctcgtggcgcgaattcgagcagtcgctgcacggcaacctcacgcgctattacgagctcgcccaccgctgtgccccgtacctgcgcgaatcgaagggcgcgatcgtcaatatctcgtccaagaccgcgctgaccggccagggcaagaccggcgcctacgccgccaacttgctcgtgttcgacgcctccaagggcgtccacttccacgacgaggtcttcaaggacaccgtctacttcatgaacaacgtgttctgcaacacctccaccacgccgacgcagtggtaccgcaagaccgacgcgctcgccaaggccgcgttctcgaacaacgactactacgaggccggcggcaaggcttcggacacccagcctgaggacaagcgtggtctggaagtcgacccgaagttcgtcggcttctccggcggctccgacaccccggccggcaagctcgccggcgtggcgccgaagccaaggccaacctcgacaaggcatacacctcctccaagctgcgcgtgagcctcgactccgtcaaggccggcgtgcagtgggcgccgacgatgagcgagatccaggtgcacaacggctccggttctgcctcctcgcacaagccggctgtcgccgtcgtcaacagcaacttcaacaagcaggctcctgagacgctgcccgagtacaccgtcacgctggacggtgacaagctgcagtccatccgctggatcggctccgaaggcaacgtgctgagcagcctcgacgagggagactacacggtgagcggcgagggtgacaagatcacggtgaagatcgccgccgacttcctcaagggcaaggacgcgggcaactacggtctgcagttcgagtttgcgtccgtcgccacccgcaaggtgtcgctgaacgtgaccgacgaggcagtcgagccaagcaagtcgacgactccggccaagccgggcgctaacgagcagccgaagaccgaaggcgtcgcgaagaccggttcgtccgtgcccgccgtcgccgccggcaccacgatgatcgtccgcaagcgcgccactcgctgaatgacacgccgtaaaggccggggccggtaactatgtgccggctccggcctttgccggtacgatggatataatggatgtcttgccgttgcgataacgccgcggcagacaaaatagaagaaacgttccagagcacagaaaggaacattgatgtcaacttctggccgttttacgattccgagtgaatcgaacttcgcggagaagaccgcggaactggcccggttgtggggtgccgacgcggttcgcaactcggatggcacgcagttggacgacgaggtcgtggcgctgggtatgaaggtctacacggcctacttcccgacccgcgcgcacaacgagtggatcacgctgcacatggacgagaccccgcaggtgtacctgctcaccgggcgcgtcctggcggaagccgcaggcgggaaccggactggcataaaatcaaccaaaaaagtagtacaaacacactcttgagttctcaaaccaccaccactcggccagctcagcaaccccagtgaagaagtccatcgctaaccggcagcgagtagataacttacacgagttggccgaccaacgcaaatcgacatgccccaagacacccaaaaacgttgaaacaacaacattccatcggcgtgtcgaaaatcgtcaaaatacgccttcaatagcaacttcagaccgtctttcgtttccaaatcgttaggaaaaccgtccttgtacggcgtgttgtgcaatgttccccacacggacggcggccattcacccaccgttcaacgccggaaggcagacacattcctgtggtaagcctgtaaccatgaaacacatcgcagtattgacgggcgccggcatctccacgtcggcgggcatccccgacttccgcggcccggatggcgtctggaccaaacaccccgagcagatgagcgtctatgacatcgactccttcctgtccgataaggagaagcgcgaatactcctggcgctggcagaaggaatcaccggtatggaacgcgcagcccggagccgcgcacaaagcactggtcaaactggagaaagccggcatgctcacgctgctcgccacgcagaacttcgacgcgctgcacgagaaggcgggcaacagcccggacgtcatcgtcaacctgcacggcaccatcggcacctcacactgtatgaaatgccatgcgaaatacgacaccgccgacatcatggcccgcctggacgaagagcccgacccgcattgccaccgcacgcttccctatagtggcggtatgccctgcaacggcctgatcaaaaccgatgtcgtctatttcggagaggccctgccggacggcgcaatggagaaatcctataagctggcctcgcgcgcggacgagctgtgggtcatcggctcgacgctggaagtatatccggcggcgagcatcgtgcccgtggccgcacaggcgggagtgccgatcaccatcatgaacatggggcgcacgcaatgcgaccgtctcgcgtcgcgtctgattcgcgacgacatcgcagttgcgctgccgaagctggtggacgagaccatctctgcggcacagtaacggcgcagtagcggcacggctatgcaacggccagccatgacggccggcttatacgcagcgggggtgcccggacgagatggtccgggcacccccgcatgtcatcggcgtcaaagccgcaccgcttcatttcgcatctgcgaaagccggcggaaacccacggcgtcagtaaatgcgcttgggctggaagcctgcctccttcagcgccatgagaatatggtcgatatgatccggaccattggtctcgacggtcacaccgagtgaaaccgcattcgtatagtggccggacgccttgaactggtcgtgatccagagcgataacgttcgcacgttcacgagcaagcagctgtgccaccttgaccagctgtccaggggtgtcaggcagctccacctcgaagttcatgatgcggccgcgggcgatcatacccttctgaatcaccgcacccatcgtcaccgtatcgatgttgccgcccgacatgatcggcacgaccacgtgcgggccggtcgcggaggcgaacttgcgcgaacgcaggttcaggtgttccaaagccgccagagataccgcgcccgcagcctcgatgaccagcttgtgcttctccagcatcagcaggatcatctcgttgatatcgcgttcggtgacggtgaccagatcgtccatgaactcgttgagcagggcgaacggcaggtcgccggggtgcttgaccgcaacgccctcggcggacgtgacgacctgatcggcctcggtcacccgtccggcggcgaacgagttcttccatgccgggctgccttcggggatcgcgccaatcacgcgaacctcgggcttgaacgtcttgatggcgagcgccacgccggcgcccaggccaccgccgcccaacggcaccaccacgtcggtgacgttcggcacatcctccagaatctccaggccaatggtgccctgaccgcagatgacctcgtaatcgtcaaagggcggcacatagatcatgccttgcgtggaggccagttcggcggcatgggcggccgcctcgtcgaacacgtcgccgtacagcaccacatcggcgccgtacgccttggtggcgtccactttcagcgggggcgtaatctgcggcatgcagatcgtcgccttggtatgacgctcgcgcgccgcatacgcgacgccctgcgcatggttgccggcggacgcggtgacgatgccgcgggcgatctgctcctcggaaagcgacgcgatcttgttgtacgcgccacgaatcttgaacgaaccggtcacctgcaggttctccggcttgagcagaatctcatgcccggtcagctcagacagggtgcgagagggaatgatctcagtgtgacgcgcggtgcctttcaaacgcttggcggcgagcttcagctcggccgcgtggtcacgctgcaatgccttaaggacgtctttctgttccatactgcgtattgtatgcgtcgccctgccgaacggacgcggccgtctcacctgcgattgccgcagtcgcggcggcccgtcggaggactggccggaaaacagttgcacgtattcataagtcggcttcgttgcgaggctcccttcgtcgccgggcgtctgatgtatgacggtctcgatggtagacgaaacgtaatttattgccacggtatcgcgtgtttcttgcgcaaggaaagaaataacccgcataccggtccggcaattatcgtcgtgaggcgaagaagccggtgagcagacgggcgcatgccgcttcgcgaacgccgccgacgacctgcggcacatgcccgacatgcggatcgcgggggatgtcccaaatcgaaccgcacgcccccagcttcgcgtcccaggccccaaagacgatgcgtccgatgtgcgtctggatgcacgccccggcgcacatcgggcatggctccaatgtcaccaccagcgtgcagtcggccagattccagtcgccgcgggcctgcgcggcctcacgcatcgcctcgatctcggcatgcgccaacggatcgtgccccgcctcgcgacggttgcgcccccggccgatcaccgtgcctcgctcgtcgagcaccacggcaccgaccggcacgtcaccctgcttcccggcgcgctctcccagcgcaatcgcctcgcacatcgcctcgtcaagttcgcccatgcgcccagtttatcgaaatcgcgctctcaaaacttgcagatacaaaatcagaaccgccattttccaatacatcgacttttgtatctgcgagttttgagagcgcgattcatgaacaaccaccaatcaggcaccatgccgatgccgtatattgaggcttatgggcgaagaagcagcacacgatacgacacgacgtctttccgacgtgattcccggacgattcggcgatccggtctcggtgcagtatgcctggatgtcacccgaaaacgccgaagcgatgccgacacggccgttgttcctcgcgctgcatggatggggatccaatgaacgcgacatcgccggaatcatgcagtacatcgcccctacaacgatgtggtgtcgctgcgagcgcctctggtcctgcacgcgccggaaggcgtatcggccggcgcatacagctggttccatgacgctgtgccttccggagacgacctggatcacgacatcgcggccgccgcacgcgcggtcgaccagtgggtcgacggccacatccccgcgacgcgcgacgtcgtgccgatcgggttttcgcaaggcggggccgtcgcggtccatctgctgcgcatgcacccggaacgctatcgcgccgtcatcaacctgtcgggattcctcgcgcccgcaggcgtgcccggcaccgcgccggcggatgaccggctgaccgacttcgagataccggtatatttcggatacggcaagaacgatgcggtcattcccaaatatgagctgttcgccgcggccgcgtggctggaagagcacacgtggctgacgacgaaaagctaccgcgggctggaccatgcggtgagcctggacgagttttcggatatccggcaatggcttgtattgcacgacatcgcgtccggcgtgctgtgacccgcgcgaccccatcggccgcgcccaccccgttcagatgctgctgtcggcgtccacactcatgacgaacacgttgcggcgcagggccttcgcctgggcgcgtgtgatgtcgcccgcctcgagcatgtcctggatgatgcccagctcgatgccatagctctcgcgcttgatctcttccgcctgagcgatcgccttcgcgctgccgcccatgttcggccgtgacttcaacgcgccctcggcccggcgataatcgaggatcagcgccgagcagtgctccgtacggtaggtgccgcgtcccatctcctcatacagccgatccaccacgtgctccatcacgtcgagctgcagcagccgggagtgcgcgaacatctcgtcctcgctgatcagtggcgtggtacgccggatcttgctgctgatgcgccgtccgagattctccgcacgacgttcgaacgcgcgcatgcgcccgcgaatctgagacaccgcatggcccgaggaggagaccgtggacgtgtgccgcaacgtgttcatgatgtcatccatcatgcgttcgcatgcctccacgcgcatgtcctgctccgccgcatcatccagcgggtgcattttcaattcggcgagcagactcttgagatagtccttctcccagtgcagcgcctcgatctgcagccgctccaatccctgggggtcggattccccgacgcgctgcttcaatctcgtgatgcgcttcgtatacgactcgatgaccatgagcaccgcgcggcggttctcatcgtcgactcgccccgtcagctcctcgacggtcttgcgtaggatctctatggtgatctccgtcatttcgggtgccatgcggtcacggttcggagcgagcagaggcagcatgaaattcgccaatagtagcgtgacgacgatgacgccggatgcgatgaaaatcaactcgtcgcgcatggggaacggcacgccccaagtgacggtgaacgggatggtgaacatcagcgacagggtgatcgtgcccttggcgcctccgaaggtcatcaccgcggcgctgcgccaacgggctggcgtcatcttgcgccgtttgccagtgttgacgtcgcgcgccaaacgcagcatcccggccacccacaggaaccgcatcgtcaccacgaccagcgacaccagcagaatcacgatgctcaggcgcacgttgctcacgccgggatcgtcccaactggcgctcatcgccttcggcagctgcatgccgagcaggatgaacacggcaccgttgaggctgaacgacagcacaccccacacgctggacgacacgatgttggtgcgggcgacgttcggcccgatgccggtccggtcgaaccgcacgaacaggccggacgcgaccaccgcgagaatgccggacacgtgcagttcctctgcggtcaggtacagcatgaacggcaggaacagctccatcaatatgcgggtggtggtggtctcccaacccagcgagcgcacggtttcgaacagccagttcgcgagcaggccaatcgtcagaccgtatacggcaccgccgatgaacgagagcgcgaactcgccggcagcccggccgatcgcgaactcgccggtgatggcggcggcgatggcgaactgaaagccgacgatgccggacgcgtcattgaacaacgactcgcctttgagcacgcccaactggcgcaggctcagcgacgcctccttgcccagcgagctgaccgccaccgcgtcggtcggccccagcgccgcgccaagcgccagtgcggcggcgagcgtcacggacggccagacggcatggacgacgacgccgaccgccaccatggtggcgatggccagtccgattgccaatgacaatgacagtttcagcgatttcagcaattcggatttgtcgatctcgtgcgcttccagatacagcagcggcgcgatgaacagcaccatgaacagttcgggattcagggaggcgttggggaatcccggcacctgcgtgatgatcgcgcccatcgcgatctgaaccagcggagtcgacaccttggggatgaaccggctgacgaacgacgagaatacgacgacgccgataatgcacagtatcagctgaaagacttccaaggctcgctccggctctccgtcggttgtgtgggattacttcacaatataaaccgactccgcaaccgacacgttaacttcgacgtccggcttaacggctgcgcgcgggcaaaaagaaaccccggcggtgttgcccgccggggagagaaaggagagagaagaagaaaggggttcagttattgagaatcgtgctgccgattcccggtcggcttgtgctgacaattaatagtaaaacacccgtttcttggtgcaatgctgagattgtctgaaagcttcctgtgagttgatgtcgcgggctgaatcccatcacatggtaatggctgtagactgtagtgtggcgccgtgcgccatacacgtgagcgcgaaaaggagaatcctcatgctgctgtccgaccgcgacattctcgccgcccagaaggacggtcatatttctcttgacccatggactccggaaatggtgcagcccgcgtcgattgacgtgcgcctcgaccgtttcttccgcctgttcaacaatcatgcctacacatacgtggatccggccgagaaccagggggcgctgaccgagcagttcgacgtcgctccggacgagccgtggatcctacatccgggcgagttcgcgctcggctcgacgtgggagtacgtcaagctcgacgcgacggtggcggcacgcttggagggcaaaagctcgctgggccgtctgggcatcctcacacattcgacggccggcttcatcgaccccggtttcgaggggcatatcacgctggagctgagcaacgtgtcgacgcttccggtcaagctctggcccggcatgaagatcgggcagatgtgcttcttccagctcagctctccggccgagcacccttacggctccaagggcaccggctcccattatcagggccagcgcggcccgacccccagccgttcctacgtgaacttctacaaggccgacgtcaacgactagagccgatacccaagttctttgacgcaatgtgccggcgactccatgactgggccgccggcacattgttatgctccgttcgatgccgtctggcttattggcgaatggcggtgaacagcaccgactgggccggatgcagcgatggagggcgcaacccgtaggtcatcagcgcccggcccgtcatcagcacgccgtctttggtccaccagcccaacggcgactggccgctgccaagaccaagcccgtcgagatcgagatccagccacagcggctgtatgcggtacgtgccatcggggtcaagaccgggcacgcgaatcggcgccgcagggagagtctgggatgttgccagttgcgtgaaccggtagaacgccgcggaacgatccggcttgaccatgccgtcgacccggacggccggatcggcgatatcggcgtgcacgcacgtgtcgatcgcaaaccatgcgcggtgcctcttgtattcggcgacccattcgccgagcttgttcaacgcctcgtccggctccttgagcagattccattcgacgcccatgtgcccgaagaacgccatcgccatgcgcatctcctggctcgtggcgcgatgcgtggaatgtgcaggactcgcccccacatgctcgcccatcatgcagggcggcacgagcagcgacgtgtaccgctgaatatcggcccgctcgaccgggtccacgcagtcggacgtccacacgcggctggcgaattcgagtatgcccaggtcgatacggccgccgcccgatgcgcaactctcaatctccagtcccggatgtgcgacttcgaggtcacggaacatccggtacacggcgagcgtctgcccgtgcaccgccggcctgccggtacgtggcgagaccgcctcggtgacgaatttgttgtggtcccatttgatgtagtcgatgcccaactcgccgaccagcgcatcgatggaatcatggatgtatcggtaggcgtcgggattggtcaggtcgagcacttgctgcgagcgtccctgcatcggcagacggttcgcagtcgggcgcagcacccagtcagggtgggcgcgggccacgtcggaatccgggttgaccatctccggttcgaaccacaggccgaactccatgccttttccgtgcacgtaatcggcgagcgccttgaggctcttcggcccgtccggccacacatcctgcgctatttgccagtcgccgagcccggatgtggagtctcggcgggagccgaaccagccgtcatccaccacgaaccgttcgacaccggaatccccggccttatcggccagagccttcaacgtgtcgtagtcatggtcgaaatacacggcctcccacgtgttgagaatcaccggacgcggcttgacggcgagatccgggtgacaggagcgcacgtaatcatggaatctcgcagccacctcgttgagcccgtcaccgtacgacccgtacagccacggggtggtgtacgtttcgccgcgggcgagcgtggcctcgccgccgagcagcacctcgccgccgccaatcagaccggtcgtatacggctgacgctctgccgacagcacggaattgccgctccagcccacatgcaccgaatagacctcgccatgctcgaacccgaagccgggctcgcccgcggaaagcaacagagaggcgtcaaaacctgggcgccccgccatcgagaccttctcgaagcgtccttcggtcagcggctgccgctgcgggctgcgttcgcgcagatgatggccggtggtggtgagtatctccgtggcaagtgccgggagcgggaagccgagttcgactttaccgacttccaagtcaccggtcggaagattaccagctggaagattacgcagcgtggcgcgctgtctgatcagtccgccgggcaacagttcggccgtccatgacagttccacgccctgctcggtatccgacgcggtcacggtgacgaccggcacctgttgcgtgacggtatgcgcagcaccgtccacgccgtcggacacgtcaacgccttggcgttcgtcctgacggattgcgatgccggtcaccgtgaatgcacagaacggcgttacgccggcgcgccggatatccagtcgcggtgcccctatccacgactcgctttgcgtgggcatgatgcttggccaggcggtctcgtccagcgcgccggacacgcgctgcggccgcagggcgtcgtatgcggcgagtacggttcccggcgccgcgagcgggcggccccagtgcacgaagcgcggaagaccgtgaccggcgaagaccagcgcgaacgccacatcagcagccggctgctcagcataaatagcggtgagttccgttccatcggcggcggcgccatggaattgttcgatgagtgacattgcgaatcccttcggaacgtgccattgatatatggttcgcctccgatgctacgacatcgttccgtcatgtcaccgcatattcagcgattcaggggtatgagaagggctcccgttttccgatgtggagagcgggagccctgactgctggtggaggcttatggcattgttatgccataatgccgcgcttgcggtcgatggcgcgcatgatcgccttgtagatttccgaggcgatcagcacgaccgcggcgaggcagatgcactcgacccatgcccacggtccgagcggcgtggtgccgaacgcggagttgaggaacggcacgtagatcaccacgagctgcagcacgacagacaggccgatcgccccccacagccacttgttggagaacaggccgacgaacgcggactgacgtgcggaacgcgatgcgatcgcgttgaacagctgcgcgaacacgagaatcgtgaagcccatcgtacgggcctcgatcatctggaattcgtgggtgccgccgatggagcggtcggtgaacaggccaccttcaaggtgcatgtccatgccgatcaaggtgacggccgccatgatgatgccgatgaacgcgatatcgatccacatgtccctgtcgatcacgcggtcggtgagcttgcgcgggctgcgtgccatcacgtcatcggtctgcgggtcgacacccatcgcgagcgccggggcggcgtcggtcagcaggttgatccacagcagctgcgtggcgagcagcggcacggcgacaccggtggttcccggctgcgtgatgccaagcacgccggcgagcatgacgccgccgaacacggtgaacacctcgcccacgttggagctcagcaggtagcgcaggaacttgcggatgttgtcgaagatcacacggccttcgcgcacggcggcgacgatggtggagaagttgtcgtccgcgagaatcatcttcgcggattccttggtcacctcggtgccggtgatgcccatcgccacgccgatgtcggcggacttgacggccggggcgtcgttgacaccgtcgccggtcatggcggcgatgttgccctggcgctgcagcgactccacgatcttgagcttgtgctcgggggccacgcgggcgtacacggagacctcagaagtcgccttgtcgaacgccgcctcgtcgggcatcgcgtcgagctgatcgccggtgagggccttgccgcccttttcgatgatgcccagatcggaagcgatgcgggccgcggtgagcgggtggtcgccggtgatcatcaccgtgcggatgccggcgcgatgcgcttcggccacggaatcacgcacttcggtgcgcggcgggtcgatgatgccgaccatgccggcccagatcaggtcacgctcgatgacgtcgctctgctcggagatgtcggtcacctggccggctgcattggtcttgatgccggggatatcggccagggatgtggtgccgagcgggcggtacgcctcacccagcgtgcggtatgcctcgccggacagacgctcgacggtcgcgagaatctcctggcggtcgccttcggtcatcgggcggacggcgtcgccaaccgcgatgcgcgtgcagtagccgagcagcacatcgggcgcgccctttgcatagacgctcaggttgccgttgtcgctgctgtccttgccgatcacggccatacgcttgcgctcggacgtgaacggaacctcggccacacggtcgagcttgccgagggcgcgttcggccttgatcttgcgggaagcgacgacgagcgacacctcggtcgggtcgccgacgatctcccactggccggcatcgttctgacgcaagtcaccgtcgttggcaaacgctccgacggcgatggtgcgcagggcttcggcgttgaccggagcgctctcctcgatggcgtcgccacccatgcccagcatcttgcccttgggctcgtaaccggtgccggtgagctgcacttcaccgctcggggtgacgatgcgctcgacggtcatctcgttacgcgtgagcgtaccggtcttgtcggagcagatcactgaagcggatcccagcgtttccacggagctcagcttcttgacgatggcgttgtgcttggccatgcgctgcacgccgagcgcgagaacaaccgtcagaatcgtcgcaagaccttccggcactgcggcgacggccagcgaaacggccagcagcagcgagtcgatgagatcgtcgggcatcttgtggaagccctgcgtgatgaacagcgcgacgagcacgacggccgcgatgatgcacacggcaatgcccaggatcttggagacgtgggtcatctccttctgcagcggggtatcctcgtcatcggtctgcgacagcatgtcggcgatcttgccgacctgcgtgttcatgccggttccggtcacgatcgcgcggccggtgccctgagtgacggacgtgccgttgaaaatcatattggtgcggtcgcccagcgccttggcggagtcgagcgtgtcgggcttcttgcccaccggcacggattcgccggtcaggctcgcctcggcgatgcgcagcgacgcggcggcgaacagacgcccgtcggcggagacggtatcgccttcgccaagcaccacgatgtcgccgggaaccacgtcggcggtgttgatgtgcacgattttgccgtcacgcagcacggaggtctgcggtgccgtcatttgggcgagcgcctccaccgcctgctcggcacgggcctcctgaatatagcccagcactgcgttgacgatcaggatcaggatgatgacgatggcgtcaaacggcagcacttcgccggccgttccgtgcgagcgctcgatgaaccatgcgatcagtgagatgacagtggcggcaagcagcaggtacaccagcggatcctggaactgcgccaggaacttcttccacttgggtacgggtggcgcgctggccaactggttcgggccgaatttctccaaccggcgctgcgcctcggcggagctcaggccggtattggtatccacatccagcgccttggcgacttcgttcgtctcggtcaagctgggatcgacgtcgtgaagcaggccttcctgcgactgcacgcctgtggattgatcatttgtgtgatcaaccataatggtctccttgatatagccgcggagtagtcagccctcacgatcaccgggatcgtcccctcccccggtcatctcgataaagctgcgcggttatgggcaccggcgcaactgctgccgatgcatactgttgccattattccacaaacccgtcatcgcttggcgaaacagccctttacgtgttgtccaaatatccgcattccgcgaacgatttcaggcgacacgctcacacagcgcgagcagccagcggagcgccgccatggtgtaatcgaacagtttgtcgtccatgccgaaataccgctcgcagcgctccctgctcacatcgaccatcgcaagaccttctggctctccgggtatgaatgacgccgcccgatcctgcattcatcatacgtgccaaggcaaggaactccggcggcttcggaaccggacgagctgcgttccgttcctaagtgcgcgccgaaacgacaactcgggggtgcggatgtttttttggacggttagacggccagtccaaggtgtttgcggtattgcacggggctcagccagccaaacggcgggacgaggggacagcacggcaggaaacggcggaagacggcggcgacagaagacaacgaaacacaacgcaacaagacagcaaacacagcaacatagcaagataacgaaatgaggaaacgcattcatgggaatgccattggatctatatgtcatccgacacggagagtcggaggcgaacgtcatcatcaacgcgggggagcagggcgataactccctgtacacgcaggacaacgtgaccgtgcccgaccggtcgtggcgactcaccgccaccgggcgcaagcaggccgactgcatcggccgctggctcgtcgcgcaacagcagctgttcgaccggtatctggtctcgccatacgtacgcacgcgcgaaaccgccgcgacgatggcgctgccgaaagccaagtgggaggagacgcgcgtgctacgcgaacgctcctggggcgagatcaacaccatcacgcaggacgatttccgcacgaactacgcgcgcaactggatgttcaagcgcaccgacccgctgtactggcgtccgccggcaggcgagtctattgccgacgtgtcggagaaccgcgtgcataacctgctcacgtcgctcaaccggcgtgctgaggcggaatccgtcgtcgccgtcacacacggcgacttcatgctcgcgctgatgctcaccctggaggacctgtcggacgaggagttcatgcgccgcgccgacgacccggcatgggcgatcaccaactgcacgtgcctgcattattcgcggcgagacccggccaccggccgcacgtcgtcgcgcgtgcgctgggagcagaccgcgcgcccggtgttcgacgagtcgaccggacgctgggaggtgcgcgtcgatccgtggcgcgaattccagcgcccgttgctctcgaacggcgacctcgtcgacgtggtgcattcggtcgacccgcacctgtgacggcacgaggcgcctcacggcgctcacgggccgcgcatgacgagtcgcgcgccgcacgtggctcgtcatcgcaacggtgggcgaacgggttacaatggcctcaacgcggcacatggctgcatggatgtgccacctgagagaaccgaaggagttcgtgatgggaaacctgttcacatggaaactgcatggcgacggcaagacgctcgcgcccggcgaggtcgtggagcccgatgagcgactgacctggacccgtaccatcggcatcggcgcccagcacgtcatcgccatgttcggcgcgacgttcctggtgccgatcctgacgcatttcgacccgtcgacgacgctgttcttcaccgcgatgtcgaccgcgctgttcctgctcatcaacaagaacgtgctgccgagctacctgggatcgtcgttcgggttcatcgccccgatcgccgccgtcgcctccgcgggcaagggcattccggccgccagcttcggcatcatggtcacaggcctgctgctcgccctggtgggcgtggccgtccacttcgccggcgcgaagtggattgacatcatcatgccgccggtcgtcaacggcgccatcgtcgcgatcatcggcttcaacctggctcccagcgtgtggtcgaactggcagaagggctgggacaccgccctggtgacgctgctcgccgtgctgctcatcgccgtgctgttccgcggtcttgtcggacgtctgaacatcctgctcggtgtgatcgtcggctatgtgtacgcatgcttccgcggtcaggtcgacttttcggccatcggcgacgcggcgtggatcggcttcccgaaattccatcttccgcaggtcgacttctcgatcctgccgatgttcatccccgtcgtgctggtgctggtcgccgagaacgtcggccacgtcaagtctgtggcgcagatgactgggcgcgattatgacgggcatatgggcaccgcgctgttcgcggacggcctcggtaccgcaatcgccggcttcggcggaggctccggcaccaccacgtacggcgagaatatcggcgtgatggccgcgaccaaggtgtattcgaccgccgcctactggtgcgcggccgcattcgccctgctgctgagcctgtgcccgaagttcggcgcggtcatcaacacgattcccggcggcgtgctcggcggcgtgaccactctgctgtacggcatgatcggcatgatcggtgtgcgcatctgggtggagaacaaggtcaacttcgacaagccgctcaacatcatggtcgccgcgatcgtgatgatcatcggcatcgccgatttcacgttcgcgttccagggcgtgcagttcaacggcatcgccatcggcacggtcgtcatcctcgtcgcctaccacgggctcaaggccatcggtaaggccacgggcaccatcgacaaggacgaccccgacatcctgtagcgggttcgtggccgctgtcaggtatgtcactgtgcgtgggtcatgtcaccgtgcgagggttacgtcacgttgcgtgccccctcgcacggtgacatgaccctcgcacagtgacgcgacccacgcagcgtgactcacgccagacgcgcggagtgacgcctcgccgccgtcggaacacgttgatgaagtagctcgccgacgaaaacccgctcatccgcgccgagcagctcaagcagttctgggtcgaccaccacgcaggtgaaccagcattgcctctgctgcggcgagaacccgtaatgcagccggctcgaattgacgaccaatccgttgccggcttccagcgtcactatggcgccgttgacggaatattgcatctgaccgctgatgacatggatgaattccagatcgcgatgccagtgacatgggcagcggtagtccgggaacgacgacaatgcgtcccgtctggcatatatgggcaggtcggggatgttgtagtcgatccgctccgaaagatccgacgagaatgatggtcttcctgcccgccctgccaggttccgggccggtcgcgccgcctgtgcaccggagtgccccattgccgctctctgcgtgatgtaacgtatatgaaaatactatatttcttttgatgcgcaaaagtatcattgcgccggtgtcgtcgttacattccatccctatcgtagatatcagttcttcttgctgcaggagagggactcaatcgatgattcggacatcgcgagaatgacgatattaatattttgtcgttcatgtgaccgtctgcatccttgaaacaccctgatggaaaggcaaggtgagtgtgatgactcgcatgatggaactgatcaatggatggcttgcccggtattatgccgtcgtccgtgcccggatggccgtccggctggcttcggtccgtgccgcggtgcacggggacggcgaggagaacatcgcgtcgttcgcgcggtggtacccggcatccgccgcgcagttcgccggctgacggggatctgcgcgggaccaatcgggtggccggtgcggcgggggggggctgaatggtccgatactctgaccatacattgtatgggggatcggagcatgatataacgaactcgaacggccgcaacatcgctatcgtcactggtagtgcactgggattgggatacgagctgaccaaacagctgatcgccgacggctggttcgtggccggcatcgacaccgcgttctaccgcgacagccgcgactacgtgtcggaggagaagcagcacaccttcatggatccgggcgaactggcccgagtgatcctgttcaatctggtcaacgacgcgaacctgaccgtctccgacatcctcatagaacgcagttgccgctgagccggatgagttccgccggctcagcggcaatgcaagtcgcgcttctgcgcgcccgtcgtctcagcgatcctcgggcggcttgtactggtccttgtcggtgaagcaggtccgataggtcatcgtcatgatgagcgcgtcggccacgagggtgagcgcggcgatggcggctaacacgacgaactggtatttcgccgcgttcagtgggtctccgccggcgatgacctggccggccatcatgccggggatggtcacgatgccgcacgacgccagcgaggcggtggtgggcagcaatcccagtcgtatggacgagacgatcgaaggacgggcggcctcccacggggtggcgcccaaggcgagcagcgtgtccacctcgtcgcggcgctcgttcatgctctcatagaaccggctcaggccgacggcgagcgccgacacggtgttgcccagtagcatgccggtaagcggcaccaccagctgcggtgcataccaggggtgcgggcgcaccaccagctcggtcaccagcgagatcatcagcagcatggttatgaccagactgagcagtaccgggccggcgagccccttcgggatgcccttggcgcgggagagtgtgatctgcacggccgcgaccagcatcaccgcgatgacgccgaacaccagccacgggttgttggagcggatcacgtacccgatgatcacgcccatcacgcacagctgcaccagcgcgcgtatcgccgaccacatcagcgtcttgccgatgctgatgcgcatgagctcggagacgagcgccgcgaccgccaccatcagcagcgcgaccagaaggccccaattatcgatcacgtaaccgttgccgctcatgacagcctccctgaggacagtgtgacgatgcgtgtggctcggccgtcgggcggacggtgccgtatgcgcacgatggccatgcccctggcggccgcgctggccatgatcgaggcgaccttgtccgcgttgtcgtcgtcgaggcctgcgtccacctcgtcggccagcagcacggccgggcgggtcagcagcgtcctcgcgaggctgacgcgggccgcctgaccgccggaaaggtcgtgcggcgcacgggccaggtcgatatcctcgcatcccatggcgtccagcgtattgcgaatgagctggtcgggcagcgccagcttcgcctgcgactgttcggagcggaacagccggctgaacctgccgcgtctcgcggaggtcttcttgccggtggccgcatggttgtcgggcgcgctcgcctcgtccgctctgcgcacggccagcgtccagggaagccgaatcgtgtcggcgacgctgtctcccatcagcatgggcttctgcggcagatacgcgacattcctccgccactgctgcagcgagaacgatgagctgtccgcgccgtccagcgtgaacgtgccgtcggcatgggggttgagcagcgcgaaggcggtcagcaggctgctcttgccggaaccggacgggccgaccagatcgacgatctggccgcgatcgacgtcgaacgacagatcctcgaagatggtgcggtctgactgcgcagaaggcacgacgcaggagaccctacgggctgtgaacaacatttgcatagtggcaacgttacccgttcgccggccatagtcgatgtttgacagcgtttcttagtccagtgttagagacgcacgcggcgagccggccgaatcgtggcgcccggcaccgctgtatcgcttggcgcgtacagttgcagtcatgccgatcgattccagaatgatagacaacatgaaggccgaccgcgtgcgcaaggtggccgatcttgccaaccgccgcacccgggagcgtttcggtcgtttcctgatagagggcccccagtcggttcgcgaggcggtgatgtggatgcccggcgccgtccgtgacctttatgtgcaggccgtggacgggccggacgggccgcggatcgcaggcgagacgctgacgtccatcgtcgagcgatcccaggaacaccgtatatatgtgcatccggcgagcgaggcggtgatgcgccgcatcagccccgattgccagggcattgcggcggtcggcgatgccgatgcggtgcgcgcgacggcgcaggggacgcaattgcccgaaaagccgttcgtcgcggcgttctggcaggtgcgcgaccccggcaacgcgggcacggttatccgtgcggcggacgcggccggatgcgatgccgtggtgttcgtcgacgattgcgtcgacatgctcaatcccaaggtgatccgcgcgaccgcgggctcgctgttccatatccccgtgatgacgatgggcgtggacgagttcttcggatgggccggcgagaaggtgctccgcaccgtcgccgccgacgtctacgggacggacgggcgcgagccaagggagctgcccgaggcgctgagggaccaggatctctccggggtgggcaaggccgtgatcttcggcaacgaggcccgcggacttgagccgggtctgctgggtaggtgcgacgacatcgtgcgcattccgctctatggcaaggccgagtcgctgaatctggcgaccagcgccgcgatcatgctcatgagtatggctatgtcgagccatatagggacaatgtgaactcggtaaacgcttggattatttgatttttggcgcagataaaccggtagtttcggtagttgtaggtaggacgaaagggttctcgtggcagacaatgctctcttcgatgcccagtcagtgaccgatgcggtcgccgagggcatcagcaagattcagaacgcctccagcttggaggagctcaaagccatcaaaacgcaatacgccggtgccgaatcggcgatgaccaaggccagcaaggccatcgggtcgctgccggtcgatcagaagaaggaagccggcaagcttatgggcaagctccgcgccgacttcggccgcgcgttcggccccaaggaggccgagctcaaggcgcaggaggagcagcgcgcgctggaggccgagaccgtcgacatgacgctgccggtcaaccgtcgcccgctcggcgcccgccacccgctggccaagctcatggaggacgtcgaggacctgttcatctccatgggatggcagatctccgccggccccgaggtggagaccgaatggtatgacttcgacgccctgaacttcggcccggatcatcccgcccgccagatgcaggacaccttctatgtcaagggcaaccaggcccatgacgcggccggcttcgtcggctccaacatggtgctgcgcacgcagacctcctccgatcaggtgcgtgccctgctgacccgcggcgtcccgctgtacatcgccagcccgggccgtgtgttccgcaccgacgagctcgacgcgacgcacacccccgtgttccaccagtgcgaggctctggccgtcgacaagcacctgacgatggccgacctgaagggcgtgctcgacaagctcgccgtggccatgttcggccccgaagcgaagacgcgtctgcgcccgagctacttcccgttcaccgagccgagcgccgaactcgacctgtggttccccgacaagaagggcggcgcgggctggctcgaatggggtggctgcggcatggtgaacccgaacgtgctgaagtccgcgggcatcgaccccgaggagtacaccggtttcgcgttcggtgtgggcatggagcgcacgctgctgctgcgttccgatatcaacgacatgcacgacctcgttgagggcgacgtgcgattcagcgaacagtttgtgatgggggagtgagaagcccatgcctatggttgacattgattggctcaaggagcacgtcgaggttccgtctgacctcacctacgagcagctggccaaggacctggtcagggtcggtcttgaggaggaggagatccacgcctcccaggtcaccggtccgatcgtcgtcggatatgtcgtcgacgcgacgccggaaccgcagaagaacggcaagaccatcaactggtgtcatgtcgacgtcggccccgcgtacaacgcggtcgacgagaacggcaagaaggtgccgcgcggcatcatctgcggcgccccgaacatggccgccggcgagaaggtcgtcgtgaccttgccgggcgcagtgctgcccggcgatttcaggatcgaaccgcgcaagacctacggccacgtttccgacggcatgtgcgcctcggagcgcgagctcggcctgggcgacagccacgaaggcatcatcctgctgcgcgactacggcttcacgcctcaggaatacaaggcgctcaagcccggcgacgacgcgatgcacctgctgcacctcgaccagccgatcctggaaatcaacatcaccccggatcgcggctatgcgttctcataccgtggcgtggcccgcgaataccatcattccaccggcgcgaagttcgtcgatccggtgaccgagctcaacaagcgcgcccccgccgctcccgcggcggagtccggcgtctccagcgacatcgaggtcatcgtcgacgacaacaacccgattcacggcgtcaccggctgtgaccgctacgtcgcccgcgccatccacgggttcgacccgacgaatcacacgccgaactggatgcgccgccgtcttatccgcgcgggcatgcgttcgatctccctcgccgtggatgtgacgaactacgtgatgctggatcttggccagccgatgcacgcctacgaccttgacaagatcgaagggccgatcgtggtgcgtcgcgcggccgaaggcgagaagctcaccacgctcgacggcaaggaacacgacctgagcgtcgaggacctgctgatcaccgattcgcccgacggcaagcgtggctcgcgcattctcggcatcgccggcgtcatgggcggcctgtacggtgaggtcactgcggacaccaagaacatcctgctggaggccgcgcatttcgacagcgtctccatcgcacgttccgcacgacgccataagatcccctccgaggcgtcccgccggttcgagcgcggcgtcgacacgcagctgcagcccgcggccgcgcagatggcggccgaactgctcaccaagttcggcaacggcgagccgtccgggcacccgaccgacgtgaacacgacgatgtatcgccgtccgatccccttcaaggccaccgaggtcgcccgcgtcgccgggctcgacgtggacgtcaaccgcatcagcgacatcctcaccgatgtcggatgccgtgtcgctggcggcggcaacggcgagttctctgtgtccgctccgacctggcgccccgatctgaatgagccgtgcgacctggtcgaagaagtcgcccgactggtcggctacgacgagatccccgtcaccgtgcctccggccccggtcaagggcgcggtcgggctgacccccgaccagcgtcgccagcgctgggtcgcagacacgcttgccgaatacggcatggtcgagtcgctgagctacccgttcgtcggcgatgaggacttcaaggcgttctcctatgatccggcggtcatcaagccggtgagcgtcgagatcgccaacccgctggccggcgaccgcccgtacctgcgtcgtgatgtgctccccacgctcgccaccaccgtgcagcgcaacctgcgccgaggcctcgaagacatccgcctatacgagatcggccacgtgtacctgtgggatccgaacgcgcccgccatcccggctcttccgggaggcgtacgccccagcgatgagcagcttgccgcgctggatgcgggccttcccgatcagccgctgcacgtcgccggcctgctgaccggcaacgcggtcgactccggatggctcggcgatcgtcgcgccgtcgattggagcgacgccgtcgaggccgttcgccgtgtctgcgaccgtttgggtgcgcgttacgagctgcggcagcccgccgcgcaggatgtgcccgcgcagtggcaccccggccgcgctgcgcagatcgtcgcgggcgaacaggtcgtcggcatggtcggagagctgcacccgcgtgtcaacgaggcgctgggactgccggcgcactccgcggcgttcgagctgaaccttaccgcgctgttcggcacgcttgacggcaagcccgtgcaggcgaagcccatcgccacgttcccgcccgtcaagcaggacctcgccttcaccgtcgaccagtcggtgaccgcggcccagcttgaggccgtggtccgcgaggcggccggcgccaacctcgaatccatcgagctgttcgacgtgttcaccggcgagcaggtgggagagggcaagaagtcgctcgccttcgcggtgaccttccgctccccgtccaagacactgtccgcggaggacagtgaggccattcgcaaggccatcgtcgacaaggcggaagtcatcggcgcgcagctgcgcgcctgaccgccgacgaaaaggcaccatggaggacatgcatatgacagagccgcaacaacagccgcaatcgtctgacgatagttcgggcgagtcccggcatgttgcggcccagccgcaatatggtcagcgcatcgagcctgaatatggtgccagggcggatgagtttccgccgaattacaacccttacgtatatggaggccagcccgagcagccggctccgcaggcgcagccgtcgccgtctcagccggcctccgtgttcggagccgggccggctcccgctcagggtggttccgctcccaatgcggctccggctcagggtgggcccgaccaaggcggtccccgacgggagcctccccgatatttcaacggcatcgacctcaacgacccgcagcagaaccctatttacgggcattgggatttctacgccatattctcgttcatcttcgccctggtgtcctcgttcccggtgctgcccgcgctgatcggctgcctggccatctggcgcacccgtcgtttccatacgcggggccgcggactggccatcgcggccgtcgtcatcaacgtgctgaccaccatcatcgtcatatggatgacgatgcacggcatatcgatggacgacatgtaccaggccatgctcaacatgctggcgcccggcacgggcggaagcgggtcgggggactccgtttcggtgtgatgggccgtgtgctgcgacacgcaagccgatgaatgaatatatgcaatgtactgcataacatgtatactcgccgtagttcgtcttcgatgaaaagagcgtgatatggcgagatatacggtagctgtggctggcgccaccggatacgcgggtggggaggcgttgcgcatccttgccgcccacccggacttcgaggtgacctgcgtggcgggccattcctcggtggggcagaaactcggacggcatatgccgcatattccccagctggcggatctgacggtggaggacaccaccgccgaagtgctgaacggccatgacgtgatcatcctggcgctgccccacggcgcgtccggggcgttggccgcgcagcttgaccccggtgccgtggtcgtcgacctgggtgcggaccatcgtcttgaggagcgctccgcgtgggacgcgttctacggaggcgagttcttcgaccattggacgtacggcatgcccgagctgatcaccggcaagagcgcagacggagagtacacgcgtcagcgcgacctgctccccggcgccaagcgcattgccgggccgggctgcaacgtgactgcgacgacgctcgccatgcagccggccatcgccgaaggactcgtggaacgtcgtgacctcgtcgccgatctggtggtggggtattcgggcgcgggcaagaacctcaagcgcacgaacctgctcgccgccgaggcgttcggctccgccgtgccctacggcgtgggcggcacgcatcgccatatccccgagattctgcagaacttcgcccatgcggcaggtttggacgccgcccgggccgaggagttcacgctcggattcacgccgatactcgcgccgatggcgcgtggcatcctcgccacggtcagcgcgaagatgaccgacaaggcgctttccatgagcgacgaggaaatccacgacgtgtgggccaaggcatacgccggccaggagttcatcgtgctgctggagccgggcacgctcccggccacggcgaacgtcttcggatcgaacgccgcccacgtgcaggtggtcaccgaccggcacgccgggcgtctcatcgccttcgccgccatcgacaacctgaaccgcggcaccgcgggccaggccgtgcagtcgctgaacgtcgcacttggacttcccgaagacaagggacttacgaagattggagtagcaccgtgagtgtcacattcgccaaaggattcagcgccgcgggcgtcgcggcgggcatctcctccgtcgagggcaagaaggatctcgccctggtcgtcaatcaggggccgctcgacagcgcggccggcgtgttcacgttcaaccgattctgcgcggcaccggtgcagtggtcccgcaagacggtcgccgacggccatatcaaggcggtgatcctcaactccggtggagccaacgcatgcaccggccaggcgggatacgagcaatcggcggcgacggccaagaaggtcgcggagctcgtcgggacgcagcccgacgagatcgccgtatgctccacaggcctgatcggcgagctgctgccgctggatcatgtgctgtcgggagtggagagcgcgtacgcggccctgtcggacgacgaccaggcgggaagcgacgcgtcccacgccatcatgacgacggacacgaagccgaagaccgtatcgctggaaggcgacggatatcgcatcggcggcatggtcaagggatcgggcatgatcgccccccagctcgccacgatgctgtgcgtcatcaccacggacgccgccgtcggcgccggtcagctgcaggctgcgctgaacgccgcggtggaccattcgttcaaccgcatcgacgtggacgggtgcatgtccacgaacgacacggtgctgctgctcgcatccggcgcgtccggcgtcgagcccgatccggacgagttcaacgccctggtcgccaaggggtcggcggcaagtggcagctgaccgtcgatccgaccaagaccgacaaggtgggcggcgacgacaagtactaccgtctcggcgacgaggtggcggcggtcatctccggcaccctgcccacaggattgggccgcgtgcccgagatcgcgtggaccgacgacttcgccaacgtcgatagcatcctcgacctgaaggacacctccaacatcaaggtctacgagcaggacaccaccgacgaggccaacgccagcgtcaacgacctgaacaagaccggcagggacgtgaccgaccagttcgacatcaccgccgagggcaccaaggtcacggtcagcgcgaaggactcctacgaggccgcgcagaaggacctgaagaccgcgaagcagatcagcgtcgtgatccccttcgacgtgaacttcgacaccgtgaagctgctcgaatcctacggcaaggcggagggcgacgagctcaacacgtgcgcggacccgaagggcgacgacctcgacaacaagggcggccagacggtcggcggcagcacggtggacaccaacacgccgaagatctgcgtgaccgtgcccccgatccacaagcaggtcatcgccgaatcctcccagggcggcgaccagtccagcatcgacaccaagaccgtgttccccggccagaccgtggaatacaccgtgcgcgtggacccgcagatccccgcggaccaggcatattcggtgaccgccatcaagctgagcgacacctattccgagtacaccaccgcgaacaagcaaaccctggagatcaccgacctgggaaccggcggcatcatcccgaagagcgcctacaaggtgcagtgggacgaagccaaccactcgttcgaggccacgttcaccaaggactgggttgccgccaactggaaggccggctccaacccgcgcgtgctgctgcgcttcgaggccaaggtgaacgaggacgcgcccaccgacaagaccgtcgacaacaaggccgcgctgaccgtcaacaacggcgtcaccccgtccaacaaggtcgagaacgagccgccggtcatcaagccctccaagcaggacacgcagaaggacccgaccatcaacatcgacggcaagaccgcgctgctgggcgacaaggtgtactaccgcgtcaacatcgacgcctccaggctcaccgacaccgcctacaaggtatggcgactgggcatggtggacgactacgacgaggagtacctgaccctcgacgcgaagcacgtggagatccttgacgagaccggcagggaccgcaccggcgagttcaacatccaggacaaggacggcgtgctctacacgttcgccaggaccgttgacaccatgatccccgcgaccggcgagaccgttcccggcgacccgcagcccgacgacctgaaggcgtacagcgagaaaaccgacaaggattacgacccgctgaaggacccgagcatcgaccagtcgctgctgggccacacctaccaggtggtcatgccgatgaccgtcaccaaggtcaaggacggccacacggtggagaacaccgccacgcaggtcacgaacgacaggcgcgacaagaccaacaccgtcaccaacccgctgaaggagatcaacccgaccaaggacgtgaccgtgcaggtcggcggcgacagcatcgacggcaagagcgtgtatctgaaccacacgttcctctaccgcctggattccagcatcctgcccccggaccgcgcctaccagaccgtcacggactggggcggcacggaccagctgaacaccgagtacgaccagtacctgggcaactgggccgtctacgccagccgcgacctgtacagggacggccagatgctcgcggccaagggcgagaagatcgcgggcagcggcttcgactcctcgaagttcggcggcaacctgttcaccgtggacgccgacgagaacggcaaggtcacggccgacgcgacccagacctacctcgacctcgtgagcgccgacaacgagcacgaggccggctgggtgctctacctccagtgcaagcgcatcgccgtggccgacgaggtgcccaacacgtggaccgagaccatcaacggccagccgcgcgaatccaacaaggtcgtcaccaagaccccggacatgaccccgagcatccacctcgaaaaggtcgataccccgaccctcaagcaggaaggccaggagcaggcggaccgcgacgactccaagcaggcgctgaagatggacgccgacaacatcggcatcacgttcatcatcaccaacacctccaagaccgacccggccaccggtgacggcgcatggttcaaggcaagcgacctgaacctcgacgactccaccatcgtcggcgacgcgcacgtggacatggattcgctcacctatcccgccgactgggacaccctggtgctcaagccgggcgaatcggtcagcgtgaccggcacgctcaagggcgtcaaggaaggcgagacccacacggatcgcgccatcgtcaccggaaccccgctcgtggaatgcgcgccgtccaacggcgacccgttcaacgacaagaccgacggcggcgaagacaccgatccggaatactccaccggcgacgtgaccgagatcgacggcaagcagctgtgcgccgacacccagaccgccagcaacaccgacgactggaacggctaccgtgccaagccgttggcctccaccggcacggccgtgctcggccttgccggcggcgctctggcggtgctactcgcgggcggctccctgctcgtgttccgcaagcgccactacgcacagggttccggccgccacacggccgtgaacgcgggcaagtgaccccgtggcgttccggcctcgtcgtccgatgacggccgggacgccctccattgacttcacatgccggaaaggggcataaagctttccgaatcccgtgcccccggacggcgtgtgaaccccaggcccttcgccagcctctcccccggcgaagggccttttccatgcccggaacccgtgaacccgtggaaccgtggagccgcagacccgtggaaccgtgctcccgatggggcctgtagacggtgcgccccgcagcggcccgcgacccggcgcatcatcgactctgacattgttcgcaccatcatcattcctctggaggttgcacatggctgacaggcaaaccgcattggccgtattcgattttctcgactcgctgcgcgccggacaataccgcatcggcgcggacgcggaaaaggaccatgccacggcgggactgctggcgtcgctgtccggcgacacggggctgcgcgacgccgtgtgcgcgaagctgatatcgccgggcctggagcgcgcccgtttcctcatggtcgccgagcatgatccgcgcgccttgcccctgttcgcctcgggccaggtcaaaccgtggtaccaggccgactacaacgtgcgcgagatagccaacagcgagttccaccaggatatacccgcactgctgtggcggctgtccaacagcatcccggattccgcgcgaagggagggcatgcttgaggcggccgcgtacatgagcttcatgcagggcgatcccgaggccgcgttcaccggccatctgggccggctcgcggcggtttcgcccgagggcgaggtcacgcgctgcctcatggacgcgcacgagcacggccagcatcccgcatgggtcatggaacggcggcagctgcgcgaacggcaggccgacgccgccgacggcatggccgccaccgcgccggaccgcccgagcctccgccagcgcctcttcccgaaccgatgaacacctccagcacggacccatgggagatgggccccataatcgccgccggcaccgccgtcgccatcgacacggcacgagaaccggaaccggaacgccggccaccggccgaacccgaacccgagcccgggcccgggctggagccggatgcgcgatgcgtggacgacgccggaagcgaagaccgggcgaacacggccgtcgatccgtgggagatcggcccgctgccatcggcctcgaatccggtggggaatgatatcccggccgatgccccggcatcggaaccgcagcacgttgtcggtgccgtggagccggccgatctcgccgacacgatcgacctcacgccggtcggcgaccgggatgccgccatgcccgtgcgcgaatggaggcgcatagccacgaccgcgggcggcatcctgctcgcggcctgcgtcacggtcgccggcatgtccgcgtggagatcgcatgaatccgccacggccgcacgcgagctggaacaggcgacggcggactgcgccaccgcccacgctgcggcgaagaaagccgaacagaagctggtcgaatatctcgacggcgaccggctcgcacaggcgaaagcggtcacggccgacaagctcgccgacccggaaaccctggaaaccctcgacaagctggccgaacaatattccgagggcgagcgaatccccgcatgtgccgccacggacacggaaacggccaacgccaccacatccaagctgcaagccatcgaaaagaagcacacgggaaatctctcgcggctgaagaaggcggcgggcgcggtgttctcctcacggctggcccataccgtcgaacagggcgaacgattgtattcctcctccgaaggcaaggtgcaggacgaatattctcgcgccctgctgcgcgcctccatcgacaagcgcgacgagaaggccatcaccgacgccatggacaaggtgaacgcctccatcgacgcgaagaccaaggccgacgaggaaaggaaagcgcaggaggaggccgcagcggctgcggcggcgcaggaggaggccgcagcggctgcggcggcgcaggcgcagagcacgccggcaccgcaacagtactcgtacacgccctccggctccgcttcgggctcgggttccggcccgtccggcggcggataccattcctccggcggttccgccggctcgaccggtggttccgcgtctccgggctggtcggtgcccgcgaacccggacccctcgcaactgcccggcaccgacccgagcctatgaaaggaccaacaccatgccacaactgaccacgttgatcccgtcgttcgcggcacccgtcaccgaccgcgtgtggctggtgggcgcgcacggcggtgccggatgcaccacgatccgccattcggatccggaacgtttcgccgacgccggccgcgcgctgccggtgagccaggatccctccatgccctcgcgcatcatcctgtgcgccatgggcacggggcgcggcctcgaatcgttgcgcgcgctgctcgccgaccagtcggccggactgttcggcgcatcgatcctgttgggcgcggccatcaccgaccccgtgccccgtatgccccggcctttggtggcggcgcgcatccaactgtcatccgccgtccgcgtgtggcggctgccccatatcaaagggcttgaactcgacgggtttccccggcgttatccggccgcgtactcacggctcgtgaaggacgtagacgccatgccccgcgccacggcccatgtcggctgacgatggtgcatgaacctaacacgaaaggaacaacccaatgctgcatgaaacatacgcgatcctcgccgagaccctttccgacccgaccccgtgcctgcctccgggattctcgggcccggtatccaccgccctgggctgggtgaaggcgctgagcctggtgatcggcgtggtcgcgctggtgcgcatcggcgtgcacatcctgcgccagcagggcgacggcgtgccagaccgcgacgacaccttcgacaagctcgtcaactgggtgatcggcatcttcctcggtgcgggcgctgtcgccatcctcgccgcactcggcctgtccgtcaccgcaagctgctgagaaaaagccatgaaagggattcgacgcatacggcagcgcctgtgcgcgctgccgctcgccctcgcctgccttgccggcctcgccgcctgcggcggacccgacttcggatcgttcagcaaggagctcacgttcggcgacaagcagatcagcgacacccagaccacctacgtgatgaagatacccgaaggcaagctcggcgacctgatcggccccagccagatccaatgggtcatcgaccagtacggcgacccgcccgcccataccggcgcggtcgcggtcggcaccaagaaggcggcgaaggatctgctgaggaagtctccggaactgcaatgcagggcattggagaacacgtatcaggaggagtcgtccgacgagggcaaatgggagtacaaggactcctcgtgccggaagcagcgcaagctctcctggctggagaagaccctgtggaacatgtaccaggtccaatcggattccacgatcgaatggctgtccaccagccgcaacacgctggtcgccgcgaacgacacggtatcaacgttgcaggcgaacgccacgccgaactacgattcatggttcgcaccggtgaaccggtacctgcgcatcgcgcagggcgtgctcgtcgcagccgccgcgatcagcctgatcgtgctgagcgcgcgcatcgtgtggaacatcggccagggcggcgagggccgtctgctcgaccgcatcggctggatactgctcggcgtgctgctcggctcctcgtgcgcgagcatcgcgctcacgttcttctcccgctcgtccggcggcaatccggacctgccgtcatggacgccgggcggcggcaccacgttcttcctgtcggactacatccgtatgcaggttgacccgttccttatcatcgcggccgtgtgcggcgtgatcgcggccggctggaagctcgtcacccaacaggagggacgtgacctgatccccttgggcaaggcgttcatgtgggcgatcctgagcgccgtgtgccttgccggactggtcaacacgttccaggccacattcgacacgtggaccgccgacgtgctcaggtccgcaagcggcatgatgaacgacgcctgggaatcgaaaagcctggccgcgagctcgttcttcaatctcggcgcgcccgtcgccatcgtgctcaccatcgtgatgtggatctgcgggctgatcagcaagatattcgcctacttccgcgccgggatgctgccgatcctggtgggcgtggcacccatgtgggccgccatgagctggatggagaccggcaagcaggctttcgccaagaccatcggctggctggccgcgttcctggcctacaagcccgtcgccgcactggtcatggcgaccggctcggcgatcatggccacggccgggcccggcgacgacagccaggccatcacgctgatgctcaccctgagcgtcatcatcctccttcccgccatgatccgcgtgatcgtgcccgccgtgcaatcctcggtcggcggtggcggcggcggaatcctgccctccatactcggcatgggagtcgccgtggccggcggcggcctgcgcaaggccatgggcggcaagggcggcaggaaaggcggcggcgacggacgcggcgaagcgtcaccggacggtgccaaacccggtgccggccgaggtttggccggactgctttccggactcggccggggcgacggcaaaccacagggaacgaacggcggcggcaagcacgccaaaccgctggaaggcaatcccacgggcggcgaaccacagaacaccggcgaccagccacagggagcgaaccgcaagggcagcgacggcaaaccgcagggaacgaacggcaatggcacgggaagcccggttccaccggcacccgatggcgcgccacccgacccgtcaggcggcaacaggccgcagggaacgaacgatgccggcgggttcgcccgcgagggcgcaccggacggtgccgaccgctcgaccactcgcaagggcaagacattctgacgcattaaggagattcggataatcatggcgtcgaacacgacatacggggattggatgcggccgatgccgggaggcatccgcaacatcggcataccgttgacgatagcgggcatgggcgtattgacctgcacgctgctggtcagcatggcgagcgtggtcgcggccatcgcgatcctcgtggtcggcatgggcgtcatcctcgtgctggccatccgcgaccgcgagcaccgcaacatggtggatcgcaccgtggagaaacgcacgtggatggccgcgcagcgtaccggcgctaacctgtatcgttccggcctgctcgcgccgatcgacggcggcaaggccatgctgccgggcatcctctcacgggtgggcctgacctccgccctggacgggctgggcggcgagttctgcctagtgcggcattcgcacaccggcgaatactcgctgctcctgtcatgccagccgcagggcgcgagcctcgccgacgacgacgtggaggactcgtacgtggcctcgtgggccgggctcatggaatcgctcgcctccgagaccggcgtcacccaactggccgtgaccgtggacacggcacccgattccggcgtgcgtttccgccgcacgctgagcaaacgcatcgtggaggacgctcccgagctcgcggcgcgcgccatggcgcagatcatggaccagtacgcagccggcggcgcttccaacgacgtgacgctcaccttgactttccgctacaccgaccgtgacggcaaatacctggaggccggggaggccgcgcgtcgcataagcctgctgctgccctcgatccgcgagcagatagcgcaggcgggaggcggtgccgcgagggccctgggcatggaggagatcactcgcatggtccgcgtcgcctacgatccggccgcgcaggagaccatcgaggaatccgacgagcccccgtacatcgcatgggaggattgcgggccgctcatgcacgaggccggctggagccattattcgcacgattccgggctgagccgcacatgggagatggtggacccgccgcaaagcaacgtgaccgccgacacgctcacccgactgctcagcccattggcggactgcgaccgcaagcgcgtcaccgtgctctaccggatgctgccgcccgacaagaccatgttcatggccgaacagaaccggcagaaggcagccaaccaggtcagccaggagaaacgcgccacggtgaggtccatgagccagataggcaaggccaaccgccaggccgtcgaaacgaaccagggtgcggtcatggtgttcttcgggatgctcgtcaccgtcaccgtgtccaggggcgaacaggaaagccaacgactcgaagccgcgtcacgcgccgtggaacaggccgcaggcggcgcgaagatcgacctgcgcccctgctacggggcacaggacacgggattcgccgcaagcctgccccttggattgaacgtcagatcatacactccagccggccccctcggccggctcctgtcctgaacggaggacacatgatgccgatgccatggaagccgtcgaaacggaagggaaccatgccaagcgccacggccacggaccccgtggcacgcatggaatccatgctgctcggtccgttgaaggccaaaccggacgagcccgtgcccccgatgccgtggcgggggaaacgctcgcgtggaggcggctatgcggccctgatgcccacgatagacgagttcttcggcacgtcgaaccaggtgtgcggcgggttctggccgttcggcaccgacatggccctgccggccgagggggtgccggtcgggcgaagcctgatgacgggtgccggcgtgtgctgcgacccgatcagctggttcaaggccggcatcatcaaacagccctctatgttcctgctcggcctgccggccatcggcaagagcacgttcgtgcgccgcgaggtgctgggactgagcgccctgggcatgaacgcgatcatccccggcgatctgaagcccgactacgcctcactggtcaacatgctcggcggccaggtcatccggctgggagcgggcatcggcgtggtcaaccccctggaccccggcgacctccattatgcgctgcaacgcttggagggcaaggcgcgcaaggacctgacggactactacaacgacacgagggcggcgctcatggaggtgcttttgacgatcatgcgcaccggccgcgaggccgacgacgtgggcggtgccaggggcgtgaccgcacgcgaatccgatatcctttccgtggccgtgcgcgtgctccacgaccggcacggcgacgacccgcagcctcccgtcatcgcggacctgcgagacctgctgcgcgaagggcccgacgaggtgcgtatggcggcggtctgggacgacccggaaaacgacgagctctacagggcgcaggttcgcggccttctggccgacctgcacggattctcgaaccgcatgacgaagttcggccgtctgttcggcgaccagaccaccgcgcgcatcgacctgtccaggcccgtggacttcgatatcagcgccctggcccagtcgggcgacgatgtggtcgccgccgtgctggcgaccacatggacgagcgcgttcgccgcgaagaacgccgccgacgtgctcgccgaggagggattacagccccggcgcaaccacgtgatcatcatggacgagatgcaccgcgctttgcgcgccagtcccctcatggtcgaaaagctcgacctgctcacccgtctgaacaggcagtggggcgtaggccagatcatgatcacacacacgttcaaggacctgatgtgcatggagaccccggcgcagaacaccaaggcgcgcggcttcgtggaacgcagcgagatcaaggtgctgggcgctttgagccgcatcgaggtggaccgctacctgcgcggcgaatgcggactgcccgtatcccggcgcgaggaggacatgctggaggattgggccacgcccgtcaacttcggctccgacgcctcgcacaagggtctgggccgtttcctgatcaaactgggaggactgcccggaatccccatcaacgtggagatgtgcccgctcgaaaaaagcgggttcaacgatacgaacctcaaatggcacgcctagaagggaaccctgcgatgacagaccacctcgccaccggcatgaaacgcatgatccgcaccgtggcacgctccgcatccctctccgaccggctcggcgagcaatcccggctgctgcggctgacgggcaaccgcagcactctcgacttccgccccgccgagcacggcgcatcctcatgggacttcgaaatgtcgataacccccaccgagcccaagccgtacggcaatgcggaaacccgtgaacccgtatggcgtgagacggtcgattccgccacctatggcgaatcgagggcgcgggtcgcacacgccgtcgaaacgttcagaatatacgacaacaccggcatcctgccggaaacggaaaaccggtgaaaggaccacgatgaacgacgccgcactgctcgactcgctgcacgccgcgctgcgcaatcccgacctcgcatggtacacggaattccatgccggcgaatccatcgtcgccggctacctcgattccctgacggacccgtatgacgacgatgccatacaggttcccgagggctggttccgctactcggtcgtcacccgtgaaggcgaccacgcccttccatggatggagcactggaacgaatacgagtattcgatcacccatcacatcgattggaacggcaaagggttcacgccatacgacctgtactgcacacaggacctcaccggcatgatcgccgacggctcgctggcctcgatccgggaggacgcgcgaaccatattcaaggaccggcccctgacggacgactaccttttcgccaactccatctggcccgaaccggaactcctcggcctcgtggacgacctgaccggccgcacgggacgaaacctgtaagaaccctgtagacgccatgccccaccccgccatggccttggactgatgatcggggtcatggcgggaacagcgggttgccgccgaggattgtcaaggagccgaacatgcctttggagaacaccgatgccgaagagcggatcacacgggaaacgatgatcggatggatcgagcattggggcgaatcgtatgacgacgtgcgacccgatgacggtgccatgcggctggcgaaccgcatcatcgaatacaacgcggcgactgaaaccatcgaggcgttgcggaaccccgatgccgtgtacgacgaactggcatccatcctccagccggtgctctcctcgatggacggcacctatttcgcgggctccgaatggttcgccggcgaagtggaccgcatggaagcggaccgcatcaacggggagcagccggaagaaacggacggcctggcctccgaagaaccccgcatcccgttcatcgtggagagcgaggccacagccgccgatacggacgaaccgccgttggacgagctgatcaccgcagccacacacgaatatctggactcaggcatgacctacgacggattctcggaacatgtgcgcaccacctggcgcaacgccgccgcctacgactggtcgaataccgcggcgaggcgatccgcaacctcacgatggacgaacgcatgaccgtgtgcaacatgtccatcgaggcgggcgcccgcgccggcatgatcgcgccggacgagaccacgttcgaatacctcaagggccgtccgcacgcgcccgaaggcgagctgtgggatcaggccgtcgcctactggaagacgctcaagaccgatgacgacgccgtgttcgacaaggtcgtggacatcgacgcgaccaagctcggccccttcgtgacgtggggaaccaaccccggccagggcctgccaatcaccgcgaacgtgccggagcccgacaagatcgccgacgccaccaagcgcgccgccgccgagcgggcgctgacctacatgggactcaagcccggcatgccgatcaaggacatcgccgtggacaccgtgtttatcggctcgtgcaccaacggccgtatcgacgacctgcgccaggccgcctcgatcatgaagggacaccacaaggccgagaacatccaccgcgtgctcgtcgtgcccgcgtcctcgcgcgtgcgcctgcaagcggagaaggaaggactcgacaaggtgttcgaggacttcggcgccgaatggcgcaacgccggctgctcgatgtgcctgggcatgaacccggacaagctggtgccgggtgagcgctccatctccacatcgaaccgcaacttcgaaggacgccagggcaagggctcgcgcacgcatctcgcgtcgcccgccgttgccgccgcgaccgccattcgcggcacgatctcgtcgcccgccgacctgtaaatactgcacactggctcccgctggcagcagctgtcagtcgaagactgactgagggtggggcggagtgtcgcgcactggcgccacccccccccagtcagcaaagccgacagcccccgccagcgggggcaagaattgaaagcctgatatccatggaaaaactcaccacattgaccggcgtgggcgtgccgctgcgccgctccaacgtcgacaccgaccagatcatccccgcggtgttcctgaagcgcgtgaccaagtccggtttcgatgacgcgctgttctacgcctggcgccgcgacccgaatttcgtgctgaaccagccggaatatgccggcaaggggcagattctcgtggccggccccgaattcggcatcggctcatcgcgcgagcacgcggtgtgggcgctgcacgattacggtttccgcgtggtgatcgcgccgagcttcgccgacattttctacggcaacaccgccaagaacggcgtgctggcggccatcatgccgcaggagtccgtcgaactcctgtggaagctgctggacgaggagcccggtcgtcagatgaccgtagaccttgagcagcgcaccgtcacctgcggcgacgtgacgttgccgttcgaggtcggcgattacgtgcgctggcgcctgatgaacggctacgacgacatcgacctgacgttgcagcatgaggacgacatcgccgcctacgagaagatgcgcgccgagaagttcccgttcaagcccaagaccatccccgccaagcattgggccgaggaacccatccagtccgcccgcgagcccgaagagagcgactgggcgggcccgctgagcgaccgcggcatcatctgaccgatcgggccagcctcagccagcgatgcctttgcgccggtgttggttgagcggagtgaaacctgttaatgtcgtatccgtatatcgaccgggatgttggccggtcatgatggcatgcacgggcgtgattgtcgcccgctgcaacggaaggggcattgatggattggcatgcgtccgtgtatggttcccgctccggcggcggccagtaccgcgacttctccgacggtgatgccgacgatgacggcgtcacgtacggcgctcgcggctcgtacgccgacatggcagacgacactgccggtgccgcggtgctgccgccctccgtcgacgacgccgaactgcgccggctcggcggcaacgccgtgtattttcgtgcgaaggacgtgctgaaatccgggcgtatgcacgacatggccgtatcgttcaacgtgccggattcgccacgtacctcgggcaccatgctgacgggtgcgcgggccaacgtacgcctgacagcgctggtcaaaggcgccgaccggtacgcggacgattaccgcgtctccgccgcgatcgacaccgacgcgggcaaggtcggccagtcatcgtgcacatgccccgcatacggccggttccggggcgtgtgcaagcatgtcatcgcgctggtcatggcgtacaacgaacatccggatgacttcgccgcggccgacgatggtaacggctccacgaacggtatcggtcgcggagccgcaggcttggttccctggcaacctgccgtgcgcacgacccgcgcgcttgacctgttcatgcggcagcaggacgacgagcgcacccgcagatcgcagagccggcagctcgacctgttgaaggaaatcggcggactggctgattccggaggtgtcgccggcgcagcccagacggcgcggttcatgcccatcgccagcgtgtcgctgcggctctccttgagtttctcgctgaacagctgcgtggcgaaattccgcatcgaagtgccgtcgcgcggcatctcctatgtggtcaaggacatcgcctcgctgctgcaatccgtgaaaaaccgcgagttcgtcgcatacggcaagaagctcgcgttcgtgcactcgcgcgacgcctttgacgagcgctcgcggaacctgctcgacgtgctctcccgcgcgcaggacatccgcgccgtcatcaacaacgacaacagcgcatactcctactattaccggcgtcagtcggatgacgcgacgctgacgttgtcggacggtgaggtcgccgaactgctcgatacgtacgtcggcaccgaagacacggtggaatacacggctccggcacggttctacgcgccgacgatgcgcgtatcagtcgtggacggcaatcccgatctcggccttgcggtggaacgcggcgacgatcccgaggcctcgaacggcagtacggcggcggccggttacgtgatacggcatgcgcagcgcgtggaacgattcattgaaggacagcgctcgcattacgtgatcgcgcggccgttttcccaagccgaatcgggcgcgggcgtggggtcgggcggtcgggcgctgctgagcgtcgatcgtgcgacgatataccggtgcgatgccgattttgcgcagaaacgggcactgctgagcctgctgtgcggcgaaaacgatcgcgaggcgatgtatctgagcgaaagtgatgtggatcgtttcgtgcgcacggtactgccgcaactggtctcccgccaggagaacgaggtcgggcggtcggtcgacgccattggcgcatccgccggtccgaacgcggaggacggttccgccgcgtcatcggtctttgaccggctcgtgccgccagctgggcgtgaaaccggagttccggcgcacggcggcttgatcatcgacgtgccgcccgagctgctggcgaaaatgcgcgtgccctgcaggctcgcgttttacctcgaccgcgaccgcgccggggtgacatgcgacgcgcaggctcattatggcgacaagcattaccacgtgttcgacggtgtcggcgtcgacgcgtccatgcgcgacaaggagatggagcgactcgcagtcgaggcgatgctccactatttcccgcgcccgtccggtgccgtggccgccatccccgagtccgacgacgaggcgatataccgtctgctgaccgaaggattggcggtgttgcgcggtttgggcgacgtgatggcgacgcccgcgttcgacggactgaccgccatgccgcgcccgacgatctccataggcctttcggtgaaatccgggctcgtggagatatcgccgatcgccgacgaaatcgacccggacgacgtgccgggcctgctggcgagctaccgtcggcgccgcagattccaccgactgcgcaacggctccttcgtcgacatgcgcaacgtggatatgtccgacgtcgatgagatcgcggatgacctgggactgcgggccgccgatctggaatccggctcgatcacggtgcccgcctatgaggcgtactatctggaccatcaggtcgacgacgacgcgaaggacgcaagcttcaccgcatacctggacggcctgcgcgtgatcgatccgtccacgtaccgcgttcccgctgcgctggcctccgtgctgaggccgtatcaggtcgaggggttccgctggctcaatgccgtgtgtgacaagggattcgggggtatcctcgccgacgagatgggtttgggcaagagcgtgcagctgctgtcgctgctgcttgcgcggcataaggagtcccgggccgagcaccgtccgaatctgattgtctgcccggcctcgctggtgtacaactgggtagccgaggtggcgaagcacactcccgagctgcgcgtggaggccatcgccggcaccaaaccggaacgtcgcgcgatgcttgacggcgtgcgcgccgcacagcaggacaccggtgtgtctccgacgcgggaatccgcaaggccggcatcggccgcggccgcgtccgacgacgttcccgacgtgctcgtcacctcgtatgacctgctgcggcgcgacatcgacgactatgcgggacttgagttctactgcatgacgctcgatgaggcacagtacatcaagaacgccgctaccaaggtgtcgaaagccgtgcgctccgtcaccgcagtgcatcgtttcgccctgaccggcactccgatcgagaatcggctgagcgagctgtggagcatcttcgatttcctgatgcccggcatgctcggctcgtacgcgcatttccgcgaacggttcgagatgccggtgctgagcggcgacgagaccgcacagaagaaactgcaatcgttcgtggggccgttcattctgcgccgtcttaagtcgcaggtgctcaaggatctgcccgacaagatcgagaacgtcatcacagtgcagctgcagggggagcagcgcaagctgtatgcggcactggagcagcagctgcgctcggtcatcctgagccagcgtccggccgatttcaacaccggcaaaatccagattctggcgcagctgacccgactgcggcaagtatgctgcgacccgcggctgatatacgagaacgccgacgggcatgccagtgccttgagcgcaggggtgcaatccgccgcgaaagacccacagcagtccgtgaaacagcctgtgaaacagtcgaaggcgcgcaagaccgtaagctccgcgaaactggacgccatcatcgaactggtggactcctgccgtgatgccggccgcaagatgctgatcttctcgcagttcaccagctacctcgacctgatcgcgcaacggttgcgggccgacggcgtggaatacgacatgatcaccggagcgacgccgaagaaacgccgtctggagctggtggaccggttcaacgccgacgcgacgccggtgttcctgatctcgctcaaggcgggaaacacgggcctgaacctgaccggcgcatgcgtggtcgtgcacgccgatccgtggtggaacgcggccgcgcaggatcaggccaccgatcgcgcccaccgcataggccagacacaggacgtcaacgtgtatcagatcgtggcgaaggacacgatcgaggagcgcatcctcaacctccagcgcagcaagacagacctcgcgcaacggttcgtggattccgcgtcctccgccaccggacggtcgatggccgcgctcaccaaggacgacctgctcgccctgctgggctgaaggtttttccccacgcaacagtcaattcgtcgcgataccatcggtgcttggatgttcgtaaaggaaaggacgtgatgagcgtgcgtaagaagctgatgagcgtggtcgccgcggtggcgacggccgctgccatgggcgcgaccggtgtcgctgccaatgccgctgatgttgttgccgtgccgcaggaggggctgtccgacacgggtgcgtcgatcgccatcgtcgtggtgcttgtcgtggtgctggccgcgattggcgtgggcgtcaccgtggcccggaagcgtcagagcgctacgggcgcacacgtgcagggcgagggcgagggcgccgacgagagcggactggtggccgatggtgctgatacggctgatacgcagaccgtgcagttcgatgatgccgctccggccgcggatgactctgacgccggttcgggggaatcccgcgactccgagtgattccggaataaccgcaatgtgcaaaaggccctcttcggagggccttttgcgttgacatggtgttttgccggtgtcccccccccagtcggccttacggccggtggtgccgtccgtaggcgaaggcgagccggccggcgagcgaataaggtcgcgcccgcaggacgggcgtccttgactgcagggcccgaagggctgtcgcgaagcgactgggggtggtcccacatcgtgagtgtgattcgaggtctacgatccgacgctatctgcatttcgaggggttgattcgacggtcgcgaaacatctatctacgtttcgagggggtgccgaaacgcgatacctggagtattgagcgctaatcgccattggaaccatgccgttctggaggcgttcatacttggctaccaaccccctgaaacgcagatagatgtcccatgggactcgaatcaaccccttgaaagcgagatatcgccaatcaaggcttcaaaatgtcgcccacaggcatatcgggcccacatgagatgtcgacactgacgttgatgggcgatacacggcgtactgttgaaccatgagcatgaacgatcggcaacaggaccatgggcaacctgatgatgagatggaaccggaaggccagcggcagccggctgctggagacggaaaccccgaaaaactccagatgcctgctggtgacgccccgcagcaagttgagcagccgatgcaatggacggccggcgaaacgccgcagcctttgccgtatttacggcctgtgaatccgccgcaatccgtgaaccggcctcagccggtcggccgctcgcagccgccggtggcgggacaatgggcaccggcttctgagccacgtccaatgcctccgattccgtcaggaacaggtcagccggggatgcgccagccgatccagtcgtatccgccatatccgtcacagctgtaccctccataccctccgtatcctccatattcctcggcgcaacgacccgtcgcgccgcccatccctgtcgcccagcccgtcccgatcgacccggtcaaggcccgccgccgctggctgcgaggcaccgtcacccgccacgcgggcctgatattcgcctaccagggcgtgttcatgggcgtgaacgtactggcctcgttcgtcatcggcatcatactgggcctgagcggagccgcggggcgaggaacgctgacggccgagtcgctcagcgccgccctcgtgcagctgaccggcgtgatcatgctgctcacggtgctcggcggcatgggcttcatactgccgatgcgccgcaggatgatattccgtcgcgacttctggctcggcgagcccggccatgcgcgtatgaaaccatcgtggctgctgacgttcatcatcctggtcatggcgatccagacggcgatcgtcctgatccagctcggcttctcgatgttcggcactacgttgcaatcgcccacatccgacaacatcagcgaggcctcgaccaacatttggatgtggctgtatgtcggccttgccgcgccggtcgccgaggagctggtgttccgtggcgtgctgatgcgcggcctgaagccgctcggccggaatttcgccatcgtgaccagcgcgctgatgttcggcctgttccatgacgatgtggtgcagggcctgttcgcgttcggctgcggtttgctgttcgggttcgtggcgatggagtattcgctggtgtggtcgattgtgctgcacgtgttcaacaacgccgtgctcggaggcgtgctgccgtggctggcgggcctgttcggcgacgcgggggacacggcgtatacgctgggacttttgggtgtttcgatcatcggcctgatcgtcgtgctggtgaaatacggcgggggattgcgcgcctatcggcgggtgaaccgcagtgcgccgggaacgtattgggggtggacgtcgcctgcgttcctaattttcgtgatcgtgaatgtggcgatcacgatactgtcgttcgtcaccgcgatgatgggcgtctgaccagcctggcagacggcctggcgaatgctcccggtgttgcgggtctgccgctgtttttacagtggatatatcgtcgtgtttgtggcgccggcagcggtccggcgtcggttgagtgtctggagagccatgagtgatttcgagccgttttacaacgttgacttaagttatgaggataattatgcgcgcggcccgttcggcgagttcgccgcggcgctgcgcggtgatgtgccggccggcgaggccgcttcgccggcgaagtcgtcgttctttggcatccccgttgacctgccgttcggcattccggccgggccgctgctcaacgagcggttcaccacggccgcgttccgcatggggttcgacatcgccacgtacaagaccgtgcgctcgcgcgcgtgggggtgcaatccgttcccgaacgtgttggccgtgcacccgaccagtgccgacggctcactgacgccgggcagcgccgaactggatgagggcgtgcttgcggacacggactatcgcctgccgatttccatttcgaattcgttcggtgtgccgtcccgcgacccggatgagtggcagccggacatgcgccgggccatcgcggcggccggcccggggcaggtgctgctaccgagcttccagggatcgcgtgtggagggcatgagcggcgacgactatatcgcggatcatgtcgcaaccgcacgattggtgtgcgagaccggcgccgacctcatggagatgaacacgagctgcccgaacgagggtcataatcgcctgctgtgccatgacccgcatctggtcggccgcatcaccgaggccgtcaagggcgaaatcggcgaccggcctctgatcgtcaagctggcgtatatcccgccgaccgaggtcgagggtggctgggggccggatcgccgcgtgattgacgatgccgctctggagcttatggtgcgccagaccgccgcccgcggcacggtgcaggcgttcagcacgatcaatacgatttcggcccggctcgtcgacgcgaacggcgggcaggcgctgcccggcaaggggcgcgaccgcagcggtgtgtgcggcagcgcgattcgcggggcaggccttgacatggtgtcgcgtcttgcggcgattcgcgagcggctggggcttgactatgcgatcatcggcgtgggcggtgtcgtggcgccagaggattaccgggcgtaccgcgcggccggcgccgatgcggtgatgagcgctaccggcgcgatgtgggatgccgagctggcccgcaagatcaaggcggatgactgatccgctgtatcagcgaatcgttctcaatagcgtttgtgcgagtactcctcacatttgcgaacaaaacgaacatcggcttactcgttggaatatcggccatatgcatacaatcatgttcgttttgccgacgacgggactcgcacgtttcttattgagaaccattcgctgcgacatggtaatcggcttccggcgcatttcacgtgcccgccacatgccgtatggcaaactaatggatgtgatgtccggggtggcccggcgaatgaataggagtgttgaggatggcggaatcggagaacgatgtcctgcatgtggtcggcggcaaaccgctgaacggcacgatcaaggtgcgtggcgcgaagaacttcgtgagcaaggcgatggtcgcggcgctgctcgcccccggcaaatcggtgctgaagaacgtgcccgagattcgcgatgtgcatgtggtgtccgatctgctgcgcctgcatggcgtggatgtggaggtggatggcaccaacggcatcgtcaacatcgacgcgacgcatgtgcagctcgccgatgtggcggatgtcgacacgctgtccggctcttcgcgcattccgatcctgttctccggcccgctggtgcatcgtctcggcgaggcgttcatcccggcgctgggaggttgcgcgatcggcggccgtccgattgatttccatctggaaacgctgcgcaagctgggtgccacggtcgacaaggagcacaaggacggcattcacatcaccgctccgaacggcctgcacggcgcgaagatccatctgccgtacccgtccgtgggcgcgaccgagcagacgctgctggccgccgtgctcgccgaaggcaagaccgagctgtcgggtgccgcaatcgagcccgagatcatggatctggtggccgtgctgcagaagatgggcgcgatcatttcggtggatgtggatcgcacgttccgcatcgagggcgtcaaggagctcaatggcttcacgcacacgtcgctgaccgaccgcatcgaggccgccagctgggcgtcggcggcgctcgccacgcgcggcgacattttcgtcaagggtgctacgcagccggagatgatgacgttcctcaacgtgttccgcaaggtcggcggcaagttcgaggtgaccgacaggggcatccgtttctggcatccgggcggcgacctcaagcccgtggccatcgagacggatgtgcaccccggtttcatgaccgactggcagcagccgctggtcgtggcgctcacccaggcgaatggcctgtcgattgtgcacgagaccgtgtatgagaaccgattcggcttcaccaagccgcttgtgcagatgggtgcgacgattcagctgtatcgcgagtgcctcggctcgctgccgtgccgtttccagcagcgcaactacaagcattccgctgtgattttcggaccgaccccgttgaccggccgcgatatcgacgtgccggatctgcgtggcggtttcagccatctgattgcggcgcttgccgcgtccggcccgtccaatgtgcatggcatttcgctgattgaccgcggctacgcggatttccgcggcaagctcgccgcgctcggtgccgatttcgagtaacggtacagagagcctgtagggccccgatttccgctgaaggaatcggggccttctctgtgactgattatggtcgatgaaaaggatgcaccgccgtcgtcagtcgtcgaagtgcgcgaacagcgacgcggacagcaacgccatagcgatgagcactgcgcctgacgcgatgaatatcgcggcggcggggagatgatcgaacgcccagccgtacgccatctgcccgagcggctgcatgcacatggccagcgcagacagcagcgccatcactttaccgagcatcgcatcgggcgtgcgcatttggattgcgggcacggcgatgatattcgcgcatgagcagatgacatcgccgatgcaggcgaaggccacgagcgccatcagccgcgtccagttgccgccagacagcatgcaggccacgccttgggggatgacggtcagtccgagcaatgtcaggatcttcgtcatatggccaattttcagccgtccggccatcatcgtcacgatgagcatgcccatcagggccgcgacgctgatcagtccgtcggcaatgccgtagacggtcgcgtcgaacccccattgcgtgcggatgacgaacgcgtatccgacggcgccatagccgagtacgacgaagttcagcgctgaggcgagcaggaccattttcagcaggttcggtttttcccgggtcaggaaccgcagagcggccttgagatcgtcgagtggcgtcggcatcttctcgtcgcgttcgggcataccaagccggatgaagcattcgatggccgccgcgccggcgaatgccgccacggagacggccatcatcggccggatgccgaagaacgagtacgcggcgcctccgaggaagctgggtatcagtgcgctgacctgctgcacctgactgactatcgcggcgctggtgttcagcgtcgcatccccgtattggcgcagcatctgcggcagcgcggattcgacggtcggcgtctcgaagataccgagcagcgatagcgccacctgcattacgcccacggcgatgatgctgaatccggcggcggagaaccagacgagcgcgagcgcgaccgtcacggcggatgccgcgtcgaggatgaccatgagcgtgcggcggttcatccggtcggccaacacgccgccgaacggggcgccgaggatcatcggcacgaacgatatggcgaggatggatgcgaatgcggtggctgagccggtctcgtccagcacccacatcgacatggcgaagcgcagcatcatgttgccgaacagcgagatgccttgcccggcgacgagcaggatgaaattgcgggagcgcagcggatgatcggcagaatcaggtacgcgagtagatgaagctggacgacacggtctcgtagccaccccagacgaatcagcggcgagaacgagcggctggatgaccagccgaagaacaccagggagcccacaccgacgaccaggctcacgacggtgatgatgacgggacgtgtcgccgaagagccgttgaccgcagcgctgaccgcgacgcccatctggttgagcgccaagatcatgccgctcagggcgagcactatcgccacgaactgcactgggttgagccgcgcgtcctcggtggggcgtttctgctcgatgcagtgcagtccgagcggcagggagaccaacagcacgatcggaatggcgatgacgaagatggcacgccacggcaaaacactcgacactgcgccgccgacggtggggccgatggccggggcgaccgtgatcaccagcgaacctacgcccatgaggcggccgaccttgctgcggggcgactgttcgaggatgatgttcatcatcagcggcgtcgccacgcccgagccgatgccttggatcacgcgggcgagcaggatgaccgggaaggtgtggccgacgatcatgatcgccgaaccggtcacggcgaggaccacagccgcgatgaacagggacttcagccggaagcggcggttcaggaacgacgacagtggcatcgtggccgcgaccaccagcagatacacggtggtgatccattgcacggtggcggtgttcacgccgaattcggtcatgagttccgggaacagcacggtcatcaccgtttcggtgaggatgccgatgaatgccagcgagcccacggcgacgatggcgccgatcagacgcttggggatgcgctcctgcgaggttgaggtcatgtgatgaaatccattcagaccgacgccagttgtttccggactgcccttacgatacccacactgcgtcaggccacattacagtgtaacggattgccggacgagggcggagtggcagttgcgatgaactactcccagcctcgctaccgctcggccgccccgccgggcggggcgatttatccgttctgctctttggactcggtatagccgtccggcgcggtttcactgtgcaggatggagcgaactttgtccaagcgctggctgacctcgtgctcgtatccgcggtcgttgggatgatagtactcgcggccgcgcagctcctcgggcaggtattcctgcggcgcgacggcacccggccagtcgtgcgcgtaccgatagccgtcatggttgccccagcttttcatcaacgcggtcggcgcgttgcgcaggtatagcggcacctggccgatgagcccggcgtccacgtcggcgagcgcctggttgatggcgttgtagctggcgttcgatttgggtgcggtggcgacggcgatggtcgcctcggcgaggatgatgcgcgcttcgggcatgccgatcatcgcgacggcctgtgcggcggcgacggtgacctgcagtatctgcggcgcggccatgccgacctcctcgctggcggcgatcatgatgcgacgggcgatgaaccgcggatcctcgcccgctcgcagcatgcgtgcgaggtagtgtatcgcggcatccgggtcggagccgcgcatcgatttgatgaatgcggagatgacgtcgtaatggtcgtcgccgtccttgtcgtagcgcacggtggcggcgtccatgacctgcgagaccacatccggcgtgatggtcggacgccgcgcgccttttttgcgagccttgtctccggtgacggcacctgcagcggcttcgaggatcgtcagcgtcttgcgggcgtcaccgccggccatgcggatgatctcgttgaccgccgcatcgtcgattttgacttcgccgttcaatccgcgcttgtcttccaccgcgcgtgcgatgagcgtggcgagatcggacggttccaacgattcgagtttgacgacgacggaacgtgacagcaatggtttgatgacggagaagctcggattctcggtggtcgcgccgatgaaggtgacgtcacggttctcgacggcgggcagcagcgcgtcctgctgcgatttggaaaaacgatgcacctcgtcgatgaacaggactgtctccgtgccgtcgccgacgagtctgcgccgcgcgcgggcgagcacgtcgcgcacgtccttcacccccgatgtcaccgccgacagctcctcgaacgcgcgccccgactgacgggcgacgatggtcgccagcgtggtcttgcccacgccgggaggtccgaacatgatgacggagctcggcgcggtcagcgaccccttggacgagggattcgccagacgccgcaatggggagcccttccccagcacatgggactgccccaacacctcgtcgaccgtccgaggccgcatgcgcacggccaacggtcgcgtcatatcgtcgggcacatccgccgccccgaacagatcattctcagtcatgcctacactctacaacacggtatcgaacataggttcgataccggacggaccacccccagtcgcttcgcgccagcccccgctggcgggggccgacggcgtcagtcgttggtgacggcgtagtcgaagaagacgacttcgccgctggattgcgtcgcgtccaggtcgatggtaccggtgatggcccagtcgtggtcaccgtcggagtcgtcgatgatctggcgcacgtgccagctgtgctcatcgttctcgtgcttctcgtcgagcatgaacagctcggccgaacgcgccttggcgtcggtgttcacgtactcgtgttcgtcgtagaagtcgtcgagcgcgtcctcccactcatgcacgccgtagccccactccttgtcgagagcgccgagcgcctcgggcttgtcaaggtccatgagctgcacgcggtggaacagcgcgttgcggatcagcacggtgagcccgcgccggtcctccaccaccgcggccttcgcgcccggcgcggccagactggcggccgcctgcgaggcatcatcggacgcgccggcgttctcccattcgtccaccagactggagtcgatcgaacgcacgaccacgcgcagccatgagatcacgtcgcgcagctgatcgtcgagcttgtcgtccggtacggtgcgggcgagcgcccggtaggcgtcggacaggtagcgcaacagcgtgccctccgagcgggcgatgttgtaccgcgagatgtatccggtgaagtcggaggcggtctcgaccatgtcgcgtaccacggatttggggctcagccagtagtcgttcgcccacggcacgtcgtgccggtactgatcgaacgccgcgtcaagcatgtcctccagcggcttgggataggtgatctcctgcagcctgtccatgcgctcgtcgtattcgagcccgtcttccttcatccggatcatcgcggcgtcgcgcgcctgccgctcctgcgcgcgcagcacctgcttggggtcttcgagtgtggcctcgaccatggaaatcacgtcaagcgcgtacatgtcggattcagggtcgagcagttccagcgcggcgagcaggaacgggctgagcggctggtcgagcgcgaaatcgtcgggcatgtccacgtcgaggaagtagtcgagcccaccgtcgtcgcgctcttcggtctcgatcaccttcgtgtcgaacagggtctggaatatctcgtcggcacgttcatgcagatgctccttctggtccggcgtctgcgcggagtcatcgatcagctcgtcgacgcgccggcgcgcgtcaccgccctgcgtgacctcgttgagcaccatcgaatgagtgatcttcatgtgcgggacgagtgtttccggcgcggcgtcaatcaacttgtcaaacgtgctctggttccacgtgacgaacccttccggcgccttcttgcgcttgactttcttgagtttcttcggatcgttcccggccttggcgacggccttggcgttttcgatctcgtattcgggcgcctcggcgacgaccagtccctccgtgtcgaagcccatgcggccggcgcggccggcgatctgatggaactcgcgggcgcgcaggcgacgcatcttggtgccgtcgaacttcgtcagcgcggtcagcacgaccgaatggatcggcacgttgatgccgactcccagcgtatcggtgccgcagatgaccggcaacagcccctgctgcgcaagctgctcgacgagacgacgatatcgcggcagcatgccggcatggtggatgccgacgccggtacgcaacagccgttgcagtatcttgccgaacgcggtcgtgaacttcacgcccttgatggcctcggcgatggcctgtcgctgctccttgctggacacgccggtcgaggcgagcgactgcgcggtgtcgagcgccgcatcctgtgagaaatgcacgacgtagatcggcgtctcgcccttgcggaacgccagttcgacggtcttctccagcggatcgagcgtgtactcgtaagtgagcggcaccgggcgcggcgcgtcggcgatcacgtccacgtcagtgtcggtcatgtcctccagcttgtcggcgatcgcgtcgacgttgccgagtgtggcgctcatcagcaggaactgcgtgtccggcagcgtcagcagcggcacctgccacgcccagccgcgctccgagtcgccgtaatagtggaactcgtccatggccacgcagccgacgtccgcgcgacgcccctcgcgcagcgcctggttggcgaggatctcggccgtgcagcagatgatcggcgcatcggcgttgatatgcgtgtctccggtgatcatgccgacgttgtcgcggccgaacacctcgaccagatcgaagaacttctccgagaccagcgccttgatcggcgcggtgtaataggagcgccgcccggtgcacagcgcggcgaagtgcatgccaagcgccaccagcgactttccggagccggtcggcgtgttgaggatcacatggtcgcctgccagcaggtccatgatggcctcttcctgatgaggccacggctcgacgcccttgacgtcggccacccagccgaagaaccgctcgtagatctcgtccgtgtcgatgttgcgctcgccctcgtcccacgcgggcgccagcgcccccagcgaaccataatgttctgtatctgccatagtggttcccagtctacacgccggcgcagctcgcggaatcgaccggcgggcgcaagttcaccccagcagccgccgaacctcgtccggatcgacgtccgggtcgagtcccggccatgtcatgttcatgttcttcaatgtggtgcgcagcagctcggagaccacggccctcgagtaccagcggttgtcggcgggcaccagataccacggcgcggtctgcgtgctggtcttctcgaacacctcctgccacgcgcccatatagtcgtcccagcgttcgcgcgcgcccaggtcggacatgtcgaacttccagtatttggtcgggtcgttgagacgcccgagaaaatgcctcttctgctcctcctggctcacgacgaggaagatcttgagaatcgcgcagccgtcggccgccagcgaacgctcgaactcattgaccagatcgtaccggccgcaccattcggcctcgggatacgtgccgtacacatgcggcatgacgatgtcctcgtaatgcgagcggtcgaacaccgcgatccacccgttctttggcagctcgcgttccacccgccacaggaaaccgtgccgcgtctcctcgtcggtcggcttgccgaaaccgtgatagtggatgcccatcgggtcgccctgccggaacacgtggcgcacgatgccgcccttgccggaggcgtccatgccctgcagcacgatgagcagccggcggcgcgagcccttgacgccgttcgcatacagcagccgttgatatcgggcgatctccgatgagctgagcgtgatgaaccgttcagcgtcatccctgccgcctgggaagccgggtgtggagtctccggcgacatcgtcgatatgcacgccgtgatggaacatgagacgctgcgcgggcggcagcgaccatacagcgctgagcagctcactggatttggcggcgttcgcgagtcgttcagccaccgtcgtgctcgattcgatggtttcgatgcggttcgtggcgagccgcagtaccttgtcgatgcgtttgtccgttttctcggacttcgctcctttgcccgacttgtccggcttatctgtcttgtccgattttccgtcgcctttggccatgccccgattgtacgtcccatgcgccgccttgtgaagcatttccgcggcggaatatcgaacggccggaccggcgcatcccctgtcggggagtgccggcccggccgttatcgggtcaggctgcgggacgctgtccgcgtattcctgcgcgggccgtaatctaccgggtcattacgcgtcgtcttcagcgttcttctgctcggcatcgtcctcatctccgccctgcggatcgggatgggcctcgtcgaagccctgctcgtagcgcgtgcgctgccagttgtggatcgaggcgttgctgccgcgatggtgcacgtggtatgtgagcggcgtgccgcgcagggggcgctcctcgacctccttggcgacggcaatctggttgacgttggacggatccatgatcgcgatcggcggaactggttccggttcggccggcgccgcggtgcgctgctgcatgcgcgacggcagccattcggccagacgcgacagcagccagcagacgatgaagtacacgaccgcggccacgaccagcgtctgcaggatgttgaagtacatcgagccgagacggcgcgactcctgcagcagatcggtgtacatgatgatcgatccgagcgcggtatccttgagcaccacgaccagctgcgtgacggcggccggcaacatcgcgtagacggcctgcggcacctcgatctgcatcagcgactgcgtctcggtcagtcccagtgcgagcgacgcctcacgctgcccgttcggtaggttgccgacgccggaacgcaccagctcggcgaccacggagccgttatacagcaccagggccagcaccactgcccagtaggacgggctggacagtcccgcgaacgcgaaccagcgccagaagaagatcatcagcagcagtaccggcaccgcgcggcagaactccacgacgaccgacgagatcgcccgcagcaccacgttcggcagcagtcggccgacgccgaacaccaggccgaacaccacggagccgacaacggcgacgatggacgccttgaccgtcatccacaggccgggaagatagaaatcggtccacgcctcacgctccagcgcgggcttccacagctcccagctcagctggttctcgccgtccggcgggttgtgcaggcgcatcaggatcagcaccagcacgccgacaaagatcagcgcggcgacccagttgacgatgcggatggcgcgacgtcccttgggaccgggctggtcgaacaatacggaattggaagtatcagccatgtcgtcacctccgcacggcgagcttgttggacaggtacgtggtcagcatgccgatcgggatgatgagaatcacatagccgaacgcgaagatcaggaagatctgcacgatcacgtccgggtggaattcgatcatcgtgctcatcagcgacgacgtctccgtggccaccgacgcggccgcggccaccgtggagttcttcagcaacgcgatcagcgtattgccgagaggcgcgaccgagccgcggaacgcctgcggcaggatgatctgcgtggccgactgcatgaagcccaatccgagcgcacgagccgcctcggcctggccgatcggcacggtgttgatgcctgaacgcagcgactcgcacacgaacgccgcggtgtacaggctcaggcccgtcaccgacagccagaagaagttcgtggcgaacgtgtcggagaacgtgagcttgagctgcgcgtaggcgcccagcaccatgaacaccatgatgatggtcagcggcaggttcttgaacagttccacgtaggctccggcgacggtgcgcagtgaggatatcggcgagatgcgcatcatgaccagcaccacgccgagaatcagcgagaacagcgccgaccacagcgtcagttcgatgttgaccaggaacgcggcgggaacgttgtactcgctgaacagttggatgaatccgtccatgctacttctccccctcggtcggtttcggcgggttgtactccgcgttcggcgtgtacgacgtgccctcggtgttgtcggcgatggcgcgctcccaggaaccgtccttgatcatctcggtgatggcggcgttgatcttcttggcgagcgccgtgtcgcccttcttgatgcccacgccgtagtattcctgcgtgaacggcttgccgacgacgcgcagcttgccgcgcgaggcggaggcgaggccggcgaggatgatgtcgtcggtggtgaccgcgtccacgatgccggagaacagcgccgtggcgcattccgcatagccgggctgctccatgagctgcacttcggaggcgaacttctccttgactgtggcggccgaagtggaaccggtgaccgagcacaggcgcttgccgttgaggtcttcggggccgttgatggaatggtcgtccttgcgcacgagcaggtcctgcccggccacgaagtacgggccggcgaaggagaccgcgttcttgcgctcgtcggtgatcgagtaggtggcgaggatcatttcgacgtcgccgttctgcagcatggcctcacgctgcttggagggggcttccttccagacgatctcgtcttcggaatagccgagcttcttggcgacgtacttggccacgtccacgtcgaagccgacgtatgttccggatttcttgaagccgaggccgggctggtcgaacttgatgccgatgcgtatcttgccgctttcgtcggcgccgcacgcggccagcgacatcgtgcatgccacggcggcgagcgccgcgagcgcgcggcgggcgatgcgcctgatgcgagtgttgaataccgtcatatgcgtcacgaccaatcagtgcgtgaggatcttcgacaggaagtccttggcgcgttcggtcttcggatggccgaagaactcgtcgggcgtgttctcctcaaggatctgcccgtcggccatgaacacgatgcggtcggccgccttgcgcgcgaagcccatctcgtgggtgacgcagatcatcgtcatgccttctcgcgcgagctcgaccatcacgtccagcacctcgttgaccatttcggggtcgagcgcggaggtcggctcgtcgaacagcatgaccttcgggcgcatggcgagtgcgcgggcgatggccacgcgctgctgctggccgccggacagctgggagggcatcttggacgcctgcgagtcgacgccgacacgggtcagcagatccatggcgagatgctcggcttccttcttgtccatgtggcgcaccttgatgggcgcaagggtaacgttttcaaggatcgtcttgttggcgaacaggttgaacgactggaacaccatgccgacttcggcgcgcagctgcgcgagctgtctgccctcctggggcagcgccttgccgtcgatgcggatgtcgcccgactcgatggtctccaggcggttgatggtgcggcacatcgtcgacttgccggagccggacggccccacgacgacgagcacttcgcccttgttgacggtcaggttgatgtctttcaatacgtggaggtcgccgaagtacttttccacgtgagtcagttcgacgagaggtcgtcctgtgggttcattgcccggtaccagcggcaccacggggagtattgcttcttgtttttctgacatattgagcagtataaactattgaaggcacaagaagttcacattctcgtccaacatgcgactcgcctgtgcgactcgcccgcggccgcacggcgtcttactgccggggcttgcccagaccggggacgaatcggacaccgggaatatcagcgaagatcgagccgtcgaccaccagtttggacgggcggatgccggagccgagatacagcttgggaatcgacagcacatgctggtcgacgagcagcggccagtcatcgggcagtccgatcggcgacatgccgcccgactccatgccggtcgcctcgacggccgcgtcaatcggtgcgaaactgaccttggacacctccagcgtgtgcttgaccacgccgttgaggtcggcgtgcgtgtccgcggtgacgaaagccgcggcgaattcgggcggcgccttgcgggtcttgtgcgtgtgcacgaccgaatctccaacgatctcgcctacgcggtcatgcgtatcgatcatgacctcgacgcagggctgctggaggaagcggaagcacaatcgctgcgctccatcgtcatgcgggcgctgcatgacacgcatgacgtcatcaacatgccggatcgacatggcagcggcttcgatcggtaccggcggctgggggtggtcaccgtaaacagacgcacgatgttcaagccgtattcgactcagtacaatgcacaaaacacgcgcacggcctccgaccgagcggcgacgtcgagcttgaccttcgcgtgccgcaccaccacggacaccgtcgaatccgctattcccaggcgctccgcaatctccgccgtcgaatagttgtcggcatacagacccaacacctcacgctcccgcttcgacagtgtccggggccgtcgcgccgatgccgacactatcgacccatgtgcctgttccgtggtcgggaaacccgggaacggccgtactaggacattccgcatggcttcggcgagttccttcggcgtcacgcttttggcaatcaacccctgggcgcccgcatcgatcgccagctgacggtaatgatccaacgaatacgatgtgatgccaagtaccacgatgtcggctgatgcagcacgaacacgccggcagatctcgggaccgggaatgtcggtcagcggcatatccagcatgggcaatgcgaaccggtcgttatccacgattccaatggtgatcacgatcccattgtgccctgcccgacctcatcgcccatcatcaaatggtcgacatggcatgcatctgatgtgctttggccgtcattgcgttcctaagtgcgcgccgaaacgacgaccgcgcgcacttaagaacgcaaaccgggccatttgcgtcgctatgtgcgcgcacttgtcgtttcggcgcgcacttaggaacgcaaaacagcagttcggcaatcatcacgggtagcagggtgcggacaactgcggaaaaacggcctgtgtactgcgcagacggatatgcaaagagggtcccgacctgcatggtctgggccctctcgtcaaagaagacagcgagatgttactcagtcttcggcatccgggtcgtagtcgacgccggtctcggcacgctgctcgtcactgatcggagccggggcgccggtcagcgggtcacgaccgccaccggccttcgggaaggcgatgacgtcgcgaatggtgtcggcaccggcgaggatggacacggtgcggtcccagcccagggcgatgcccgcgtgaggcggggcgccgaacttgaaggcgtcgaggaggaagccgaacttctccttggcctcttcgggagcgatgccgaggacgttgaggacgcggtcctgaatgtcgtcgcggtggatacgcacggaaccgccgcccatctcctcgccgttgcagacgatgtcgtaggagtcagacatggcgtgctcgggatcctgatcgaacttgtcgatccagtccttgctcggcatggtgaacgggtggtgcatggaggtccacttggagtggccgacggccacatcatcgtcatccgggtcgtcggtgggcttgaacagcgggaagtccacgacccaggtgaaggcgaacttcttcggatcgagcaggccctcgcgacgggcgagctccacgcgcacggcacccagcagcaactgggaggattcgcgggaaccggcggcgaagaacacggcatcgccggactcggcaccgacggcggccatcaggccctcgcgctcggagtcggacaggttcttagcgacgggtcccttgagctcgccgtcctcggtgaaggacacgtaggcgaggcccttggcgccgcgccgcggctgtgcttcaaggccgagcagctgtcgtcgctgatgaccgcccgatcgctgactaacgacgacgaggccgccctagccgaaacggtgaaattgtttactatggtcgcggcgagtgagtggaaacgtcaccatgacgacgtgctgtgggatgccgccgaggcgaagcggctcgcgaaagaggaggacgagcgccgcaacaaggaggcgctcgccgccaagttcgcgcacgtgagcgacgatccgtccaagccacccgtggagctgtgacggctgccgcctgacgtctgatgggacggggcggagacctgaaatatatgcgattcaccgctgactgctcggaatcgtgctgacctgcttgcggcgcgcccgctgaatgtggcgtacttcttccagaacctgaggaacgccttgccgaacgagcacccgtagtagggtttgtccggcggcggctcgcctgtgccgaactgaggggggggcggcgtaaggactgttgccgccgtacgccggcgcggccgtatattgctgctgtggtgcggcgccggctctattcgccgtcgtcgttgaacgcgatggtgtcgtccgggccgaggagcaggcgttccgcgagactgatgatggtcagcagcagtgcggtcagtgcgaccaccatgatcgttgcggagaagatcagcggggtgcggaacgagttgaaagcggcctgcagccagatgcccaggccgttcattgcgcccagatattccgccgtcaccgcggtgccgaacacataggcggcgctgatgcgcaggccgccgaacacctggcgggcggcgacgcgcagcttcacatgccacagcgcccatgcgcgggtggcgccgcaggtgagcgccacgtcctcgtagaactgcggtacggcgagcatgccgcggcacgtctgcacggcgacggggaacacgccgaatacggcgacgatcacgattttgccgagcggctcgaacccgaaccagatcatgaacagcggggcgatggtgatgagcgggatggtctgcgcggcggcgagcagcggatagataccgcgatacagggttttggacacgtacaggccgatgccgatgagcaccccggccaccgctgcgatgagaaagccggtgattgcctcgtatgtggtgatggcggtcgcctcccacaggtcgggccaagtcttgatgatcgatgcggcgatctggctgggggaggcgagcacgcgttgggagatgtggcccgcatccacggcgatctcccatacgatgagcagcccgccgaccgtgaccgccggcggcgcgacgcgtgcgaacagggatttcagtgtgcgcatggcgtgatcttcggacaatgtgaaaccttagggatgggattgatggggactggcgggttgacgggctgacggagggagatgggccgggtaggagggagaagggccccggaatcgttacgagagtcggaaaactcccctccgtcccgtctcgtgacggaccgaaggggagcggaggttggcccggccggctgtgacgaacctgtgctcgcggattcgctgaactgtagatagattggctgtggccggactggctgcagccggatcagcccacgtactcgttggtcgcgaggtccttggcctgcggcgcggacgcgggatcgttgccgtcctggtccttgtaggtgccggccttgtactggaactccaggtacggctgcgcgtcatcgaagttcgtggtgccgggcagcgacttcggatcgtcggtcgtccagtagttgttcttggcgatctcctccatcgaggtgcgggtcagcttggagtcgagctgcgcctccttggcctgttcgaccaggatgtcggcggccttgtccgggttggcgagcgcgtagtcgtagcccttcttggtggcggcgatgaacttcttcagcgcatccgcgttggcggagtccttgagccaggagcccttgacggcgaatcccagctggtcggggttgccgggcacgccccagtcggaggcgacgaagcagttgagcttcgggccgttcagctcgctttccacgccttcccaggtcacgtagaagccgccgaaatcacccttgccgctggtcagcgtctcgaaggtgttggtgccggccgtcgcggtcttgatgtcgccggtgccgccagcgtacttgatcatctggcggacgaccgcggtctgctcggcggagccgaagctgacgaaggtcttgccggaaaggtccttgggcgtcttgatgtcggtgcgggacgccagcgcgcaccaacgggcgaccggcttctgcgtcaggtcgaacacgaacttcaggtcagcgccctgcgagttgaacgcggcgacgttgctcagcgtggtgaagcccacgttggccacgccgttctcgacgctggtttcagctccggcctgggcggtcggcaggatcttcacattgacgccggcatccttgtaatagccgagcttctgagccacgtacagaccgatgtggttcgtgttcggcgtccagtcgagcatgaacgacacggtcggcgtggatccggagttcttggaatcggtgttgctcgcggaattggtgtttccgcaggcgctgagcgtcaggccgagcgcgacggccccaaccatcgccacgatcttgctgaagcccttgactgtcttcatcttctgtctccttgccttctgcgcacatcgtgcgcctgccggctgacacacgccgggcgggaaggtgaggagcccgcgcgacatgaatcagacccgtcgcatcgcagcgcgacacatatcgccttgcaatgcgtttacttctctgatgtctggcacggctgctgccaccaaccgcgcgaacgttctccagtatagcggtatgcgggggatcgtggtatgtctcgacgggcggcttcgcgcaggagtcggtgtgacggcgcggcatcgggccgccatggcatgtctcccgccggtggacatgtgtttgccggattgccggggcattgctgttttctgctgttctcggggcggaccgtttccccgccgggttcatgggctacgatgctagtggctcgtgaaatggcttgtgagatcaaggaggatgccgatgatgaaggccgtgttcttcgacttggacgggacgctgatcgattccgatccgtattgggtgcgctctcaggagaccttggtgcgctcctgtggcggggaatggagcgacgcgctcgccgatgcgctgcagggggcggccttccccgagaccgtgcgtctgctgcgcggtgcgggggtcgattgggatggcgatgcaatcgtgcggcacctgtccgatgaggtgctgtgcatggaaaaggagcgtctgccgtggattgagggcgttcgcgatgtgctgtccggtctggcggcggcgcacgttccggccgtgctggtgaccggctccccgcgcgagatcgtcgagaatgtgatggcgcaggcgcctaagggcgcgttcgtcggctatgtgtgcggcaacgacgatgtgacgccgaagcccgatccggcgccgtattggcgtgcggcgtcgatggtcgggctgccggccgatgcgtcgggtgctggtcagtgtctggttttcgaggattccaagcccgggttgacggcggctcgggcgtcgggcgcgacggtggtcgcggtcaccggtcatgctcgtgtggatatgagcgacagtgggctgtgcgatgaggcaatcgttgactatcgcgggctgaccatcgccgatttggccggctggatgtgatgtgccagccagattgtcgtggcgttgcaacggtttcatgggttgttccctcatattcgcacgtgtttgggcttcgcgtgactcggtcggataacaggaacttcatccttcggcgcgaaagcggcatctgcgtttcgagggggtgatttcgtctcgcccaaacatctatctacgtttcgaggggttgctgtctgccagtatacgaagtatgaggggcggaatatcgccatcaatatagggaggattgacgaaaagcaaccccttgaaatgcagatagatgtctgcgagggctgcgatcaaccccttgaaaccgagaaagtggtgttgcggactcttttcgtgtggtggcgcttgattatgttgtggcttggctgcgacatattgcgagtgcactgtcgatgatgagtgaatggcggtggggatgccattcgatgatatgaagctcgtcaagcgtggaatctccagtgtacgagcacgaatccgctcgtttgcgtccctaagtgcgcgccgaaacgacgaccgtgcgcacatagggacgcaaacaggggcatttgcgtccttatgttcgcgcgcttgtcgtttcggcgcgcacttaaggacgcaactcggggagtgacgggagtgtaggcacgtatgtgggccttgcggcgcagcaaagatatggggcagtcccaaagaaaccgggtgaaggtagcggtgtgaatgagcgcggcatgtacgaacacggggtaggtgggcaatgcgcaatcagcaggaacggtggtgcgtctcgggcgggaatggtcggaaggatccagcgcgctgacaagtaggaggggcgggcttgcgaggcgaaccagcatggaaggagttggcgcaccgcattgactggcgggagcgagcggcggaacgaaaggggtgtaaacaaggcaacggggagtgccgcgtgtgaccgtttacatacatgagtgtagggattgtgtgacgactcgctgtgcgcgctaacacgatttgcgttttgccagtggttgcgatatatgagtatcaacgataatttcggttgcggtgatggaatcgaaacaagcaattggagctgtataagtagtaatacaaggggacaatcatgaataacgatcagaacaaggtcatggaccagcgcgagatccgcgaggacgagtcgcaggattgggcgacgctgttcgccggtctcgccgcctgagcgcgccgaaatatcctgaccgaggcgcacttgccggattgacgatacatcgccgtacatggaatccgacagtcacccatcggcaggacgacgcagcaaccttcatgcgcaacgccgtcgaagccgccatcaaagccggcgcttcgaccgccataccagcagccgttccttctgccatcgacggcgcgaccgtgagaccgattgaccaaaagtgagtgaaccggctcacgtcccgttgacgcggcacaatggaacgtatgactgaagctgaacattcaaaagacaccaaaccagaacttccggctcatgttcgcgtgcgcttctgcccatcgccgaccggcacgccgcatgtcggcatgatccgtacggcgttgttcaactgggccgaagcccgcgccaccggcggcaagctgatcttccgaatcgaagacaccgacgccgtgcgcgactccgaggaaagctacaaccagattctcgaatccctgcgctggctgggcatcgactgggacgagggcatcgacgtgggcggcccccacggcccgtaccgccagtccgagcgcggcgacatctacaaggatgtggccgcaaagctgctcgaagccggctacgcctatgagtccttctccactccggacgagatcaaggagcgcaacctcgccgccggccgcccggccgaattcggctacgacggttacgaccgcgacctcaccgaggagcagaaggccgccttccgcgccgagggccgcaagcccgcgctgcgcatccgcatgcccgacgaggacatcgccttcgacgacctcatccgcggcaccatcgaattcaaggccggttccgtgccggactatgtcatcgtgcgcccgaacggcgatccgctgtacacgctcaccaacccggttgacgacgcgatgatggacgtcaacgtcgtgctgcgcggcgaggacctgctcagctccaccccgcgtcagatcgtgctgtaccgctacctgatggagctcggcatcgccaagcagatgccgctgttcggtcacatgccgtacgtgatgggccagggcaacaagaagctctccaagcgcgacccggagtccaacctgttcaaccaccgcgacaacggtttcatccgcgagggtctgctcaactacttggctctgctcggctggtccatcgcccccgaccgtgacgtgttctccatggacgagatgatcgccaagttcgacgtgcgcgacgtgaaggccaacccggcccgcttcgacatcgacaaggccatctccatcaacgccgagcacatccgcatgcttgagccgcaggacttcctcaaccgttccgtgccgtacctgcaccgcgacggtgtggtctcggccgacaattgggatgcgctgaccgaccgcgagaaggtcgtcctgaccgcctccgctccgctgatccagccgcgcgtgcgcctgctgggcgaggtcgccggcatggtcggctccctgctgtccaccgaggagtacctggagcctgcggacgatgccaggaagcagctcaaggactccgccgccgacgtgctcgatgccgccgtcgccgcgcttgagggcgtggacgaggccgattggaagaccgacaacctgcacgagaccctgaacaaggcactcgtggaggatggcgggtacaagccgcgtctcgccttcggcccggttcgcgtggccatatccggccgtcgcgtctccccgccgctgttcgagtcgatggagatcgtcggcaagccgctcaccatcgctcgactgaagggcctgcgcgagcacctgtgatgtaacgcagcgcttgtgcgcatgcggaatccggcgggcggctgtcgcaagacgccgcccgccgtctgctatctgcggagtttgcgcctccgctggcgggctgagccgtgaagcgaacggaggtgtcgttcgtaatcgaaggcgagccgacatacgagtagacaatactgcccccgcaggggtgtcacgaagcgactgggggagtctccgccgatcaggcgggcagaactcctccgctgatttaccgccccaaataacgctccgccgtaacatacctcccgttcttacccgtgaagttttctgttcctcgatacacgacgattctgcgatcgaccggcacgcccagttcttccccgacggtggcgagatgcctgaagaaatctggtcgcggagtcattctcgatttgatttctatgagggtggggctacggcgctgcgtagcgtctacgaggtcgatttcgctctggttggtatcgcggtagaagtacagctcgccgtctttgttcttgttgaggtatcgcttcacggtttgcgaaatgatgagattctcgaacacatcaccgcgcttggggtcgttcagcagctcttccgcagaatgaatcccgagaagatagttgagcaggccattgtcgtggaaatagatgtcgttcggcgttgacgcgtcatagaggtgaggatagccgccgcggaacatgaattcgtccgcggtgaggtcgggttccggctgaatcgcctcctcatgcgagaggggcggcagttgaagcatgcccatgcgccccgccagagattggcccaatgcgcttctccaggaggaagttttgcgagccggacagcacgtattgccccatgccgcctcgttcgtcggccgcgacctggatctgcgagaacagtcccggagcatgttgcgcctcgtcgatgatgagtttcgcgccatgtgatcgaatgaacccgaccgggtcatcgatggcgctgatgcgggtggtttcgtcttcaagattgacgtattcgtaatcgagcagcatgtttttgatgagcgtggatttgccgctttgacgtggtcctgtcactgagacgaccgggaaccatgacagcatcggggtgagctcttgcgcgacggtccgtggtatcatcattgtctcatttgcaatttcatcaatacagtgtctgataattcatcaataggattcatgcaaattcatcagtaggattcgtgataatctgtcagtgcatgtcttatatcgttgcaatataaggttttttgacagtctttgtggctcagttgacgatggtagtgcggtaatggcgcattcgtgagaatctcgaccatgtcatgcgacccgcggctcaattgacgtgagccgtttcgccatcctcgatgatggtcggtggagatgcagcctaacgtatctgcatcgtgccgtctcgttcgatgttaccgcataacgcttttgttgactggattggttgggatatttttggagtctatcggatttcgtcggtggtcaagagcccgtcccaaaaccgttggaaatcctcgcgacacgccgtgagttgcagtgggctggatattgccgtatagttttcatctgttgcgcggcacgccgcacagcggataactcaagcccccatcgtctagcggtctaggactacgccctctcacggcgccaacaccggttcaaatccggttgggggtacgaaggtgctataatcccaatcggttacagcatctagccaaattgggatgtggtgtaattggcaacacagctgattctggttcagccattcttggttcgagtccaggcatcccagcgaatgaagctctcgcggaagcgagggcttttttgtttcccggcgcattcagccggcggattcgtggcctataggccggatccgtccaaaatacgggttgaaatcgccgaaatctactattccccgtgtgaaatcgccgtttttgaaccttaaaacggcgatttcacacggggaattgccaagaacggcgatttcaacccgtaattcagtgtcccggcccgctcaagacacgccatggtgctgtcaggcacggtcaaggtggtatgtactacgctgtgagttatgacggatttcaaccagattgcagcgccggcatccgctagcggccccgatgacgagcgcccggtgtccatctcggcgcgtctgggacgtctccagttccaccgttccggcaagttccgcgtgttgcagctggcggacatacaggatggtccgaaggtctccaaagacaccatccggctgatcgaggcgtcgctggacgccgcgcgccccgacgtcgtcatattcaccggcaaccagatcgccggatacgacgacgcgtactgcgacacgttccgcaagcggcagtgggagccggcgcggcgcggcaagatcgagcgcacgcgggccaaggtgcgtgccggcatcagtgcgttcctgcagccgctgatcgaccgcggcataccattcgccgtcacctacggcaaccatgatgcgcagtgcgggctgagcccggccgagctggacgcgctgtaccgtgagttcccggggtgcatcaacccgccgtgcaatatggacgattccgccgcgaatcccggcttcctggtgcgttcggtgccgtcatccggtttgccggatcagccagtggccgcatgcgagcccggcacgttcgcaatacctgtcctggatcaggatcgccaacgtgccgtgctgggtctggtggtgctcaattccggcgattacgcacgggagggcggctatggccggccgagcgacgccgcgctgcgtttcgtgcacgacgtgccgcggtggctcggcgtccgctccctggtgttccagcatatgccgttgccgcagttttatgacgtgctgaaggccatgccggcgaacgccgataacgccatacaggggtatcgcaagtacgatgcgcagtattacgtgctcgatgatgaccggacgctcccgggcggctatctgggcgaaggcgtgagctgtcctgacgaggattgcggcgagttcgccgcactgcgcgacacggacggatatataggagtggttgtgggccatgaccatcgcaatggtttcgtcggctcgctcaacgggatgatgctggtggcgacgccgacctgcggattcggctcgtacggaccggccgcggcgaatcgtgcggcaagactgttcgagttcgacatccgccacccgtacagcccgcggacgcagctgctgacattcggcgagctggtcggaaaaccgagctccaacaaggcgtacacctatgcggtcgaagggcagtcgaacgccgccgatggcgtcaatctgctgaggaaacccggcctgctcgccggggtcgccgccgcattgaagaagatctgagcaaaaagggacgcccccgctgacgggctgagtcgtcaggcattgtctgatgccaaggagcgccccccccgccagcgggggcgctccactgatccgctgcgctcgacagcctgctgggctctgcacccgtccgttgtcggcgctgtcagcgaacggagctggccttgagcagggcgtcggtcaggtatttgccggcggccatgaccagcggggcgtaacggcgcccgggcgagttgcccatacggccggacgggccggaaatggaaatcgcggcgatgacctgaccggaggcgttgcggatcggcgcggagatggagcagacgccctcttcgcgctcgttcaccgattcggaccaaccgcgcttgcgcacggcggcgagcttcgcggcggtgaacttggcgtgcctcagcccctgatgcagccgctcggaatcctcccaggcgagcagaatctgcgcggccgacccggcctccatcgacagcatcgcgcccacgggaatcgaatcgcgcaggccgctggcgcgttccaccgctgcgatgcacacgcgctgatcgccctgacggcggtagatttgcgcggattcgccggtccggtcaagcagtgtctgcagaatcggccccgccgcggtcagcagacgatcctcgcccgctgcggcggcaagctcggcgaaacgcgagccaagcacgaatcgtccgtgctgatcgcgcagcacgaaacggtggcgctccaacgcgatcgccagacggtgggcggtcggtcgcgccaggccggtggccgacaccagctgtccgagagtcgcgggaccggattccagcgcgtccaaaatcttcacggttttgtcgagtacaccgacgccggaatggatctctccgctgatggtgtactcgatggcgtccgctgtcatggtgctggtcacggtgccgtcgtcatgcatctcgtcgtcggcacgctgtcgttcatcggccatgcttgtggccagtggttgcgtcagagaagtcataatgaagcattatgccatctcacataatgaaatgcaaaagtaacgtagacgcttttctgttaatggcaggccggtaatatcgcgatattttcgacaagaaccgcaaaaaacaagaataattcaagcatcgccatgttttcgccgttttatggccatgtatttatctcatatatcggcctagggaagttctcaacgtgcccttgcccatacgcttattaccacataaaaagcgtgagggcaataccttgcgcgaggaaatttgaggaggtcccgaatgggaaccacattggccgagaaagtctgggccgaccatctggtgcggcaggggagcgacggcgcacccgatttgctgtacatcgacctgatgctcatgcatgaagtaacgagcccgcaggcgtttgagggtctacgtctggccgggcgcaagccgcgtcacgtcgatcagctgatcgccacagaggatcacaacacgccgacggtcgacatcgaccgcccgaacccggacaagacatccgccctgcagctgagcacgctggaaaagaactgcaaggagttcggcgtgcggctgcacccgctgggcgacgccgatcagggcatcgtccacgcgttcgccccgattctgggcctgacccagccgggcatgaccatcgtgtgcggcgactcccacacgtccacgcacggcgcgttcggcgcgctcgcgttcggcatcggcacctccgaggtcgagcacgtgatggcgacgcagacgctgagcctcaagccgttcaagacgatggcgatcaacgtgaacggcaagctgccggcggacgccaccgccaaggacattattctggcgatcatcgcgaagatcggcaccggcggcggtcagggctacgtcatcgaataccgcggcgaggcgatccgcaacctcacgatggacgaacgcatgaccgtgtgcaacatgtccatcgaggcgggcgcgccatcgcccgtctgggagtcacgccgctgcatcgggtcacgtggcatctgacctgattgcggcgttgcggctgattccgggcctgcgtcgcgcagctcggcatggcgcggcttaatttggcccggcccggttatctgactcggtgctttgtctcaggtgcgggcgctgtagtgccacagttctttgtgagaagaagtccggggcgtgaatccgaacagcgcagtggcgaatctgttacctgcgcatgatttgtgagcgctcacgtgtgttatttaagcgttaccgggtagacttgcccatattgtgttgttatgcagcgggaggtttgacagcgtgacggccaagcgaagcgggcggaaacgcccatccatgttcgaagtcgcgaagctcgccggagtcagtcatcagacggtgtcccgggtcatcaacgattctcccgatgtctccgacgccacccgcaccaaagtgcaggatgccatcaaggcgctcgattatcgtcccagcaactcggcgcgagcgctcgcatcgcaccgttcccgcacgatcggcctgatcgcaggcggcatgaagttctacggccctatttcggcgatttccgcgatcgagatgatggcgcgcaagcacggcctgttcatgtcggtgatgatggtgcatgaggcgctgtgcacgcgggcggagttcgagaacctgtgcggcacgttcaacgagcagaacgtcgacgcgttcatcatgctcacgcccaccgatgtcatgttcgaagcggcctgctacacgcagctgacgcagcctcgcgtgatgatcacctccacgcacggcgaactcagcgtgagcgaagggctgcgcctgattcactcgcgcgagcgcgaccgcgtgtcgatcgtcggtatcgaccagtggagtgcgatgggcgatgtggtgcgcatgctgaccgaatacggtcacaagcgggcgttgtacttcgccggtccgttggggtggcgcggtgcgatgacgcgactggatgcctgggtgaaactgacccgcgcccgctccatcagttccgtcacggtgcgttgcaagacctgggagtcgaccgaggcgtacgccaggatgaaccatattctcgattccatcggcaatcagggcggcaagttgccgacggtcgtggtcacggcgaacgacaatcaggcggtgggcgtcgcgcgtgccctgtatgagcacggtgttcgcattccacgtgacgtcagtctggtcgggttcgatgacatgccggcgatggacaacatgattccgcctctgaccacgattcggcctgattttgaggcgttgggcgtcgctgcgatgcggcaggtgctgcatctgctgggggaaggtgacgaagtggcgttgcccgcgtccgcacatggtgtcggtctgctccccgcagaagtcgtgaagcgttcgtcgctcggccccgccgccaaccgctgaccgaggatcgcgcgtttttcttgggtctgttagaccaacgtgttggttttgatttgcaaagtagctgcatagtacgtgcaatgaagctatgggtaggcatagcaaggcagtgaaactggtcggcggagtccggggcggactcgcgctgctggatgatgacgagtgccgccgggcgattgaggcgggcgaacgagatattgacgacggcggcggcttttttcgcggcatggctcggcccggcacggcgttgatggtcgcgtacgtcgacgagttcagggaccgtttcagggtcgggatcggccgcggccgggtgacgagcgtcgtgcgggaaccgggaatccgcggcgtgcgccgcggcgggatgcccgtcaccgccagaccggcgaggggcgcgggcggcgggcccggcctcgcggaacgcgggttcgaggcggggcgccgaacccgcctcgccggtcctcgggctaccggacaccgggacggaccgaaaccgggtattatgcgagccaagcggcgcaagccgccccactataagagcggaacaaaaaacaggccatatcaatgtgccagacggcacgttcgcatcacccctcgttcggttatgcggcccggtggtcagcgcttgccggcgtacagctcctggtcgatcgcgccggagaacacgcggttcacagccggacgcacgaccttcagcgacggcgtcaggcaggagttctcctgggtgaactgcgcatccagcaccacgaacttgcgcaccgattcggcccgcgagaccgtcgcgttcgcgcggtcgacgaacggctggatctcctcgcgcacctgcgggagcgctgccgcgtcggccagcgacaagtcggccggctgaccgatggtcggcagccacgacgccagaccttccgggtcaagcgtcaccaaggcgccgatgaacggacgcccgtcacccacgaccacggcgtgctcgacgatcgggcacttggcgatctcctcctccatcgggatgggggagacgttcttgccgccggcggtgatgatgatgtccttcttgcggccggttatcataagccggccgtcctcgtcgagcgagccgaggtcgccggtcttgagccagccgtcggcggtgaacgtttcggcggttttctcggggagattgtgatagccgcggaacacgttcgcgccgcgcacctgcacctcgccgtcgtccgcgatacgcaccgacgagccgggggcgggctggccgaccgtgccgatcttgttgtcgttcacgcgtgtcaccgtaaacggtgccgcggtctccgtcataccgtatccctggatcatcggcaggccgatgccggcgaagaagtgcgccagatcggcgctcagcggagccccgccgcacgccacataccggatgttcgggccgagtgcgccgcgaactgcgcggtacaccgatgtctcgaacatcgcgtgccgggcgcgctggctggcggaatgcttgcctccgtcctgctcggtgcgcgaccattcgcgggcgcactgggcggcctgcgcgaatatgcgccctttgaaaccggtgccggccttgcgtgacgcggcgttgtacaccttctcgaacacgcgcggcacgccgagcagataggtcggcttgaacgagcgcaggtcgggaagcagcgacttcgtatccggcagatagccgaccacgccatcgtcggagccaatcgagcagtactggatgtaccgtgcgaagcagtgggcgaggggcaggaacagcagcagccgtggatggttgtcgcacagcacctcgccgaggcactcgtatccggctcgaaccaccgacaggaaattgcggtgcgtgagctccacgcctttcggggcgccggtcgagccggacgtatatacgatagtggcgaggtcgtcggcatgggtgtcggcgatgcgcgcctccagctcctcgtcggagaccgacacgcccaatccctccaaagcgcccagcgcgttgccgtccatcatgaggatgcgctgcaggccggggcatcggtcgttgatcgaatcgagacggtcatagcgttcgcggttatcggtgacggcgagcttcacgccggagtcgttgatgatgcgctccgcctgtgccgcggaatcggtgtcgtagaccggcacgttcaccgcgccgatcgcggcgagcgcgaaatccagcacgccccactcgaagcgggtggcggagaacagcgtcaccgcgtctcccttgccgatgccgaacgcgatgaggcccttcgctgcggcgagcaccagacggtggaactcgccggtggtgatgctcgaccacgcgcccgggccggtcttgcgcgccgcgatggtggtcgcattgccggtgcgggcgatgcgttcggtgagcagcgagtacagtgtctcgtcgtcgttcacggcgacgtcgccgggggaggtgtattcgctgatgatggtcggaacggcagcggtgccgaccggccgcgcggccggtgccgtcatactgggtgccggttcatccgccggcttggcggcttgggccgcgttcgactgatcctgtgcctgatcctgtggcatcgtggatttcctttgcagatgtcctgatacgtattccatcgtcaagggtacgttgccgtaggttcctgcggtgttgtgcatgggcacgaaaagcggcgtcgggttttgtcgtcgcgcacaaccgcgcggcgcaggccggcggcggcgcggtggcggacgtcgggcggacggtgttcccgcgcggcggtgcagcatggccggctgataacggattataggttttccttatcgccggaaatgagccgctgcgcgtgttcgcggcgggaacgcctctagcatggtgccttgtgtgccgccggcgcatcccggggatgtgcgggcggtcgaggcaacgacaacaatggcaatatagacaatacagtaacggcaacaatgacggcgatgacgacagtcgtcgcgacggccatcgccgcagcatatggaaggagaaccctcaatggctgaaaaccgagcggaactgaacaagaacctggcgcagatgctcaagggcggcgtgatcatggacgtgacgactcccgagcaggctcgggtcgccgaggacgccggcgcgtgcgcggtcatggcgttggagcgcatccccgctgatatccgtgccgccggcggcgtctcgcgtatgagcgacccggccatgatcaagggcattcaggaggccgtctccattccggtcatggcgaaggtgcgcatcgggcacatcgctgaagcccgcatcctgcaggccatcgacatcgactacatcgacgagtccgaagtgctttcgccggccgatgacgtctatcacatcgacaagacacagttcgacgtaccgttcgtgtgcggtgcgaagaacctgggtgaggcgctgcgccgcatcgccgagggggccgcgatgattcgcaccaagggcgagcccggcaccggtgatgtgatccaggctgtgcgtcacatgcgcacgatgaacaagcagattcgcgagctcgtcggcctgcgtgacgacgaggtgttcgaggccgccaagcagctggccgtgccggtcgagctggcgcgttacgtgcacgacaacggccgactgccggtcgtgaacttcgccgccggtggcgtggccactccggccgacgcggcgctgatgatggagctcggtgccgaaggcgtgttcgtcggttccggcatcttcaagtccggcgacccggccaagcgcgccgccgccatcgtcaaggccaccgccaactggcaggacgccgatctgctggcacgactctccgagaacctcggcgaggccatggtcggcatcaacgaggacgaaatccagaccatcatggccgcccgcggcgagtgatcatagcccgctagcggcgggacgatcgagccgcccctcccgctggcgaaggcggtcaacttggcgggggcgattccgcatgaatccgcccccgctggcggcgagggctgccgcggggcgactggggtggtagaggcacatcctcagtcaccccacccctccccaccgcattcgacggctcccctcatcgggagccaaggagtaatcatggttgtagctgttgaatatatttcgaaggaagagtcggccgatgccgagacggcaaagcacggcgtgaccggcatcctggccgtacagggcgcgttcgcagagcacgctgcgatgctcgacaagctcggcgcccagtggaagctgctgcgtgccgccgaggatttcgacgattccatcgaccgcgtgattctgcccggcggcgagtcgaccacacagggcaagctgctgcgctccaccggtctgttcgagccgattgccgcgcacatcgccgccggcaagccggtgttcggcacgtgcgccggaatgattctgctcgcgaagcgactggaaaacgacgacaatgtgtacttcggcgccctcgacgccacggttcgccgcaatgcttacggtcggcagctcggttcgttcgtctccacggccgatttcggtgacatcaaggactttccgctcgtgttcatccgtgggccgttcgtctccgatgtcggggcggacgccacgatcgagaccgaggttgatgggcgtgtggtcggtctgcgacagggcaacattctcgccacggccttccaccccgaactcaccgacgacacccgcattcacgagttatttttgagcctgtaggctcccgctagcggatcgggctgcttgtcggcggggaacggcagtgagaccagcgggctggtcatgcatggcatgtccgtaactgcagggtcgagggctgttcgcgaaggtgactggggcggccgaggactttcggggtatcatccgcagctcggcgtctcgatttttggccgagacagcaggtcgccgcgtcccttcgtttcgtagttgtgccacaccagcgtgattttgcccgatttggccgtggtgtggccacgccgatggccacaccagctcgtgcaaacgtttacatgacctggtgtggtacatgatgtcattcgttttccttgaaatatcaaggaaaacgggattccgactccaaaccggtattgggcgcgtgtaccacagaaggccgaaaagaggcaaaaaagccctggtgtggtacagactttgcgatgtcgtgtgcgtcgtatgacccacaaatcgccggatggcgccatctgtcgacacgataagcttatgtcaacgttgtcatgccatatcgttcgtcgcttccgaatgggtctttagcggggtgaaagatgcggacggtggatcgggggtttgacttctacttcaaccgtgcgaagaacgaggctgtcgtgcgcgagccggcaggcgagaccctgctcgtctaccgcggatgcggcaataccgatgatggcagggccgtcacgctgaaacgcaacggtgtgctcatcacggtgtcgcaacgttgacggatcgccggctccagacatggggccggcgattcgaggagagtcgggccgcggcgaagtccgcgacgacgtcgacgtggacttcgtcgcaatgctgctgcgcggggagacgcgggttcatgacggtgaccgggcttccggcgcggaagcaacgccggccgcagggccgtgggccgattaccggctacggctgacgctggaccaatggacgccggacggtgcggtcagcggcgaaatcactgacatcactcggctgcgactgcggttccgcagcgattacggaaccgtgacggccctcgacggatccgccgtaccgcagacccaggatctgttccgtccgctcctgctcgcggtgcaccgcgatgacgggtcgggcattgacggctcgactgccgatacctcgcgcgtggtcatctccgtcgtcgcggaacgactcgacacccccgtgcgcatccccgacacgcctgacgcgaccggcaggcggggcatgcgtttcttcgccgaccctgaactcgcatacgaacgcgggacgttctacctgttcgccaccaccgacggacacggcgggtggagcggctggcagatccgctgcctcgcctccgaagacctggcacattggcaggaccgcggtgtcgtcatcgacctgcatgaccagcatctcgacggcagcggccgaaccaacatcctgcccggccacgcctgggtgccggcgctcgccgttcgcgacggccgctattacctgtatttctgcggcgacgggcagaccaacgtggcggtatccgaccatatcgatggaggatacgctctgcagggcgacttggcgcgaaccggctcgcacgccgcgcggcacggcttcggaaccggcatcgtcgcgcccggcgtcgatcccgcggcgttccgcgacccgcaggccggccgatggtacctagcctgggggcagaaccgggcacgctactcccgcctgtccgacgacatgctgcacatcatccccgaagtcacgcccgacatccgggaggccgcatatctgaacgtgagagagcatgccggaacgtggacgtactatctcacgtactcgatcggcgacaccgacgaccccgactatcgagtcgcctatgcggccgcgtcgaccatggaaggcgacggttcgcagtggacctatcgcggcgaaatcctggtcgccaacgaacgcctcggcatactcggcaccgggcatcactgcatacttcgggtccccggcaccgacgaatgggtcatcgcctaccactgctttctgccggacgccatgcgcccgcgcggcgtggaccggtacacgggcgagcgcatccgcaccggcaacaagcgcgaaatccggttcgccagactcgaattcgacgaacgggacggatggcgtgccgctcatcagaccggtgacggtatcgatgagcagcctggcgtggtcatgaacagcggcgacatgcgtggtggcgaacacgtcatcggatggcaacgatgtcgcgaagacgacaaaaccgtagcagacatgcggtggcccgtatgacaacttcggcgaagacgattaccatagggggagtttcctctacgagtaaggttgacgcgatgggcaagaccgaaaacggcaagaccggcaagagcgagatcgcgcggaacctgccaggctcgccgacgacggccgcacgtcggcgcgtcacgttgcgcgacgtcgccaccgcggccggcgtgtcgctgaaaacggcatccaatgtcatcaacggcaccggacgcatgaccgacgccacccgcgccaaagtcgaagccgtcatcgagcagaccggataccgggtcaacgtcgccgcgcgcaacctcaaccgggaccgcaccggcttcatcacgctcgctgtgccgacgctgaccgcgccgtacctgtccgagctcgcgaaccgcgtgatcgacgccgcccggcagcgcggatacctcgtgtacgtcaccacatacgcggaagggtcggcgacgggcgcccgcgagctgttgcgcaacttcaacaccacggtgtcggacggcatgattctgtcgatgagcgaagtcgaggacatcaacccggaggacctggaggtcgatttcccgctggtggtggtcggcgcgcgaaccacgtggggcaaggccgatcatgcgacgcccaacgacgtgcaggcggcggcatcggccgccggatacatgttcgactgcggcgtgaagtcgctggcggtggtcggcggacgtggcgcatatgacgaggcgaagctgctcggcgcggtggaaggcaacgcgcagctgcgtttgcgcggcatcatcgaagaatgccggcgacgcggcatgacgctggatgcgcggctggtcggcaatgtcgagcaggaatggacgattggcgcgggcgcccatgccacgcaggagctcatcgacaagggcgtgccgttcgatggcgtcatcggcctgaacgaccagctggccatcggcgcgttgaccgtgatgcgcgcgaacggcatcgagattccccggcaggttcaggtgatcgggttcgacaacatcgaggagtcgcaatacctgcagattccgctcaccaccatggattcgcgtctggagtggaccgcgcctaccgccgtcgagcggattctagggcgcatccgcggtgagatcgctaagcccgagttgttgatgaccgattgcaatgtgattgtgcgcgacagcacgcggtgaatctcggggattacgggaaccacgctctcaaaactcgcagatacaggccatttttagtgaatttgaccctgtgagttttgagagcgtataacgccgcgtttccctatttgaggtcggtggcggcatgtgctccgtcccgcgaaagtcccgtttcactggccttggatgggacttttgccggatggggggcgctgacaatcgacataatggcggcctggtgggcgttggcgggggttgtcggtcggaggccggctggggtggtcgagggatgcttcggccatgggtcttgcgtagaaccgtggtgcgcgtcgggtctgatttgtcgcgacacgcccggagtggtggcacaattgcgaggctggttattgcggatcggaggaattgagcggttcgtcacgactgcatatgacggttgtgctgcgcactccgggcgtgtcgcagctgatggcggcggcgtcgttgacgggctggtgaacggatggccgctatgacggctgatcgatcggtgcaggggccggcggcgttgtctgccggcccctgcaccgatgccgccaatcgcgaatcgtatgtcggtcatccgatatgatggcatactggtgtagggaggctcggcatatcgccatggcatatgctccgaaccggatgtagtgtgaagacaaggagacgaccatgctgggaaccagcgatctcgccgttgcggcggctgctgcgagcgtgccgggaatcaaactcaatgacggcaacgtgattccgcaaatcgggttggggctgctgcgaatcgagaacgatgatgtcgctcccgtggtcaaatcggcgttggcggcggggtaccggcatatcgacggagccgcgggctacaacaacgagggcggcgtcggccgcgccctcgccgaaaccggcttcaacaaggggcgcaagcgcagtcatctgtgggtcacgaccaagctgcgcgactccgagcaggggtacgacatggcacttgcagccttcgaccgacagctgggactgttgcagctggaatacgtcgacatgtacatgattcattggccgactccgttcaattggcgttccggagcgacctggaaggcgttcaccaagctgcgcgacgaaggccgtgtgaagacgctgggcgtgtgcaacttcctgccggagcatctgacccgtctgtacgaggagaccggcgaatggccggcggtcaaccagatcgagctgcacccgacctggcagcagcgcgaagtcgtcgcattctgcaaggagcacggcatcgcggtcgaagcatactccccgatggctcgcggcgccgatctgaaggccggcaacggcacgatcgcgcgaatcgccgaggcgcacgaggcgtcgcctgcccaggtgatcctgcgctggcacatcgaaaacggcacgatcatcatccccaagtcggtgcactccgaacgtcagcggcagaacctcgacctgttcggcttcgcgctcacgctcgatgaacatgccgccatcgacgcgctcgacggtccggaacgcgcggggcacgatcctcgcacgttctcctacgcctgatccggcggggagaaaggtacgcggcgtgagtccgggcttatgccgcgcgcctgagccgacgacgataccaccgcgcagcccacgagactgaccgcagaaccaacgacaggccgattgaccgtgcgcacgcattttcgcaaacgccgattccgcggatcatccccgctggaacgtcttatgatactggtggtgatcgccgccctgctcggcgtcgtcatcggtctggcgttgcccaaaatcagcccctccatcggcgagatcaccggcgaatacattgcctccggcccggcggcggacgcgctgaacgggctgcaggtcgacgaccggcccgactccaccggctacgaccgcgactccttcggattccgcgccaccgacgatgatggcgacggctgcgacgtgcgcgacgatgtgctcgcccgcgacctgactgatgtcatattcagcgcagccaagcgctgccaagtctcctcgggtacgctcgccgacccctacaccgggaagaccatcctgttcgtgcgcggccgaaacaccagcgccgccgtgcagatcgaccacgtcgtggcgctcgcaaacgcctggcaatccggtgccagggactggaccaccgcccagcgctaccgcttcggcaatgacccttacaatctgctcgccgtggactcgtgctgttgtgcgtggtcgcctcgggcgtgtgcgcgatcatcggcaaacgcatgggcagcccgatgatcgtggaatccggcggacagacctggagccgcacgctggtgacggccatcgcgtggatcgccggcgtcatcctcatgctgatcgcggtgctggccatcgccgccgtgttcgcgccgctgctcggcttcgccgcctgaccttggcgacgcctttccatccagggccggccgggaagggattcccgcgccggtcctcgcatgtcggacaagaatcaaggaatcccaaaaaacggaaggaacgcgaatgagactcgtcatcgcggaaaagaaatcggtcgccacggccatcgcgcaggcgttgtgcgccgcgcccgtccaaagggacggatgctatgagtgcggccagctgctcgtgacatgggcgcagggccacctgatcgaccttgccatgcccgaggactacaaggacagggattggaggaaatggagtctggacacgctgcctgtggacccgtccggccattggcggtggaagatcagcgaggagcgcggtgccggctcccgctaccggcagatcgtgcaattgatccgccgaacggatgtggattgcctcgtcaacgcctgcgaccccgaccgcgagggtgaggccatcttccgccgcatcgcggacatggaaggctctcacaagccggaactgcgcctgtgggtggcgagcctggaggcggaggccatccaggccgcgtggcgggcgatgaaacccgaatccgaataccaagggctcgcatggtcggcggagatcaggtcgaaggcggactggctgatcggcatgaacgcgagccgcgcgtactcgctgctctacaacgcacggttcagcgtgggccgcgtgcagacgccgacgctcgccatgatcgcggaacgcgaccggcagatcaggaaccacaaaccggtgccgttctggaccgtgatcgcggacatgggcggatggcggctctccagcgaacggatcgacagcaaggatgcggcgatgctgctgtgcggccaggccgaacacggccgcttccgcatcatgtccgtgaaccggaggcgggtgaacgaccggccgccccgcctgtatgacctgaccggattgcagaaggacatgagccgcatgtacggcatgaccgccgcacgcacgctccaggcgttgcagcacctctacgaactcaaactcgccacctatccgcgcaccgacagccggtacatcacgcacgacgacctcgaaacgctcacggcgctcctcgaatccggccgtctcgcccaagggttcgtcacccgcgagggcatacccggacacccgcgcccggaactcaccgtcaacgacaagaaggtggccggccacaccgcgatactgccgaccatgcaattggacgccgggaagctggaaggcctggacgatgacgaacgcaaggtgatgacacgcatcgtgcgccgcatgtgggaggccgtgggcgacgaccatgtgcacatcgtcaccgaggtgaaggcccggctttccgacgacaccgacagggagttctccagtcgttccgacgagaccgtatccgcaggatggaaggccgtcgaaaccggccacgggcccgaaccggaagacgaggaaaccgcgaacccggcgggaggaaggaacgtgatcccatcgaacctcatggaaggcggcgtcattcgcccggtcgggaaggtcacggtcgaggaaggcgagacccggccgcccaaaccgttcaccgaggccacgctgctggccgcgatggagcacgcgagccggtgcgtggaggacaaaaacctcaaggcggcactcgatgacgacgaatcacattccggcggcatcggcacacccgccacccgcgcggacaccatcgaaaagctcgtgcgctccaaactcgtggaacgcaagggccggcaattgcacgccaccacggaaggcgaacgcctcaccgacgtggtggagccacgcctgaaggacgtgctgctcaccgcacggatggaacaggcgttgtccgacgtggaacacggcaaacgggacccgtctgaggtgatggacatgttccaccgggaggcattgcgaatccccgccgacgcgaccgcgaacctcaaggccgatgccgtcacacgaaccgcgaacaccgacgcgcaggaatggggcgactgcccgcgctgcggccagccggtgaggaaaaccggccggatgtggcagtgttccacgaacaagaccgagaagaccaaggacggcaagtgggccacgaccgcaggctgcggatggaagatgttcgcgcgcatcgcgggcaagaccatcaccgaccagaccgcgcgcaggctcctcgcgggacaatccgtcaccctgaagggcttcacatccaaatccgggaagaagttcgacgcggccatccgcatcgacaaggaacgcggcacggcgttcgacttcgaccgctgaccaaacgccaaccatccgtgcccgacgcaccatgccgcgccgggcacggcaacgaccaaggagacgatgaaaccatgcgacgatacagccacgccttccgggtcctcatggaccaggagctgttcaatctgcttgccgaggcctccaccaagacgggcatacccaaatcccgtttcgtgagatacgccatccagccgttcagctacacggaactcgcccccggcaccaccgattggaacgacgtgtaccgcaccgaccccgaccccgaacatccgctgaagcagggacgccagctcaatgtcatgctcaccggcgacgaatacgagatgctgtgccgggccgcattcaagctgggcatcgcgcgcagcgcctgggtgcgggaacgggtgtacgcgctcctctgccgctcctatgcggacgagctctccccgctcacggacgcgagcatccgcgacaacgcgacgatgctgctcaaggagctcaagacgaaggatgcgggaagatgacattccaaaaaaaggaagagccccttcccattcgtggaagaaggcatcaccccgaacgatcatccaccctcatgcgttttcctatgcgctcatatggatatgtccatggatacccacatggacacgtccatggacacccacatggatatgtccatggacatccacatggagatgcccatcaaatcgaaggtaagcaagctagacggttcatgtacatgaaccgaacgcagcacctcccgcgcccgtcggcgcaggagcaacaacccgagtgccgaaggccgatggaggaggagaaagaataatgcgtaaaagaagcagcaaaggcggcggcgcgcagcgctccatccaagtgcatctcatggtgaacgaagaggaagccgcgatgatccgcgccgccgcgaggaaacggaaccagacggtatccctcaccatcatcgaagcggtaaagctgttggagggaagcctgtacgtcgaggaggaggaacatgattcgcccaccgtccaggcgctcagggagatcgaataccagctgcgccgcatcggccgcaacgtcaaccagatcgcgcacaacgcgaacagggagatgaacgcgaccatcgaggacgaggcatcggcgtcctacgccgtccggcaatgccgggagctgatagaccatctcgatgccgtcatcgggcagtccgggggagtgcctgatgacgcgaaccggtcagaggagggtcaggctttgcggacggtccgcttgtagtccttggatttcttcgatgaaccgggagaacgtcatggtttctccctggatcaggtcgtcataggattccttgactaccttgggcatgaccaggtggatgtgcagttcatcgagttgggcgagcttgggatgggtcacgtcgccgggagtcagggtgaacaggtgtttgtccctgatccggttggcttcgtcggcgacctggcggaaacgatccttgatggaggttttcgaggcgagcatacgcagctgttcctcggggaacgccggatcctcgtaggcggcttgcgagggaaacaggaaatcgggtttctttccgttttccgtcttggcctgcgcctcgtattcgatgccgcgcgcgtcgaggatgtgggcgatgtggatttcgaggaccttgcctgcgcggctcatgcgccggttgcgcacggaggtgtagaacgaagtgaacgagtcaacgtcgatgacgccatccgatacgaatggcgcggcatcgtagtcgtgttggatgaccgcccgctcatagagtttgaacagcaggtagctgcggtcgtagtattcgatcaccacgtcgtcagggtcatcgtgcgtggggtccacgtccgtcaaggaggattgggagaaggccgcgaactcctcgttgctggggaacctgtatccccatctgccgatcatctcggggagatacgtgtcatcccgcacttcgacgttgatgccgagagcttcgaagatctgcgcgccgaaggcgtccagctcacgttccgtattgtcgtggaagcggaacgcgccctcctgttcgtcgtcgatgccgaagagccatttggcttgggcttcggccgtgctgtcatgctgtgcgatgatgatcagcaggcgattgtccctgagcataccgaagcacatgaggtcgccggggcgggccatgcggattggctcgcagtccttgtagtagagacgccattcggcgctgcggttcgggttgttgcgccgcgcgtcgtaccatgtggtttcgaggtcggcgaccgccggtgcgtcatcgtcgctcaggtacatgagcgcggtgggtatgccgtgcccttgtgaggctctacgatcctcgccggtgccgagcagtcttctgagcgcgtcgttgccgccgaactcgtgctggttgctgctgttggcgtcgatatcgacggccgacagtttcttggccgcgaccgggccgatgtagtcgccgattcttccgtaatcgctcataatccatgagcatagaccaatcggacaggaaacgcctcgggcgaatcagtcggacaggtagggtttcatcgcctcgcctatggctcggatgaccggcactgcgaccgagttgccgaactgccggtatgcctgcgtgtctgataccgggatactgaacgaatccgggtagcccatcagtcgcgcgcattcgcgcggggttagccttcgagggttctttccctcgccgcgtgagaccagtatctcgctgccgtcctttccgtaccgcgcgctcaacgtgcgcgtgtggtcggtggcggcatcgaccatgccatatccgaaaccgttgcctgcggcctcgtgcttcttcttgtagttctggaggtacgtccacagcttgtcgctcagaacatacttgtcgggaacctgggaggcgggcaggaggatgctgccgacgttgccgtgcgcgatgggcttcacgtcatcgaacgtgaacccgttctcctcgcggaagcccacgatgtacgtgcgttccctgtgctgggggacgaagcccgccgcgtcgatcagcttgtaggtgacgtggtatccaaggtcttcggtcagcacggaatatatcgtcttgaacgtgcgcccacggtcgtgcgagagcaggttcttcacgttctccaggaggaacgccttcggctgcttcgccttgatgattctcgccacgtcgaagaacagtgtgccttgggtcttgtcctcgaagccggtgggacggcccatgctctgtttcttggagacgccggcgatggagaacggctggcacgggaatcccgcgagcagcaggtcgatgtcgggaacgtcatgctcgtcgaccttggtgatgtcgccggccacgggattctcgtcgtgccagttcgcctcataggtctgcacgctgtacttgttccactcggacgaatacaccacgtgcgcggcatcgcccagcgcctgcaccattcccatgcggatgccgccgatgccggcgaacaaatccgctatcctgatctcactcatacggttcctccgattcccgagaaacccaggatagcacatgagaagggcgcggcccgacaccccgcgaaatcatcggctgcgtagacgccatggttcgtcgtatcggcgtcaatgtgaaccagatcacgcacaacgtgaaccgcgagatgcacgccagcgaacgcgacgaggcaacggccgcgcacacggtgcggcagcgccggaaacttataggccggctcgaagtcatcatcacgcaagccgaccgtaaataatcccatggagttcgggagcacccccggacgccacgaccgtcacctcagtaagccggaacctccatcgaggccatcgaggggaacaccgggcacgatgcccatcccgttcgcggcatcattcgtcttttccgcggccccagacgattgggccaaagtcagcccgccgggcacatggccgacggcgttctgtgagagccaatcggagagccgggagtagtcgcccgtctcgtagtagcgcaggagcatagagacgaactgtgccttgtcttcgggagggatcgagaagacgccgatgccgtcgtgtatgagctggtggttggcgaccatcagcgcggtgcgcttgttgccgtccgaaaaccattgtccccgcgtgaccgcgccgaacagcagcatcgcagtgtcctccccttctgactcctccaggatgccgcgaaccctttcctgtgaggattcgacggtggggatctccggcacccatcccgtgccgccgatcctcacgccgtattcacgcaagcggccggcgtcgcgcacgaggccttcgccgatgatgcggttgtattcgcggatgtactgccaatcgactggataatcgatgttgtcgagcaggaacctccacgcgcgcttgatgttgttcaccgtgactatatcgtccacgctcataccctcgggggcgcgcccgtcgaagatctcctgcgtgtcggggaaggtgacgccatcaacctcgatcttggcggtgcgccagatcgaatcgaccagcagccgcttcgccagttccacggccgtgcgcctatccgccgtcgtatcgttcctcaccggttccatcaaagctccttgtccgtttccgataattctatcgaagtggccgtgccggcaaaggacgcatatctctcatagacgccatgcgccgccgtgccgggcgcgcggacggagaatcatcgtatgataccgaatatcgtcaggggttcggacccggccggcctggtgcgctacctgttcggcaagggacggcgcaatgaacacaccgaccagcatctcgtgtgcgcgagcggcgacatgtttccctcgtttgacatggatggcaagccggcggtgtcgtatgcggagataggccgcaggttcgaccgacgctaccgcgtcagggaacgcaaggacgatccgttcccgcccgacatgcgaggcaagaacaatcccgaacgagagcatggcaggaagcgcgtgtggcactgctcgctcgccatcaaggccggccacggaatactgaccgaccaggaatgggaggccgtcatccgcgattatctgacgcgcatgaacatcatcgacggcgacgacgatcagggcgtcacatggctcgcggtccgccacggactgtccgccaacggcaacgaccacgtgcacatcatggtgcagctcgccgccgacgacgggtggataaacccgtaccacgaccggatcaacgcgcagaaatcatgcaggcggatggagaagacacgccccgaactggtcgagctcgcacgctccgacaccggcacgcgcgtcagctggcagtacgggcaatggcgtcaatgggccgaatggaaggcgcgaaacgagtacggcgacgacgagggatgggatgcgttggacggcaacgagagaagccggctcgtcacggcggtcgccgcctcaacgatgccgcgccagcatgtcggccggatcgtggaggcgtgcgccaaggcatcgcgcagcgaggacgagttcatacgccgcgtgcgcagggaaggcttctccatcgaccccaggctgcgcaggggaaccgccaaagactcgttcaccgaccccggccaggtggtcggctacaggatcacgtggcgcagcacggacgggtggacggaacggttcaacgccttcgagctcggcgacgacatgcgattgaaacgactgcgcgacgactgggcggacgatgccagaagccgcgccctggccgtgcaggaatggcgcgccgcgatggagaaccgcccgcccttcctcgatgatggacgcgaacggcacctggagaacctgtccacgcacgacatggaacgcctcgtatccgaagcgttctgcatcgccgccagcctcaacaacgcggcggacgacgacgaataccgggcagcgatgcgcgagggcctgcacacgttcgacatgctgcgcgaacgctacggaatcgcgccggaatacggtctatggagcatggtcgcctctgacgaggagaaccggccccgccgttaggacgcttcccggaaaaagctcagatggtacggcccgaggaaggaaaaccgagcgaatcgggcaaagccgatgctggatcgagagagttcgccggctcgtctcccggcatgatcggctcgatggactcgttcgccttcgtccagcacgcgttcaggcgatcggccatccgcgcgtccaggccctcgcaggattcggatatgccggcgaggaccttccccgccatacgccgggccatatccgccaccctcgaaccatcgagaccgtgacgtgtcgccagatcctcccaatcctggggcgtggtgtgctccgcgaaggcgtgatcctcgttcaacggcatggtgagttcccaattgaactcgggccaatacctggtggcgaccgcatcatactggggagacaggcgtatccccgatgcgggatcgaggatcagggaatagttcttcgcatgtgcgtcgctgttggcggacgacgtgttgaaggccagcctttcgagccaccggtaggacagggaacccgacgcatcgatgcgttgcaggagatccaggcagtcatcggccgacggatcgtatttgtcgcgggtcggcaatcccaacgcttgcaggaagtcctcttgccgcagtcggacgattcggccttcctccaggcgacggtcgaaccgttccacgatataggccgtcttgcgctgcgccgtgatctcgccgcgtgccggtgtgtcgatgccgcacagttccgacaatcgcatcgtcgccagttccaccttggtcgcctcgggaaggtcatggggcttcggtttgacgatgtgggtggagggcagcatcatatccggccaataccacttgccgtccacgcgggacagtgtgaacttgccctgcgcccctcccaaggagaaccggcagtggctgtcctcgtcccaccagtagttcctggtccgctcgatgcggtcgatttcgttggctatctgggaatcggagatcagacgaagcgtcggcgatgggattggaggttccggggagagggagaacaccagtccgccggtggcgtcaacccggtccagcagatcgaagacgccggccgaggaggcattcaggtgctcacgcatggcctggcggacgttcggattgtcgggcaatagattgtccaggaagttacgcggtgcctggtctctccatccgccggttctgggcaggctcagactgatcggcagaccctcgttcgcgtcgtacgcgaacgatatgcgctcctcgtcgtcttccgagaacacgcccacatgatgcccgttctcccaggcgtgcagttccctcacagcagtctccccgcgtaggcggacggcagcgtttcggtgcggatgtgcagcaggtcgaacatcctgtacacgtagcggatggaggtcagaccggtctccacgagctcttcggcgcttgagagggggaccccggctctcctggcgagttcggcggcgtcgagacccatgacggacatgcgttcgcgcacgcaacggcggaccgacgaggtgtcggggaagaaccgcgccgggttctcctccttctcgtcgggaagacccttgtaggcggtcagggcatcatatttcgacagatccaacgtcacgtgtgccatgctcgtcctttccggttccgaaagccgttgacaccatgatacggccatccgatgccggcgcaccccacgaacctcatggcaaggggtgcgccggcatcggcgtcagcgtgcgttgccgttggtctcgggttgcaggatctgcggcgtcgagacgttggcctggtcgggtatcggctggtccgtggggttcatggaggattccatggcgggactgtattcgccgaacgggtcgggcccgttccattcctcgggttcgttcaggtcgagtggcatctcctcgtatccgtcgggctccccggtcgtcaggtcgccgcctcccgtggtctcgggctcgggtccggatgccggtttgcgttcatcggcggcgggcttcgtatgctcccgcacgggtgtgggggtttcgacgattggcgcggcgtcagcgttctcggtgcgttcgacctcgcttatggtgctgggctcgtctcctgtggccttgttgtccgcgtgcgaggattccggcaggccctggtccttgaggaagctgattcgggaggcggcgtcgtccacgccgttgaccggcgcgcacatcacggcttcgacgatcctgtcgtggtcgtagcccgtccattggccggtcaagcgcgagtccacgaagaacgtggcgtcgtcgccgtgcgcggcctggaacgcctgcgtgtcctccacccgttgcaggtccacgggcacgccggccgtgttgaaggcgttcagggtggcctgcaacgcgggcgactggtcggtgtaggtgatgttcacgtggttggtcaattggtcggctgcggcgtcgatgtgcgtttccgggtggcgtttcgaccattcgtccttcagccgggccttcgcctcgatgatctgcctgcggtagccggggtcgttgccctccagttggtcggcgaccatccatccttgcaagagggacgagtcgcgcatcttcctccagccgtcgccgtcggcaagcacggtcgcgttcagggtggactcgaaccccttgttgaggcgttccctgttgtccatctcccattgttcgaggcggatggattgctgctgccgtctggtctgctcgtagcgttcgttctggacggcgcgttcggcgcgttccctgcggcgcgcgcggtcgccgctcagctcgtcggccgcgacaccgccatcggcaagcagatttggcagcagatagacgcgctcgacaagaccgtgaacacccagcagggccagctcgacgccttccacaaggacacgtcacagttcatcagctccggcaagagcgcggccaccagcctttcggacgtcaccagcaccgccaccggcagcggcatcggcatactcaaccgcgcacgcacgacgctcaccggaaccgtcaccccgaacctgaccgcgggattgagcaacttcgccacgctcagcggcacaatcgacggcacgctgtcatcgctgtcatccacgctcggccagtccgacagcctgtttgacgagctgtccgacacgctgagccaggcgaaaaccaccgtggccggcacgcagaaatcgctcgccgacctcaccgacagcgtcagcggcgtgcgcaccgacatcgccgcgctcggcagttcggccacataccagaaaatcaagcaggccctgaacatcgacggcgacagcttcggcgaattcatgggcacaccggtcaaactgtccactaaaagcgtctacccgatggacaactatggctccgcggtcaccccgttctacacgaacctggcgctgtgggtcggcggcttcgtgctcatcgccatctacaagctagaggttgaccgcgagcggctcggcgacgtgaccgcgtcgcaggcgtatctcgggcggtggctgctgttcgtggtcgtcggattcctccaggccctgatcgtcatgatcggcgatctggtgctcggcatccaatgccagcgtccggtgctgttcgtcctcgccggtctgttctgctcgttcgtgtacatcaacatcatctatgcgctcgcggtcgcgttccggcatatcggcaaggcggtcgccgtgatactggtgatcgtccagattccgggcgcgtcgggcctgtacccgattgagatgatgccggacttcttccgggagctgcacccgtggctgccgttcacgtacggcatcaacgcgatgcgtggcccgatagcgggactctacggcaaccattactggagcgacatgctgcatctgttcctgtacctgcccgtcgcgctgttcatcgggctggtcgtgcgccggtacgcgctgaacctgaacgcgctgttcgaccggcggctggccgaaaccgacctgatgatgaccgagcacaacgcgatggtcaacgagtcggtgagcttctcttcgatcctgaacgagttctcgaacaccgaagagcttcgcaaggtgatccgccgtcgcgcgaaacggttcttcgggcgctatccgcggctgatccgcgccgggctggccctgctgatcgtgctgccgttcgtgttcctcatcctgctgttcgtcatcccaaacaaggtggcgatgctgacgacgtggatcctgtcgataatcatcatcgatgccttcctgatcgtggtcgaatacatgcgggaccggtacgcgcggcagctgggcgtcagcgccatgagcgcggacgcgttccgcgacgccgtgctgcgtggatacacgcaccggcacctgacgttccgcacgtccgggaggtcgccgcgcaagcatgcggccgtctccaaggcggctcgggacgacggtgatgccggggccgccggcgacggtgacatcggggagctcggtgaactcgacggccttgactggccggcgcaaccgatttcaggcaatgacgatgccgaaggcggcaataacggcaatgaggagagcgccggggagaccaccgagcagataccgcccgcagggcagatgccgttcgccgggcaggaggacgagacgcgatgaaaaatatctggaggatcttcacgcgcgacgtctgccacgccacgcgcaacgtcatcgcgatcatcgtggccatgggactgatcatcgtgccggcgctgtacgcctggtacaacatcgccgccagctgggatccgtacggcaacaccaaatcgttgaaagtggccgtggcgaacgtcgacagcggatacaaatccgacctgatcccggtgcgtgtcaacatcggcgagaccgtcgtcagctcgctgcgcgccaaccatgacctcgactggcagttcgtcgaccgcgacaccgcgatcgacggcgtgcattctggcgaatactacgcggcgctgatcatccccaagcagttcagcgccgacatgatgacgctgttctcgccggaaatgaagcacgccgaactggagtactacctcaacgagaaaatcaacccgatcgcgccgcacatcaccgatcagggcgcgtccacggtcgccacgaccatcgaccagaccttcgcgaagaccctcgcgcaggtcgccctcgacctggtatccagcctgctgaaattcgcgcaaagcccgcaaatgagcgagtacgtatccaacgccacgaaacacatttcgtcgatttcgtcgcagctgaagtccgccgcgtcacaggccgactcctacgcaagcctgatgggcgcgacaggcaaaatcatcagctccaccgaccgtctgctcggctcgaccggatccagcgcgtcggacgcgaagaaagcgctgaaacagggcacggccggcgtgaaaagcctggacgaggccctagccggcgtctcgacgagcatgagctcgtcgctgtccgacgccgcgggagcctacgacacgatcagcaagcaggtggacaccgcgttctccgacatgggctcccaatcctcccagattaccgacaagctcaccacgctgcagcgcaacatccaatcgcaggccgacacattcggcacatacgcggaggcgctgcgctcgctggccgacgccgcgcacctgcaggcggtcaaggacgcgctcaacaacgcggctcagcaggcgcagaacacgcagaacagtctgcagaaggtcgccgacagcatcggcgacgcctccaagaaaatcaccgacggcaccgccagtgcggacgacacgcgcaaatccctgaagaagcagatagccgccgcgaagcagtcgatcaccgacatggcgaacacgtacgacaccacgatcaagccgcagctcgacgagctgggcaagtcgatgagcgatgtcgtcaagcagtcggggagcgtcatcgacggactggccgccaccgccaccagcatgtccggcctgtccggcgacatcaccggcagcctgtccgacgtgcaagcctcgttgggcgacgcggcgaccaccctgaacgcctcggccgagaaactcgactcgctcaacaagcagctgacggcggtcgtcggaggcagcggcatgcccgatctctcgcagatcacgtcaaccgaccccgattcgatcgccacgctgctgtccgccccggtctcggtgaaccgcatcgcgctgtacccggtcgccaactatggttccgccatgacgccgttctataccgtgctgtcgatctgggtgggcgcgatcatcctcgtcgccatgatgaaggtgtcggtgtccgaccgcgagaaggcgaaggtgctcggcctcggcgaaacgctgccgatgggcgagacgatgggcgtgaaggatgccgtgatcgccggacggaccgcagggccgggcgcgatgctcgacgtgctgcgcaagccacgccccgagtcgcccggcaacgcgcgacggttcggcctgcacccgtatcaggagtatttcgggcgatacgccattttcggcgcgatggcgctgctgcagggcacgctggtatgcctgggcgacatgttcttcctcggcgtgcagtgcgagcatccgctgcagttcctgatggtcggctggctgtgcgcgctggtgttctcgctgctgatctacacgctgaccgtgtcgttcggcgacatcggcaaggccatcgccgtggtgctgctggtcatgcaggtggccggctcgggcggtaccttcccgatcgagacgttgccgccgttcttccagacgatctgcaagtggctgttgttcccgtacggggtcgatgcgatgcattcggcgatggcggggtcgttcggcaacgaatactgggtgtcgatgggcaagctggcgctgttcatcctgccggcgctgctactcggcctggtgctgcgcaagccggtgatgcggttgaatgattggatcatccgcaatctcgaatccaccaaggtcatgtgacgtgagtcggcgggcgagcggtgggctggccgcgcgggtgcggcggccggtagccgccggttgccggccgtccggccgcccggctgtgacgccggacgaagccggtcgtttccccgcccgtcgccggcgtgaaaggcggtacagtggaggctatgcaagtgaagcttatcgacgagaaccgctatgcagacgagatgcgcgagatggtgctgcccgcgcttgccacatgccggtccgaaggctggatggcgccggcggacgacgacggtctgccgccgctgcagcgtgcgggcaaactgcattacgtgtgttacgacgcggcgaaattcgaccggttgggcgaggacggtgccgccgccacattccgcggtgccgtggtgatctcccacgggttcacggagttcgccgcgaaatatgcggagatggtgtggtacttcctgctcgcagggtactcggtgtgcgtgttcgagcaccgcggacatgggtattccgcgcgtgacgtcgacaattcgtccctggtgtggattgatgattggcggcggtatgtggccgatctggcgaaattcgcggagacggtgggcaaggattacgcggatggccgtccgctgaacctgtactgccattcgatgggtggcggcatcggggcgagtgtgctggagacgcatccgacgctgttcgacaaggccgtgctgtcgtgcccgatgatcgcgccggtgaccggtatgccgaactggctggcgtcggtgcttgccggcgcgatgtgccggctcgggctgggacggcacatggtgttcgggcagagtgagttcacgccggagctggatatggccgattacgagggcgcgagcgaggcccgcgtgcgctggttccaacagcagcgcatcgacgacccgcatcagcggacgttcgcggcgacattcgcgtgggtgcggcaggcgctgcgactgtcgcgtgccgtgcagcggccggaggcgtgcgacaatgtcgagacgccggtgctgctgttccaggccgggcgcgacgtgtgggtgctcaacgagccgcagaaccggttcgcgcaggaggtcaactccgatggagggaatgtgcgcgtggtacgcatcgagaactcgctgcatgagattttcagcatgcccaatgccgttcttgggccgtatctggagcggattctgggcttcttcggctcatctgagatgccgacgttctgatggtttgtgacggatgccgaccggatgagtccgcaaggaaagatgtcgtgaaacctgccgtgaaacatatcgtgaaacagtcgaaaacgccggccgccgagtcggcgcccgagactgcatcattcgagcgtacgccgaaagccatgctgctgggtgccgtgctagtgctgcttggcggtgtgctgtggggcatcaacgccacagtgtcgaaattgctgatggccgactatcacgccgacccgctgtggatcgcctgcgtgcgcgagctcgcggccggcgcgttgttcctggcctgtgccggtgtgcgtacgccgaaactattggcaggtgcggtgcgcgaccgacgctcctacccgatgctgctgctcgccgcgctgacctgcgtgctgttcgtgcaggtctcgtatctgtccgcgatcgactggacgaactccggcaccgcgaccgtattgcagacgttgaacctgctgttcgtgctggcgtatgtgtgcatacgcgggcgccgctggccggggctgcgcgagagcatcggcgtggcgttggcgtttgccggtacggtgctgatcgccaccggaggagatctttccacgctgaagctgccgctggtcggattgctatggggcctcgccgacgcggcgtgtacggcggcgctgtcgattctgccggccaagctgatagcgcgatggggcaatcttgcggtcaacggcatcatgttcgtcatatccggtttggtgctgatgccgttcgtccgcccgtgggccagcgcgccgcagctggattggttcggcgtgctgctgatggtgttcaccgttgtcggaggcacgttcggcgcatattggctgttcctggccggcgtgatgcgtatcggctcgatgcgcggcacaatgctgggtaccagcgagccgatcgccgcgacgatatccgccgtgctgtgggccggtgcggtgttcacgcccacggatttcgtcggcttcgtgatgatcatcgtcatggtgttcctcgtgcgctagcacgcgtggcccgcatgccgacatacggtctctctcgcgtgcgacgcgcttcaccgactgtttgcgttcttaagtgcgcgccgagacgacaagtccgcgcacataggaacgcaaacagggcgatttacgttcctatgtgcgcatggtcgtcgttttggcgcgcacttaagaacgcaaaaccacgtttcgcccgccaggccaggcgtcgcgggatgtgtggatagtgataggtgagcatccgaatgcatagaacgggggctgccatgcatgagtcatcgtataaggccggttcggggcgacgttatcagtccgggcaggggcgtccgggtcgcgttccgcggatcctcgccactgttgtcgccgtaatcgcgctcatcgtgggcggcctcgcactggttcgggccgtcgcaccccatgcaatcgcgaagctgacagcggtatccgtgcgcagcctggcaatcggcgcggcggcgctgatcgtcgtcgccatcatactgatcgtcatggctcgcgtggcttcccgacgcggcaaccgagtgagcgtgcgtggaaccgcaggcggagccatcgtcgccgtcgtattcgcaatcatgctgaccgtagccgcgctgctgatctccaacctgttcaaggacggcatcgtcaagccgtcatcgcccgacaagtcacctgctcagagtgcgcagaacatgcaacaatcagttgaggaggctggcatctactgcgagtccggctggtcggaactctcatcgcaagggtatccgggtgtgacggacgtcgagatatgcctcaagccgcgcatcgcctacgtcacgttcgataacgaattcgctgccgacatgtaccgcgcgcctttgcgatacaaaatcgccgagatgtttgacgagcaagcgaacagcaccgactccaagggagactggcggctgttgagtggcaagaaatggtcggtattcagctacaagaccatcattggcaagctccagaagcagtggggtggaaccgtcgagaaaataggatgacggcggatgatccgggtgcgatgcaaccgcggcacatgaggcgcggacgcggtgctccgcgaaggctatgatggaaacgtgaatgacgtctcgaatcagccggcagcgaagcccccagccgaatcatcctccgagtccaccgaatcctcccgtttcacacgcggagacagcacgctgaccaccgtagggcggatcgtcatggtctacgcggtcgtccagctgctgatggcgatcagtgcgctcgcgtcactgtccggccttgatcccgcggcttccgtgcaagtgatcggcgggtggcgcatcggcctgcgcgtggcatggttcacgctcggcctggtgttcgcgggcaattgcgtgctgtatctgatcggcggatggctcggccgccgggccggagcggacacgtccaaatcccggccgttcatggcactgatgtggctttccgtggtgaccacgcttatcggtctgctcgccgcgcgggcgaccacatccggctgggaggcgtggttttcgcttctgatcgccgtgatactttccctatacgcgaccaaagtcgtaaagcgcagcacgcgcatctgagcggtgacatcggcggctggcctacagacgagcgaaacgccgccaatcgacggtgctgtgagtgaacgcaacgcaaagaaaaatcaggtatggtgagacgcatgagcgagcagaacaatcacgatacaacaaacaactcccggcgcaacccggccgcggcggacggcccgtccatgcagacggcctatttcgcgggcggatgcttttgggggctggaacgctacttccagaacgtcgacggtgtcaccgacaccacggtcggttacgcgcagtcgaaggtcgaatcaccctcctatgagcaggtgtgtgcgggcgtcaccgacgccgcggagaccgtgaaagttgtgttcgacccagcgcaggtgacgctgcgcacgctcacactgctgttcctggaggtcattgacccgttctcggtggaccgtcagggcgaggacagtgggcggcagtaccgcaccggcatgttcttcacggacgcgacgcagcaatccgtgtatatcgccgcgctggagcagctggtcgatcggcagcccgcccgcccggcggtcttggtcgagccgctgcgcaacttctacccggccgaggcgcaccatcaggattatctgatcgccaatccgggaggcttctgccatattccgctggccgccatcgcgaacgtgaaacggcggcagaagtatgtggaaaagatctgggacctgacgctcgaacagttcgcggtcacgcagctcgcggccaccgagcggccgttcgtcaacgcctacgacgaggagttcgagccgggcatctacgtggatgtggtcagcggcgagccgttgttctcatcgcgcgacaaattcgattccggctgcggttggccggcgttctccaagccgatcgcggacgagctgttgaccgagcacgcggatcatcgcatcccggggcgcgaccgcatcgaggtgcggacggccgacacgcagatccacctcgggcacgtgtttgacgatgggccagccaatcggggcggtttgcggtactgcatgaactccgccgcgctgcgcttcgtgccgcgctcgcgcatggaggcggaaggctacggcgactggttgcctgcggtggatggcgaatagccgttcagagagccgttgcgcgccttttcctccgcgccagccatcgccgccattggccatggactagcgcaacggtcgcgatgagactggccgccgcagccaatcccagagaatacacgaatcccggagtgctgaagccgtgggcgatcaccagggcgttggaaccgatgcagatcgccgcgaacgaggcgagcgtcgcgatacgcagccatggcacccagcgcgccgggattcttgcgacggcgagatacaacgatgcgataacgacgacttgcaggcatgatgcagcgacgaattgccacagcatcgccggatcatgcagaaatgcggtttcggggaacattctgatgatttcgcggatggtgttcggcaggcgccaccatttgagccatactagccaagcgtccactgccactgcgatgccccacgccaatcctgtgcgcaggcgcagctgtggcgacgcgcgtcggatgctgctcttggcgatgagcgtagattctctcatcgtcggctccttcgaaggcgaatcaggtatatcgcacattgtgaaggcgcggttgccgcgaatcgccgccaaacctcatacgaacgggcagacttttcgcgggaaggggcagctatctgcgtttcagggggttgatttcgtgttcgccaaacgtctatctacgtttcgaggggttgccaaaacgcgatgcccggggtattgagcgccaatcgccattggaatcatgcggttttgggggcgtttatacttggccaccaacccctcgaaacgcagatagatgttcggatcaaaccgaatcgccccctcgaaacgcagatagccttctgacagcgcttatctgcgcaatctctcacccgacaaggtgacggtacagctcaggatccagcggccgcgcaagtctcagtgtggagagcgtgaccttcaccgtaccgtctccggccgcgttcggcttggtggtgagcgtcggattgtcaaacgcggcgacgtgcccgacgtaatagtatttgccgtcggcctcttccgccttgcgcatgacgaacagcggaacgaaatgcgtacggccccagtccggtcccacaccgctcagcgcccactggaattcgggagattgcggggtgcgcccgttcttgctgaagtacttcatctcctgtgcgttcaggaactcgtcttcgtattggctggccgcgtacttcacgaagatgggcatggtgttggtgtctttgtcgagcaggtacccgcctacgttctgaggcgtgttctccttcttccatccgcacagccgcatgacgtcggccatggagtatttgcgctcatacaggaacgcatggtcgaaagcgcgtcgccggctctgcgcctcctggaacaggtctcggcaattggccagaccggtgcgcagcgtgtctgcgagaaagatgcgaaacgtgcgattttcggcgagcatgttgacgaagccggagcttaaacgataggccggttcgccctgatcatcgtcggccagcgtctccaccagtggcaggttcccgaaacgtttgcgattcggtccggtgaagtatgagtagtcaagcacgctgatagcggagtcgaactgcgcatccgagagatcagcctgtgggaagtccgcacggatcgcatcaagcagcgcatctcgactgattggcgcggatgcgttccagctgacaggagtctcgtcatccaggcgctcttcggcaagccgacacagccgttcgaggatggccaactcatgagggcgcagcccgggcagcagcaattccgtggccatcttgaggaccgcgtcttcggtgtcggttaccgggtccagctgatcctcaaatgttgtctcgtggttcttgccgccgccgaggctcttctcgcgcgatcgcacgaaatcgaggtagttgctgcgcttcgtggccaatgtatacggcaaggaaggatcgtaggcgtagatatccatgagcatcggaatgcggccgtgatgccggtcttgttgttcatgccggcgagtgacagctggttgcgatcccagtaattgccgttgatggtgatggtcggcgtgctcatgacacccttgttcgaaccggacacctgccacagttcggggcgcttcggggtgtacaggttgatggcatccatccatttcttgtattcgccgttgaacgccttgtcggccacggactgcggtacgccggcgtcaatcgcctgctgcttgagtgccttgttcttgaccgacttgtattcgctggcctcaccgggctggaagtcctcggcgtagatgttcgagatgaacttgagcaggtgatcggggttgtcgtcattgctggcgatgtacaggatggcgccggtggcgcggctggaatattcgtcggtcgagtattcgtccataaacgacatcgggtggatttccaggttgatctggcccgcgtccaccagcgagatcagcgtgggatcggtctggcggttgaactcgccgcagccggggcacagcggatccatgtacacggcgacggtgggggcgccggacaccttcttgccatagccttcgctggagatgaggatgccgcccttgtcgtcggccgccgatggcttggtctcgaccttttgcagctgctggtatgcctgctcctcggtggtgctcttcgccacgtcgttcttgtgaatggctccatagatggcgaagccggcgattgccaccagcacgacgatgatggcgacgaccaccgcgccgatgatggtttgctgcttgcgctccttggccgcttgctccgccttctcctgcgccgccttctcttcggcggcgcgacggcttgccctggtgttgcgcttcgcgttctgattcttttgtgccacagttatccctttcctgccggtttgttgcccatagtagtagaagggttcgcttttccggcggcgggttgcgccgtttgccgcatgatggaacgtgacaatggctacaaaccgggcattgccgttgctcggcatgcagctgggatggggatgttatgcgacgttggagggcagcggccaccagttgatgccctgtccgagaccgagcagcgtgcacgctgagagtgtaatcaccgcccatgcgatccatacggcgaattcacgcccggaatgttgggcggatatcgcgggagtggtttcgttgtcggacgattcggggagcatgcctgcgccgctggagcccgcgggccggttgagaccgagcagggtgccggtgccaagtcgcagcatggtcggtgcgggcgccagcataccgatgatccagctgatcgccgcgcagatggccagagccagacccgacggggacacgggggaggcggcgatgatgggtaccacaatggtgatgccgcctatggcgaaccgcgtgtttacgaccggcagactgaagatcagcgtcgcgagggtggatcccagcgccagcgtcgcgacggcgagcagcccgcgccctattgccgcaggcaaccccctgagggcgtgccatggcagcgtgatgatgcgcatcgcggtgtcgccggcgctgtgtgtgccgccgcgtctgtattcgcgttgcagctgggcgtctgtcgaatagcctatcgtcagcagcagccagcacagcaacgtggctgcgaccattgccgccaacggcatgctcgcggccattgcggctatgggcgctgcccatgcggcaagcagcggcgtgccttgacgcagataggtctggcgcttgatgtctgccgggttcatggccatcggcggcatggcctgcgctgtcggcatggcttgcatggacggctggaattgcgcggctggctggagctgtgcgggctggccgggttgcattgcggtcgtcggcgttgcggcttcatcagggtcggcgaagatctgctgggggctcagcggcggcatggtcatggtggggatttgctggcgccccgaccacactggatcatccatcgccagggttgccgcggtgtcggcggatgatgacggctcgattacggccgttgctccggtcatgtccgcatcgtccgtgggtagggccgtcgtcggctgcggttgcatgggcatggttcgtccgacgctgaccgtggaatcgaatggcatggtggaggcgggcagaaccgatgtcggctgtgggcgcaacgattcggtcgcttcggtgccgaccggcatggtcggcggcataggtggggtgaggcgggacatcggcgccgtctggtcgttgccgggtgcctgagaagacgcgatatttcccggtagcggtgctccccggagcggtacggttccgtccgaggttccggcatctgctcctgtcccgattgatggtatccgtcgaaggctggcggatgcagcgtcagcggcttggccggcgtttgggagcctcggaatcggcggaaccgtcgcatacggtgagggcgccgattgtccgatgatccgctgcaaagcgggccgaacgccgggcatcgcggtttgccttggcatttctgccttggtgacggctgcagtcggcttctcacctgattcggccggctcatgcgggcgccataacagacgcgggttgcgcagaccggtatggtcaaaagggcgcatcacatccgtctgaccggattgcgcggcgtcatcgtcgtactgctgccaggcgccggggttgaacgcgtccacggtgatcgcctgcagcagttgctccggagtgcagcgcttgctgcgatccgggttcagcgccgcacggaacgccgtcatggtggtggcgggaagacctgtgaggttcgcgttgccggacgcctcgcgttccagcaccgccatcatcggcttggtgccgaaaacgggctccccggttgctgcgaatgccagcaccgacgacacggaccaccagtccgtgatctcatcggattcggttccctcgataatctccggcgcgatgaaccccggcgttcccatcaccaggccggtgcgcgtcacatggctttcgccttcgcccatggcgatgccgaaatccaccagaaccgggccggtcgctgaaaccatcacattggtcggcttgatgtctcgatgcacgattcccgccgcatgaaccgccttgactgcgtccatcagcttggatgccagtcgttccaggtcatcggcgacgtatggcccattcgcggcgacgtcgtcgcgcaggtttttgccctcgatcagctcggtgacgatgaacgccagcgaatcatccaactccatgtccacgatgccgcacacgccgggatgattgactttcttcaacgccatcgcctctcggcgcaaccgctcacgtgccgtgatctgatcgcgcgcggacgccgtcgaacggtcatcggcgagcgaatcacgcaatatcttcatcgcgtattcctcgccaccgtcatcatgcacgcgccagaccgatcccatggctccggatcccagccgcgacatcagcgtgtagccgccgaccaacgctccgggctccaaattcaacgcatcgctcataccctcctatcctactcaccgccctgtgcccgttctctctacccctgatattcctccttcccctgctgtcctctccgatactctctacccccccctgatatcgtttgcgttcctaagttcgcgccgaaacgtcgattgtgcgcacttagaaacgcaaatgggccggtttgcgttcttaagttcgcgcacttgtcgtttcggcgcgcacttaagaacgcaaatgtgtcgtcacagccgttgatgccgccgcgacgcgccgagttatccacaatcgcctagccttcgaccacataccccggattcgcttgcgcagcggcggtccatattgtcatcatcaacatatgagacagcacaagcatctagacgatctgatgaaccgggcggaaatggacgggcgatgctgttccgcgtccagcccggcggaacgacaggcgatgctgcggcgaactcgttgcggcgatgtcgtgcggccatttcgcagcgtgtacgcgcgtcgtgaatactgggatggtctgaatcccattgagcaagcgtcacatgtcattcgcgaaatggcgagacggcatcccgagcgcgtattcgccggactgagcgcggcggtcatctacgggttcgagcactcatggacgctgcatgacgagccatacgtgtacatcgcgactgacggattcaccaagtcacgtcggtcgtaccaccggctgcggcgcatctcggtgcgtagatccgatatacgggaggactgccatgtggtccgtttgtaccggcctcgcggtgatggagcagcacaggacgggtcgaatacctggagtcaggtgagcaagttggctgaccggatcgcccacgaacgggcattgcgtgacaatgtatgtatcggcgaggtacgtgtgaccagtccggcaagaaccttggtggactgcgcgctcttgtatccgttcgagcacgtgctgtcgatgttcgattccgcgttgcgccgggggctcgtgacccgcgaggagatcgtcgccgtctgtgatggtctgcgagtggattgtgggccggtatttcgtctgctgcattatgcggatgctcgcagcgagaacggaggagagtcgttctgccgggctgtatccatcgaagaagggtttgttcctccgcaattgcagcatacgttttacagccgcgtgaccggcaaggaggcgggccgggtcgatttcatctggcatacggaagatggccgcatcatcgtgctggagtttgacggtatgcagaaatacatcgatccagagatgacgtcgaaccgggatgttcggcaggtggtccgtgacgaaaggcagcgcgaacaggatctgaaagaggccggagtgagcgttgtgatacggacgaattataacgaagtggtccagcgcgcgccgttcgtcatgaagctgatgcaggccggtgtgccgcgtgccggggcgcacccgatattcgagcatgccgattgagccgaagcgccgttgcgttcctaagttcgcgccggaacgacaagtgcgcgaacatacggacgcaaatggccctgtttgcgtacctatgtgcgcacggtcgtcgtttcggcgcgcacttaggaacgcaaaaagaggagaggacttgcaaaaagaggagaggacttggggaggggagaggcgggagatggatgggaggagggggactgagatgaggtcggagtaaggataatgccggctgcgggatgccggttgaaggcccgtcgatgttacgtccgcgtttcagacgcgcgtgttgacgtgttccagcggacgtgtatagtagtacgtggctcaacgaagagagtcttcaatgaaccgaaggaaaaaagaacgctgcggtttgatgttgccagtgtagggactgatgatcaaggcacagtaatccctttacaacggatcgtgaggcacgtacctgcctctgaaaggatgaatatcatggcagaagtcgtattcgaccacgtcactcgtatctacccgggcaacgataagccctctgtggatgatttgaaccttgacattaaggacggcgagttcctggtgctcgttggcccgtctggctgcggtaagtccacgactctgcgcatgctggccggcctggaagaggtcaacaagggccgcatcctcatcggtggcaatgatgtcaccacgatgcagccgaaggaccgcgacatcgcaatggtcttccagaactacgctctgtacccgcacatgaccgtcgccgacaacatgggcttcgccctgaagatcgccggcaccccgaaggaagagattcgcaagcgcgtcgagaaggccgctgagatcctggatctgaccgagtacctcgaccgcaagccgaaggctctgtccggtggtcagcgtcagcgcgtggccatgggccgtgcaatcgttcgtgagccgaaggtcttcctcatggatgagccgctgtcgaacctcgacgccaagctccgtgtgcagacccgtacgcagatcgctgccctgcagcgtcagctcggcgtcaccaccctgtacgtgacccacgatcagaccgaggctctgacgatgggcgaccgcatcgccgtcatcaagctcggcgtcctgcagcaggtcggcgctccgaccgagctgtacgatcgcccggccaacgtcttcgtcgctggcttcatcggctccccgtcgatgaacatcaacactcacccggtcgtcaacggcaaggcgaagatcggtgaggacaccgtcgacctgcccgccgaggccgtcaacaagctgaccgctgaggatggcggcaagattgtcgtcggcttccgtcccgaggatgccaccctggccaccccggacgatccgaacgccttctcgctgaaggttcagaacatcgaggatctgggctccgacggctacatctacggcaccatcatcaccgatggctccgctgccgaggcgtccacgatgatgtccgaccagaacaagctcaccacgattcgtgtgaacccgcgtgcgctgccgaagatcggccagaccgtcaagatcaagatcgacccctccaagatgcacctgttcgctccgtcgaccgagttgcgtctgaactagtagaggaactagcagatacttggtatgactccggtcatgccaaccattaaacgaggcgattctcttcctctcttatggcctcgttggaaaagccccgcgtagttgcggggcttttctttttgcccagaaagacatacgctaaccggcccccgcaaatgagcgttttttgttcttttgtccccactgtctatttagaagtgcgacatccttgtttgtcttgcaagtttagcagctcgtcggcgaatgcctcggcgggcgtgaggtggccgagcatgcgcatgggccggttgtcggtctcgtcgacgatctcctggagccctcttgccataccgggttcgatgatcgtgcgtttgggcaggcaacggcggatgatgccgctgaccggcggcggcgaccagcctctacccggccattcgtccacccgcgcccacaggcggccgaatgacaggcggtatggcttgcgcggcttcgccctgcgccggtcggccttgcgctgcgcggggccggcgatgtagtagcggcccgtccacgggcccgtcttcagacgcttcggccggtacggccggtaggactcgctctcgttggacgggaaccacgtgttgcgcctgatctccctgctgatgccggacgggccgcgtcccagcaaacgggctatcttcctgacgctcgtgccgttgccgacctcgatctggatgacctggcgttcctcttccgacaggtgcgaatatactttccccataggtgcaacatcccttcggactggttatctggacaatctccaataacgggtgttgcactttcaattagacaacgggccaacttcttgtataattgtatgcagtgacctcccgaaaaagggattgcgaatctatgaggggaaacaatgggctcgaaatcgaagttcgtccgttgcgggtttaacggaggaacagaacaggaatctggaaggcagcgccatgccttgaagcgttgccttgcttcggttattgctgtttccttgtccatcgtgtgcatggtgcctgcagcatatgctcagaatatagacgatgtgagtagctctcctaacgccgtaatttctggggggggggataatactgtcgtagctgctccttctgctcgcaatgtcaacgttgacgataagacgtcagaagaggccaatacatcaaacggtgcgccaacaccttccgaatcctcaaatggtgcgacagacaataaggcggacgactcagcagaagctaccgctggcaattccgctaatgatggagcccaaacgcggtctccaaacgatgcatcttctcaagatgccaagaacgattcctcaaatgcgacggatcaatcgccggcgaaggccaatgtgcaggtcgccgcgacggcgcttggcggccgtgactttgagggtcaggtcaccaaggagatcaacggcaagccctacatcctgattggtaacgagcagcagctgcgtgcgattggttctggcaagaaggttattggccgcatcaacaaggtcaagcagacttgcacgcgacaaggactcggcaagtatcagtgggtggacgacggcacgccgtcttccgaatacgccggtgacgccgatctctccaattcagatactttgcgcgatgctgatgcctccgaccacgacagtccactgctgtgcagcacgcggttagacgtcggaaagacccgcaccaagtattacggcgtgggtgctgatggcacgcaaacggactactccgctgccaacaccggcctgacctattccgcagacgccaactacctgatcttccgtgacatcgacctgtccaagaacgcggcagataccaacaacaccgagtggactccgctcatgttctccggcactatgctcggtgctgtctccaatgacggcgacaccgcagccagcctgtggaaggctgttggtgccgatggcgcaagcgtggttcacgctaccgcagctcggccggtcatcagccatgtggtcgtcaatcagaaagatatggtctctaatgtcaaaggcgaccagctggatgtcagcaagcagcagggcatcggcttcttcgcctcgatcacgaacaagaccgtgatgaacagcaacagtctgggcagcgccggtacggccgtggtgtcgaacctcaagctgcaggatgtgtcggtgacgaatcatacgagtgaatcgtatattccgccgaccttgctcggtatgctcacttcggcagtgggattactgctcgacacactgttgaaggcgttaaaactattgacattcggacaagtagatcttgacctcaatcttcaaggtctgctcaccctgcacgaaaaaaatccttccaacctcgccacgggtgcatttgccggccgtatctacggggacaccaaggttacggactgcgaggtagcagatgtttcggtatctagcgtaagccgtatgaccggtggtttcgtgggatatgttgagggcgcaacccgatacgatgcagtctccggcatcgtaggagcgctcaccaagttactctcgaagattctgaacgtcatcccgttcctcgggctgggcgatttggtggactggttgctgtccggcacgctcgggctgaatgccttgattccggttggctactacaacccggttatctcgaatagttcggtgaacgggttcaaaaagaacgtggtgatcggcaacaaggacaacccgcaggccggcggctttgtcggtgcgcagattggtgcaatcattgagaactcttcggtgacgagcgcgaatggtttcaccgtgcgggcaacgcaatatgccggtggttttgccggagtaagtcgcaacggcaacgtgggcggtctgattaactcgcttggcgtcgacttgctgtctgcgctgcgtccgcagagcctcatcgaaaacagtgacctgacggtaaacggtgacgataagatcaccgtgcaggccgaagactacgccggcggcttcaacggtgccatggccaatgcctatgctgtcaataattcgattacggcttcggtcgccgtgactgccgacagatcccacgccggaggattcaccggattcgcctccgtgggatggggcctggaactcggtacggacgataccacgaaggcatcgctgttgaaacagctcaccaaagctgtgactaaattgctgagcggcagcaataacggtgcaggagaactgctatccatcgtcggtgtgaatccttctgcgattctcggtacacagatgaagggttccttcacagttgctgccggcggtgattacgcgggcggccttgtgggtgaaggttcgggtacggtgatcggtgattcctcgcagaaccgccttcaaaaactcacattctggaagtacaacaatcctcgtgacttcccacagcagcgttccaccaccatagaaggccttgaatcggtcacggccgcgggctcctacgcgggtggcatcgccggcaatttgcaaccgacaacggtagctgggttgctcaacagtgtggtgaaaattggcgatattgccatgctcaagaagttcgaccagtttgccgcgttcaccgtggagaacatgtctgtcaccgctccggcatccggcctgacagtgacggctggttcatatcatgcaggcggtgccatcggatgcgccaccggcggcgacgtgacccacacgaaccttaccaatctggccacggtctcggccaagggagaagccggcggttttattggcttctctggaccaggcgacgccatcggcgctggcggtctcaatgtgctcgggcttatcaagctttccggtctgctatcggttgcccaatattcttcggttgcagtcactgcatcgaacgtgaacggcatctctggcggattcacggttgcggcaaccggcaagaacaagaacaacgaaacaaccgattacgctgcaggcggtttctatggtcaggccaacagcaccaaaacccgggaaagccatgtgacaaacctcaaatcggtcacagccgataccagcacgtccgatggtgtggcaggcggtttcgtgggcttctccaccaccggcggcctcgccgacgcgctcagcaacgcagaagattccagcgtattggatggcctgatcaaaggcggcctgctgtccgtgaacgacccgtttcctgccgtacttcttccccgacacgttctacgagggcaacgacccgagcatcgaaggtctcgacaactggcgcaaggcccgtcgtgccatcctgcgttccccgatcgcccgcatgggctacggcggatacctgtcgctggccgcgaagttcccgaagttcgtggacgcggtggagcacatctcggatgagttccgcgacatccacgaccgcaccgacggcgaggcggcccgcggcgtgctcaacgtggcgatcctgaactgctggggcaagatgcgttcgtggatggcctacacggtcgcccacgcgctgccgaacaagcagacgtattcgtattacggcattctggagtcgctgtcgggcatgcgcgtgaacgtgcggttcatcagcttcgatgacgtgctggagcatggcgtcgccgacgacatcgacgtgatcgtgaccggtggcccggtcgacaccgcgttctccggtggctcggtgtgggccgaggagccgcgccttgcggcgacgctgcgtgcctgggtgcacggcggcggcgccctgattggcgtgggccagccgagtgcccagcagttccagggtcgtttcttccagctggccgatgtgctgggtgtggacgaggagcgtcaccagacgctgtcggtggacaagtacttcccggccgtcacgccggagcacttcatcaccgccgacgtgcacctgggcgaaggtgtgctgcagggcttcctcgacgccggataccgcaagcccctgtcgggctgcggcggcggtcaggcgatcggcgagcttggcggcatcgacttcggcgagccgatcgcggacacgttcccggtcaacgaggacgtgacgctgctgcgcgccgacggcggtcaggtgcagctcgcggtcaacgagtacggcaagggccgcggcgtatacgtctccggtctgccctactcggccgcgaacgcccgtctgctggagcgtgccctgttctgggcctcccacaacgagggcaagtatgcggcatacagctcgtcgaaccccgagtgcgaggtcgcggtgttcgacaagtcgggttgctactgcgttgtcaacaacacggatcgcgcgcagtccacgtatgtggagcgcggcgacggtcgcatcgagcgcatcgaactggcgcccagcggtatcgcctggcgcaccatctgatccggtcgcatcatcgctccggatcggcgtgaacgagtgaatatcggggtcatcgtcgcctactccttcgacgatgaccccgatttttcatgccgcctgtccattgtgcgtacatgtacgcatcaccggatgggtggcataggtatatttattacacggtaagcgtgcacaagcgcgtcgcaacgcagacaataatcgcggatacccgcggggaatgaggagtcatgagcgagaagatggaagcggtcgccacgtcggaggcgcctgtggcgctgggcgcgtacagccaggcggtaaaggccaacgggttcgtgttcgtgtccggccagctgggcatcgaccccacgaccggcgaactggccggagacaccgccggtgagcagaccgcccaggcgctgaagaacatcaagcagattctcgacacggccggcaccggcatcgagcacgtcgtgcgcgcgacgatctacatgaagaacgtcgaagacttcaaggaagtcgatgcccggtacgccgacgtgttcatcggctccgtcaagcccgcccgcgttgccatcggcggcaacgacatccccaagggcgccctcgtcgagatcgacgccatcgcagttctgtgacggttcgcggggaatccgaacagtaacccgccttcaaccaaagccgtagcagtgagcctccaccagatgcatgatggaggctcactgctgtgagtcgtattgcataaccatgttgcgccaatgctgatggttccgtcggatgtggcgtatatgaaggtgatttgcgtccgtaagtgcgcgccgaaacgacgaccgtgcgcacttacggacgcaaatcgggccttttgcgtccatatgttcgcgcacttgtcgtttcggcgcgcacttacggacgctttgggagcgccccccaatctcgctccgctcgacagccccctgtcagcgggagtacgaccaacgctcccgctggcggggctgtcgcaaagcgactgaggtggttcacacgtgacacgctatatagagttaccaaacgtgtctcccaaatcatctccggccaatccaccgcatatgtgatgcggtggtgaaggagtgacgcggatcaccctgattcttaccctcgaatgccccgaacacagctgcgcggcctatgatgacctgcaccaatggcgttggcgcgactatgtcgcgcggcgaaatatggaagcggggtgtgagatgcacgggcgcgaaggacgaggacggctgtccggatccgttgtggcggtggtttccgtactggcatgtatcgccatgcttgccggattggtgatgggcacgacgcatgtggtcggctgggtgttcgatgcgatcgcactggcgtcgccacagcatcgcccgatcgtcatcgcgcatcgtggcgacacccggcatgctcccgagaactcgctggcttccattcgcgccgcaaagcagaacggcgccgatttcgccgaaatcgacgtgcggctgaccaaagacggcatacccgtggtgttccatgaccgcagaaccgggcgtctggacgcgggcggtcgcaacgtgctggtgaacagtatgccgttgtccgcattgcagcgcatgatcatgcagcaacgcggcatgcggtattcggttctcacgctgcgtcaggcgttggacgacgcttccatgtcacgtccggggcagcggcggttcggcttgctgctggacatcaagacggacgcgcggtatgcccggaaagtggccgatgccgtggtgcgtgtggtcgaggattccaaatacgccggcaatctgatggtgatgtcggccaacccgtatgcggtgatggtcttcaagagcatgcgtccgcagtggcatgtaggcctgtgcgccagcggcaggcccgatctgacgcaatgggatgatgacggcacgagcgaagcgcggttcatggacggggccgcgcgggtcgagaccgtgcgccgcgaagtgacggcgaagcgcggcggaaagcagcgaaagcatcccatgttccgtggaatgcgcggcgaggccatggacttcgtcgtgttccgcgcgcgggacgtcacatcaagactgctgcggaatgcgcggctgcgcagaattcccgtatatgtcgactcggtggattcatacgatgccgcgaacggcttgctgcgccacggcgtcagcggactgctcggcgagaacatcacgccgttgcagcaggcttgttcgtcatatcacgggcttcccgaaccgttctcgtcgccggacgatgacgatcgctcccaggcgtgacgccgaccgatcccgcgtcggtgcatgaaccggacgttcgctgtcaaagtgcccggtacactagggagaatgagtcctgaagcgcttagtgaactgattgaaaccattgcccacgatctggtcgccgccggaaaagccggtaccctgaccgacgatttgattcccgaaaccgccaaattcgccgtgatgcgcccgaaggatcgcgcgcacggcgattgggcctccaacgccgccatgcagctggccaagaaggccggcatgaagccgcgcgatttggccgagctgttcgccgagcggctgaccgccgccgacggcatctcgaccgtcgaggtggcggggcccggcttcatcaacatcacgctggattccgcctccgccgccgcggtggtcgacaaggtgctggccgatggcgcaggctacggcaagaacgcgcacctcggcggcaagacgctcaacctggagttcgtctccgccaacccgaccggcccgattcacatcggcggcacccgttgggccgccgtcggcgactcgatggcccgcgtgctagaggccaacggcgccaaggttgtgcgcgaatactacttcaacgatcacggcgagcagatcaaccgtttcgcaaagtccctggtcgcagccgcgcacggcgaggagacgcccattgacggatacaagggcaagtacatcaacgagatcgcggaccgcgtgatcgccgaggcggaggccgatggcgtggatgtgctgagcctgccgcgcgtcgacggcggcctcgacaaggacggcaacccgctcggcgagggcgattccgagcagcgcgaggagttccgcaagcgtgccgtgccgatgatgttcgacgagattcagcgctcgatgaaggaattccgagtccgcttcgacgtgtggttccacgagaacaacctatacaaggacggagaagtcgaccgcgcgattgaggagctgcgcagtcgcggcgacatcttcgagaaggatggagccacctggtttgaatccaccaagcatggcgatgacaaggaccgcgtcatcatcaagtcgaacggtgacttcgcctacttcgctgccgacatcgcctactactggaacaagcgtcaccgcgctgtggatccggccgacgtggcgatttacatgctcggcgccgaccatcatggctatatcggtcgtatgatggccatgtgcgccgccttcggcgacgagccgggcgtgaacatgcagattctcatcggccagctggtcaatgtgatgaagaacggcaagcccgtgcgcatgtctaagcgcgctggcaacgtcgtcaccatcgacgatctggttgaggccgttggcgtggatgcggcccgttactcgctggcccgtaccgactacaacacgtcggtggatatcgatctggatctgctgacttcgcattccaatgagaacccggtgtactacgtgcagtatgcgcacgcgcgttcctgcaatgtggaccgcaacgcggccgctgcgggcattggtaccgaaggcgctgacctgagcctgcttgacaccgaggcggacggcgaggtgctcgccgcgctcgcccagtggccggcgactttggctctggccggcgaccagcgtgccccgcacaaggtggcgcactatctggaggacctggccggtgcctaccacaagtggtacaacgtcgagcgcgtggttccgatggcgctgaccgaccccgaggagcgtctggatgacgccgctcgcgaggcactgcgcatcgccaagaaccccgaaccggcacgtgccgccgcacgcctcaagctcaacgacgccgtgcgcacggtcatcgcctccggtctcgacctgctcggcgtcaccgcccccgacaagatgtgacctaggctgcccctggtcgcgcgtagcgcgactgggggcggttctcattcaggtactctccgaccgagcctccgccttatggtcgggaagtggtatcacggtgccggttctggcacaatggcacagtaataggaaaagcggcaagccctgagcgaaagaggagcaatgactggatctgctgtgcgtgtggacggaacgcaaggtatcacccccatctggccggtggcgacggcagtgaatgccgaaggcgccctgacattccacgggcgcaccgccgagtcgctgcttgacgagttcggatccccgctgtatctgatcgacactgacgaagtttccgcccgcgccagatatttcgtgcgcgcggcggccgacgccttcaccaactccaccacgcacgtgagtttcgccggtaaggcgttcctctccaaagaagtcgtgcggttggtgaccgatgcaggcatgctcgtcgacacatgctcgatgggggagatgcgcatcgcgctcgccgcaggcgtccccggccgtcgtctggtgctgcacggcaacaacaagtccgacgcggaaatcgaactcgccatcgagcagggctttgcgaaaatcgtcgtggacgagccgggtgagccggcccgcatcgccgccatcgcgcgacgactcggcaagcgtgcccgcgtgatgctgcgcgtgaccgccggcattcacgccggtggccacgaatacatctccaccgcgcatgaggatcagaagttcggcgtgccgctgctgccggccggcgccgatgccgcggcactcagcgtactggacgaactcacggctgatccagcaggcgtgacgccggctgttacgaacgcgcacatcgccgaacgcgatggtgatgccggtgacgggaacgcgaagcccgagcgcgaactgcactacgacatgaagtacccgtatgacctgagccacgaggagatccccgaaaaggacaaggcgctcgccgccgcgatggaaaccgtggcggatgggccggcactggccgtgctcaaggacatcctcacacggtccgacgagttggaactcgtcggcattcactctcatatcggttccaacatccatgacgcagacgccttcatccaggccgccaagcgcatgatgctgctgcgcaagaccttctacgccaccgacgcctatacgctgcccgaggtcgacttgggcggcggatactccgtggcatacaccgacggcgaggattcgatggacgtgcgcgtcgagctgcgtcgtctcgccgaagcggtcggtgccatcaaccgtgcgctcggtgtgcccgcgccggccatcagcttcgagccaggacgatggatcgtcgccccggccggcgtgaccctgtatcgtgtgggcacgatcaagccggtgcatctgtccgatgccaaggacaagaccggcaatcccatcgatgagcgcgtgtacgtgtcggtggacggcggcatgagcgacaatattcgtccagcgctgtacggcgccgactacacggtccggctggccaaccgtcgcgggtcggacgagtcgatgctggtgcgcgtagtcggcatgcattgcgagtccggcgacatcatcgtgcacgaggacaggcttccggccgacctcaggcgcggcgacatcctcgccgtgccggtgacgggcgcatacggccgcacgatggcgagcaactacaatcaggcgctgattcctgctgtggtcgccgtgagtgaagccggcgcacatgtgatgatccgtcgccagaccattgacgacctgctggatctggatcagggctgaccgttcagcgccagcggcaagatataaaagcaaaagcagtagaactcaaaaaaaggagtcctccccggctatcagggaggactccttattgtttgttgcggttgtgtctaccgaatcacttggtgacgatggtgccaatcggagcgccggtagccaccgcacccttggcggtgatcgacagcttatcgatcttggccgggttggtgaacacgacgatcacgtcggtgggctttccagcggacttgaccacattccagtccacgtcgaccagcgcgtctccggcgttcacctgctggccttcgctgaccatcatcgtgaacggggatccggcgagctgtacagtatccacgccgatgtgcacgagcacttccactccggcgggagtggtgatgcccactgcatgcttggcctgggcgaccgtggtaatcttgccggccaccggggcgaccacacgacccgacgtgggaaccacggcgaatccgtcgccaaggatcttggcggcgaaggtctcgtcgggcacttccgtgatcggcttgatggcaccgtccacaggggcgagcaccgcgttgtcagcggctttcaccttgggggcgggggcagcggcagcgggggctgccgtcacgcttttggggaaccaccaccgatgacgggcttgccgtacagggcggacagagcgtcagccacggcctgcacctgcgtgccgacgatgatctggacgttcttcttgtcgatcaccttgacaccggggacgccggtcttgcggatggcgtcgacgtcgaccttcgaggaatccacgacacccatgcgcagacgggtgatgcagttctcgatttcggtgatgttgtcgtgaccgcccagagcggcgtacagcttgccggcgaggtcggcgtacttgtcaccggtggacgaggtcgcggtgtcgaacgctgcggaggaggcatcgtcgttatcgtcatcgccacggcccggggtcttcatgttgaacttcttgatcatgaagtcgaacacgaagtagtagatgaccgcgaagacgaggccctgaacgataagcatccacggcatatgagctgcgggaaccttcagcgacaggaaccagtcgatgaagcctgcggagaagttgaagcctgcgatccactggaacgaagcggcgatgaacaccgagatggcggtgagcagcgcgtgcaccacgtacagcgggaaggcggcgaacatgaaggagaactccagcggctcggtgacaccggtgaggaacgcggcgagcgcaccggcgagcatcagggatccggtggccttcttgttctcgggcttggcgttcttgtagatcgcgagtgcaccggccggcaggccgaacatcatgatcgggaagaagccggcctggtagatgccggtgacgtacacgccgaacgggtggaagccgccggtggcgatgaccgcgccactggccgggtcggcgctgccccagaacttgccgatgtcattgatgttggcaaggttgaaccagaacacgttgttcagtgcgtggtgcagaccggtcgggataagcagacggttgaagaaggcgtaaatgccggcaccgacggcgccgaggcccatgatggactcgccgaaccagaccagcgcaccgtagacggccggccagatgaacagcaacagcagcgagatgatggacatgaccgcagcggtcagaatcggcacgcaacggcggccggagaagaacgccaggaagtccggcagttttgtcttgccgaacttgttgtatagcgcacctgccacgcagccgaccaggatgccgaagaacacgttcttgttgccgatggcgccagcggcgaatgccgggtgctcggtgtcgaccttggtggcgtcgaagccaaggaacatggacgcggagcccatgatcgtggtgacggtcaggaaaccgaccagtgcggacagtgccgaggcgccgtccttgtcgcgagccatgccgatggcgacaccaacggcgaacagcaggcccagattgtcgaggatcgcgccgccggtcttgcacaggtaggcagcgacgacgttactgccaccccaaccgctcgggtcgatccaataaccgatgcccaggaagagtgctgcagcaggcagacacgcaacgggcagcataagagcgcgaccaaggcgctggatatatgctttcattccaacctccctctgaggatacggacggcgctttcttccgccaaaattcccgttcacgtaccatcccaccattggatcggacgctcgcgagtatgtcagcaacgccgcttcaatgaacaatggtacgtgacttttacgatatgaggcccgtgtttcgttaagattatttgctaaataggcaggaaacatggcgggtgtataagggctcagccttacgggaagctggtgtttcacgatttctctgtttaaggcgttaatttgtaaatctactttactgcggcgtgtcgttagcgctgctacatagtggaaagccaagggaaacgaggccattgggagctggatccggcctccggggcgttgacgggcggcgtgtcggattcattccgtaggatggtacacagtgacgccggcccggcgaccctctatcggtgagtggcggccgggcgcgccaaacaccgctgaaggaaggaaatccgtggcacagctgaatgacaaccccatccgcgttggactgttgggagcgggaaccgtcggatcacagaccgcacgtctgctggtggagcagaaggacgaactcgctgcccgcatcgggcgtccgatcgagctggtcggcgtggcctgcctggatcccgatgaggtggacttcccctggatcgacaagtctctgctgacgaccgacacgatgaaggtcgccaccaacgccgacatcgtcgtcgagctgatcggcggcaccacagtggcccgcacgttcgtgatggccgcgatcgagtcgggagcctccgtggtcaccgccaacaaggcgctgcttgccaagtacggcccggaaatctacaccgcggccgaggccaagggcgtcgacatctacttcgaagcggccgttggtggcgccatcccgttcctgctgccgttgcgcgaatccctggcgggcgacaaggtgaccagcatgctgggcatcgtcaacggcaccaccaactacattctcgacgagatgaccaccaagggaatcgctcccctgtcccgccagcgtgtcgcgttcgccggactcgcgccccagcgcgtacgacctcgatacggcaatcaccaacacgataatcgtcaccagcaccgccaacgccacatgcacccatgtcatcggacccgccccgcctttcctcggccctgcaccgctctcatccacccgcaccgatgatgcggatgcggatggtttcagcgtaacggctccgcacgtcccgccgccagcgcgactacgtaagtttgccagttgttcaacttgccgtgtccttccgcggcgcagcccgtcggagcgagccgcgcccggcgtcacatgcgccgcaggatgtcgagcacgatgcgggccgcggtatccgcgtattcggagatgtcgaagcccttgaactcctcgtagtcggtgtcggcgttgtcgctcagcgcgcggatcaccagcgcgggtacttcgtttcgggcggcgacgtgcgccacggatgcgccttccatctcgacggcgtcggcgccggtgtcgtggatgaccttggcgatctgcgccggcgtatcgacgaagtagttgccggacgcgatgatgccgatgatgtgcgtgacgcccatggccgcgagcgcctggtcggcgagggacagcagacggtcgtcggagtggaattcctcgacgggctgctgctcggtgccgggcttccattggccgacgagtcgcatgtcggtgtcgaggtagcgcagtgtgccaccgagcaccacgtcgttgatgtgcaggttccggttgaggttgccggcgatgccggagaagatcaccgcgtcgggatggtatgtgtcgatcaggtgctgggtggtggcggcggcgttgaccagtcccatgccgccgacggtcgcgacggcggtgacggtgcctccgtcgttggttcccagcgtgccgcgcgtcacgtcgaggccggcttggcggtcgtgggtgacgtcgttcagtgatgcggcgatgagtgcgacttcgtcgtccaatgcgccgatgatggcgatggtggtcatgggaatcctttccgtgtggttgttcgtgaagagtaatggacgccgtttcagcgccagcgccgggcggacaccgcgtcggcgagctcgtgcagcagccgttccgtctcgtcccagccgatgcagcggtcggtgatcgacttgccgtagaccagttggtcgagcggggccgccggctggttgccgctttcgatgaagctttccatcatgatgccggtgatgccttcctcgccatcggctatgcgccgggcgatgtctcgcacgacctctgcctgccggtgctcgtccttgccggagttgccgtgcgagcagtcgatgatgagcccgtgggtggcggcagattccgccggcatcatcgcgcgcacgtcgtccatcgcacggcgcacggatgcggtgtcgtagttcggcccgtggatcgagccgcgcagcaccacgtggcagtccgggttgccgagcgtctccaccgcgcaggcccggcccatgtggtcgatgccgaagaacgtgtgctgctgcgcggaggcgtagcagccgttgacggcggccttgacggacccgtcggtcgcgttcttgaatccgatcggcatcgacatgccgctggcgagctggcggtggacctgcgattcggtgttgcgggcgccgatcgcgccccagctgaccgcgtcggagatgaactgggggctggtgggctccaggaattccgtggcggcggcgagtccttcgtccagcacgccgatcagcgtcttgcgcgcgagcagcaggcccttgcggatgttgtggctgccgtcgatgtcggggtcgttgatcagtcccttccagccgaccgtcgttcgcggcttctcgaagtacacgcgcatcacgatgagcagttcgccttcggtctccttcatcaccttcgacagccggtgcgcgtagtcgagcgcggcgttcgggtcgtgcaccgagcaggggccgacgatgacgagcagacggtcgtcctgcccatacaggcaggcgcgtatctcgtcgcgcgagtaggcgacgatctcctgcgcggcggagtcaagaggcagttccgccaacacctgggccggggtgggcagcggttcgagctccagcacacggcggttgatgatacggctgacgcccacctgatcctcccagcgcggcacgcccgtggcgagcagcgggttcttgccctcgtccatggcctgccggatggcccgcagctcctccggcgtgttcagcggcttcgggccggcgtgacgcggcgtgccctgcggcgtacgctctcccatgttctgctgctgcatgacgtgatgtctccttgccttgttctctcccccaaggataaggcacggccctgtacttggccatacacgggccgcgccagcccgtatccgccgcgcatgacgaacgtccccatgccccgcgtcgaacgggcacggggacattacgatgttctggagcgctgccgtctcgccggccgcggcgtccttgtagtcgccggccgcgatcgcgaccaccggcaacaccgccaggatcgtcttccagggagttttgcgccctgagtgccgtgccgattccgccatcacgcgccctccttcaccgacgcgaacaacgtcacgccttcgcccacagttgccgtgcattcatcatgatgagccatgccctttcagtcttctttgacttgcgccacgctgcggtcgcgcactaatacccccctgcccgcgctggcacctatgccaacacgcgccggtatccgcggtgtttcttgaaggagaggaaccaccgcttgaactcttatgcgagcctaacatgaaacgggaaaaaaacgggggcacttgatttatacaagagttgttgtacaatatttcttgtcaattggatatcgcttcataacatgagcgcagcatcacacgcgacaggtgtcatgaggcacggaaggaacggacatggcacaggcttccgacacggcgcaaccgcagacgccgccccgccgcgacaaccccgcgacagtcaccgacacgaaccgcctgaaggcgctgtcgcaccccacacgactgcgcatactgaccgtgatgagcgacaccgaacccgtcacggtcggccagatcgccgaacagctcggagaatcggccggaacggtcagctatcacctgaaacagctcgaaaaggccggattcgtcacgcaaacgccatcacccgacggagacaaccgcagaagctgctggctggccgcccaacgcagactggaaatcaacgcggacgcggccgtcgattcggcaatggcgacgacaatggatcaggtcagctccacgcttcggcaagaggcatggcagcgatacaggtcggcctctgacaacctgcccaaacagtggacggacccaacggtgacgagcagcagcgtgctgcggctgacaagcgaggaatacgcgcgcatgtcacaggagttgcgcgagctcttcaacacatggacatcacgcgacctcgcacacgaggaaggggacggctcgcaacccgtcatgctcaacatcgacgccttcagatggctgccataacggcggcctgacataccctctcaccccacgccctgcgcccacaatgcaatgggcgagcgcaagcatacgcaatttcacccctcgacgcacaacacccctcaacttattcaaaggaaacatcatgcccgaatcatcgcaggcgcaaaccgcgccacaccgcgaacgcacttccccgcaacgcagtgaatcgctgtggggcaaccccacatatcgtcaatggttcactgcagacaccgcctcgacgatcggagccgcgatgagaggcttcgcgatctcgctgatcgccttctcgctcacccaatcggtggtgctcgccggatggctcgccacgttcagccaaattgccacgcatgtcagcgacgtgttcggcggcacggtcgtggaccggcacaaccgcaaagggctcatcatcgccaacgccgtgttcggcacgctgctgtggggaacggtgttcgtgctgatcgccctgcatgcgatcgcattcccgatattcgccatcgtgacggtcgcggcgtcagcggtcaacggactactcgccaacgcgaccaacgcgatgctgcgcacgatcatcccgacccgcgaatatccgaaggcgcaaagcctcaatcaggggcgcgattccgtggtcagcatcgcgggatccccgctcggcggcgtgctgtacgcggtcgcgccgtggctgccgttcgcggtcgcctcgctgatgtacgcgatcagcggtgtcagtgccgcccagctgcgcgtcgacgaacatgtccgcgacatggtgacgacagatcgcaagagcaagcgtcccgacaccgcgtcgcaagcgggctgcacgtccgatgccgtcgtcgcgcccgacgccgatgcgacagcagagccggcgcacacctcgttcttcgaggatttcatcgaaggatggcgctggacgctgcgcaggcacacgctgctggcgatctgcgtaatcgccgcgctggtgaatttcgggctcaacggcgtgttcgccgcggtgaacctgcaactggtgagcacccacgtggactccgtgcgactcggtttcgtcaacaccgtcatgggagtcggcatgctgatcggcgcggtgatcgccgcacgggtatgcgagcgagtgcacatgggcaccggtctggtcgtcctgtcggtgacgtcgctgctgacattgctgccgatgctgttcagcagcgattacctggtgatactggcgtcatcgctgatcgtcgggctgcccatccccaccatcaactcgctgctgatgggattcgtgttcgccaaagtgccgagcgagatgcagggacgtgtcgagtcggcgagcgacatgctgtcgatgatacccacgctgttctgctcagcgctcgccggctccctgctgccacgcatcgggttcggcgccacgattggcctgttcctggccgtgcttgcggtcaatgtggtcatcgcgctgctgatgccgtcgatccgctcgctccccgccgccgaccactgggacgacgcgtcgctgtgacgatgcatcactgaagcagcgccaatgcaaaaaaaacggttcggcgcggcctctcgaacagacaaggccacgccgaacctacgtatatgctaacagccatgtattgtggcatgccccacctagcggcctaggccgggcaccggatcagagcgcgcgacgcgcgtcgatggcgtcggcgagcgtgtgcagcagctcctcggtacgctcccacggcacgcaggagtcggtgaccgactggccatacaccagctggtcgagcggtgccggtttctgatgcccgcccttgaggaagctctccatcatgacgccgaggatgcccggctctccatcggcgatacgcgaggcgatgttctcaatgacctcggcctcgacgttctcgtccttgccgcaattgccgtgcgccgcatcgatgaccagaccgcgttcgctcggaccgctcgccttcgacgcgcgcagcgcctcaagcgcggccgccacggaagccgcatcgtagttcgggccggtgttcgacccgcgcaggatcagatggcagtccgggttgcccttcgtctcggcggagatcacgcggccatccaggttgatcgacaggaaatggtgctcgaacccggccgcgaaacacgagtcggcggccggcttgatcgaaccgtcggtcgcgttcttgaagccgatcggcatcgacatgccgctcgccaactcacgatgcacctgcgactccgtgttgcgcgcgccgatcgccccccagctgatcagatcgcagatgtactgcggtgtaatcggatccagccattcggtcgccgtcggcagccccaggccaagcacgtcggtcagcaccttgcgcgccagccacatgcccttgcggatatcgaagcggccatccagatccgggtcgttgatcagacccttccagccgatcgtcgtgcgcggcttctcgaaatacacgcgcatcacgatcatcagtcggccctcaagctcgcccttgagcgtcgcaagacgctgcgcgtactcgtgcgccgctttcggatcgtgaatcgagcacgggccgacgatgaccagcagacgatcatcgcgaccgtgcaggatgtcgcggatctcctgacgcgattgcagcaccaggtcgctcatatcatcggtgagcggcagttccctgagaaaataccgcggtgccggaatcgggtcgagctggcgaatgttcacgtccaccgtttcagggaacacggcattcccgcccaaatgccgctcgtcctcggaactgtccggaccacgaagccctgccatcgctctgctctccttccgcaccgcagcccggtgtctttcgacccgcgccctcacgtcgcataccaataccgaacacacaatagtagatgccgtcggaatacggaaaacaacggctgcaatgcgggcacggcggagctgcgaagccgtcacccggcgaaagtcccattccggcggctgcgaatgggactttcgcgggatggagatggggcgctattcgcaggcgacgccgtcgccgtcgcgatcgagtttggtcgagtagccgggctgccctttgtatagcggcgctttgccggctgcacgcaccgcggcgcagttcttgtagtagacatcggaactgtcgccgtcagacggagcggccggctccaccaccgtgctcgactcggactgttcgcccgatgaaccgtcctgcgatgagctgccttgcgacacgtcctcctgcggcgccactgattccgcgccgtcgccggtcggaacggtctgggccgggcaggacgacagcacgcgcgacatcgcatcatgctcggcctgcgtcacccacagcgagtacttcgccttcacgccgatctgccgagccacgtatgagcagcggaacgatttgttggcgggcagccaggtcgccgcgtcgccgtcggacttgcgctggttcgacgggccgtccaccgcgagcaggttgtacgggtcattcgccagctgcttgcgccggtcggcgctcagctgctgcgcgcccttctgccatgcgtccgacagcgccaccacatgatcgatctgcacggccgccgaggtgctttgcccgcgcacgaaatcaatcaccgcggcggtgtacgggtcgacgagccgaccgctggtcaccacgcaattgtgcgtaccggccttgtgagtcttgttggtgaggtcacggttgaggatgtcgttgcgtgtgtcgcacccgttgtggtcgacgtcggcccatgcctcgccgaactggtcgcgcgaataaccggttttcggtgcacgtcccttgaccggcagcgtctccagcgcgctcgtggcgagctgtccgccggacgcggaagccgagcttgacggttcggacgactcagccgattcggattgtccggacgactgacgctcagccgaccccgcatcggagccgggagttccgcatgcgccgacggtcaacacgaacgcgatcgggataagacacgtcagtattcgattgaatgtattgaatgatgtgcggcttccggccgacgctttcttcatcatgaagctttctctgggcttattccgctatgccgcaaccgatgcgcggtcctctggctagagacatcattgtcatccaacaatagcggaagaccgccgtcaatgacgattccccacatcgaacggcacactcctttcgtaaaatgtccatccgacacggggaatcgacgaaatcggtcattcagtctcgtgctcgacgcacgggccgatacctcgctcaggccagcgcacccatcggatcccatgcggggagcatggtggcgggctcggcgagcgcggcctgatactcggccgggagcatcgccttgggcacggccacctcgtacacgtactcggtgaaccagtcgtcgctcatcgtgaagtagcccttgtcggcaatcttgtcgccccaggagttctccacgcgccagcgacgggtcgtggtgccgtcatcggccacgtccacgccgacgaacgccatcgcatggttcatcgcggagtcgccgaagcgtacgcgcgactccttgtccatgtcgaagtccacatcgtagacgttgccgtactcgaacaggtcagtcgcccacgcgccgcgctcgcgatccatgaacggaccgcagtccgcgccgaaccacaccgggatgcccttttcggtcaggatcgcgcgcacgcaatccttcatgaactggttcggcacgttcaggtactcggtcgggttgccgccggccacgttgcccaggtgctcgatgccgatcttcttgcccttggcgtgctcgcggcgcggatcgtccacgaggcacacgtaatcctcaaggtcggcggtgcccacgtacttcttccagaactcgacgggcgtgatttcgccgtcgcggtggaacatgccctcggagtcggtccactcccagtcgaagcttttcggcggctcgcccaggtgaatcgtcaggatgcggtggccggcggcgacggtcttggcgacctcgtcgtcgatcgacgcggggtcggcgtacatgtgtgccacggcagtgtgcagcaggtggcgcagctgcgtgttcatagcgcccgtgttcttcgaggattcggtctccgggaacaggtccttcggcacggcaccgtacttcttgtacacgttcagcgccatcgtccactggcctccgtcacccatcacgtcggcgagcaggtgctggatcaggcgcgagtcggacggctctccggcacgaaccagcgcggcgacgtcctgcaggaagtagttgacgcgctccagcttgtcgaagtacatcgcgtagttctgggagaactcgaactccttgacgccgaggttcttcttggcgacgaaacgggccacattcagcgagctgaacagccagcagcgaccggaacggtcctgatgggtgacctcgccgttgtcgacggtgacggagaagcggcgctgcagcagacgggaacggtcatagttcagcgcgaccttgtcgataccggcggcggtgacggcgttcatggccagacggttggactggctggcatcgaatgatgcgaccagatcgttcagctgctcgccggacagcggtgtgatttcagacgatgacgtgttctcggtcatgctgctcctttgacttgggacgtgcgcggccggttttgtggccgcaatgaaatgtggcatccagcgtttgaccggatgccacgacgggtctctaatgagtgtagcggcgacagcggattcccgccatcgaaccggttcaataccttgattcggcaggagcccggcgacttctgcagccgcctgcgggccggacggcgaagcccggcatccgacgcttcggaatcccggccgactgctattcggcggtttcggcctcgccggcctcggtgtgctcggccacatgctcggcgaccggctcggcggcgaccgcttccgcatcctgattgtcggcatgctccgcgacggcatgcgactcatacgccggtgccggctcatcctgcgcgacggcattgtgcagcggcacatcgggcgctccctgatgcgacgcggcgccaggctgctccgccccctgctcgttcatgaacccgaatccgctgaacgccttggtaaacatcgaacgcaactcggacacgcgctgcgtgatggccgcctcacgcgattgcagctcggctatgcgcccctgaagatcctccagctcgacctgcgcggccttgcggcgatcctcgatctgcgacgccgcatcctcgccggccttttccaggatctgcgcggcctgatcgtcggcctccttgcgcttgctcgccgcatacgtgtcggcatcctcgcgcacggtcttcgcctggccgatcagctcgtcggattccttcttggcggccacgcgacgctcttcgaggttgccacatacgggccgaaccgtccgttgcgcacttcgaccgtgccgccgcttgccgggtcgacgcccagctcgcgcgggccaccggcattgctgtcgatgagctcatggccgacctgcacggtcagctcgtcgggcgccatggtgtcgggcagggaggcccgcttggggttgcccgccgcatccacgtggttcatgtcttcgagatacgggccgtaccgaccgacgcgcacgtgcagtccgtcgccgatgtcgatggtgttgatggcgcgggcgtcgatctcccccagctgcgcgacctgctgctgcaggcccgcgtgcgcttcgtctgccgaagtcgccgcgtcgccgccggaaccgaaatagaaatgggtcagccagtcacggccggtctcctgaccgtgcgcgatctggtcgagcccgttctccatatccgcggtgaactggtaatcgacgtacttggggaatttcgtctccagcagcttgatgaccgagaacgccagccacgatggaatcagggcgcgaccgcgctcgtagacgtatccacggtcgatgatggtggagatgatgctcgcataggttgaaggacggccgattcccttggcctccagcgtcttcaccagcgacgcttcggtgtatcgcgccggcggctgggtctcgtgcccgtcagcctccaccgaggacgcggcgagacggtcaccggtctgcatcggcggcagcgatccgttgtcgtcggtttcgcgcgaggcgcgtttcgccgcggcctcgccgtcaccggcacccatcgaggaggcagcgggggccgccgcacgacggccctccccggtggccttcatgaatccggggaactcgatcaccgtgccggacgcctggaacatcgcctcgccgtcctcgccggcaggagccgacagacgcacggtcgcggtggagccggtggcgtcggccatctgggaagcgagcgtgcgctgccagatcagcgtgtacagtttcagctggtcggcgggcaccttgccggagagctccgccgggtcatggaaccgcgcgccggcgggtcggatgcattcgtgggcctcctgcgcactagcggtcttcgtcacatactgcttgggcccatcggacaggaacgactttccgaaatgatattcgacggcatcacgggcggcggcgatggcctcctgcgacaaggtcaccgaatcggttcgcatatacgtgatgtaaccgttctcgtacagcccctgcgcggcacgcatggtctgacgcgagctcatggacaggcggttgccggccgtctgctgcagcgtggatgtggtgaacggcgggagcgggcggcgacggtacggcttggtctccatcgatgccacggtgaaggtcgcgtcggccaggagcttggcgagggcgttcgcatgggcctcatccagctggcatacgttgtcagcgaaaccggacggcgtgagcttgccgtcatccgaaaaatccttggaacccgcaagtcgcttgcctccaagcgacaccatgcgcgattcgaacgacgccggctcgccctccgcgtccgtcgcgcccagcaccgcggtcacgtcccagtaggaggcgcgcacgaacgccatgcgctcgcgctcacgctcgacgatcaggcgtgtggcgacggactggacgcggccggccgacaatcccgggcccaccttgcgccacagcacgggcgacagctcgtagccatagaggcggtcgaggatgcggcgggtctcctgcgcgtccaccatgtcctcgtccacgttgcgggtgttgcccagcgacgtcttgatggcgtccttggtgatctcgtggaacaccatgcgcttgacgggaaccttcggcttgagcgtctgcaccaggtgccaggcgatcgcctccccttcgcgatcctcatcagtggcgaggtagagctcgtcggagttcttcagcgcttttttcagttcggcgacggtcttcttcttgtcaccgtcgacgatgtagtacggtttgaagccatcgtcgacgtccacgccgaacttgccgaacctggccttgtcgtccgcgggaatctgactgggctgtgcaaggtcacggatgtgaccgaccgatgccatgacggtgtagccgctgccaagatacccaccgattttcttcgctttggtgggagactccacgatgacaagcttgttgccggtgcccattgtctctccttacctacaatgtcattggccttcatcatactcacgcggcatggtcaaacggcaaatcgcgcggctccgcggcggtcaccgcttcttcttcggcggggccggcggcgcccccaccaggccggctcggctcaacggggacgccgtgatctggcgcatcgccagcagcatcccgaacaccagcgacgaaacgccggctatcatcgcgaaggtggagacgtgggcgccgacgctcgcccagctcgcgctcaggctcagaccgggctcaatctgccacatgatgtatgcggcatagcagcagcacagcacacccgccgtgatcatcaccgtgccgacgatctgcacgctcggcgaggacgcgcgtttgccgggcgcgtccatgccggacgtgcgcgtgaatgccatcgccagcagcgcgaagccgcccgccagcagcaggctcatcaccacgtcaaccgggcggtgccatgcccccgcgatcaccgacaggccgatgaccagcgcataggcggccccgaccagcgccatccacgcacggcatccgcgcggaaccgcgaacagcagcagcacgcccgcgacgacggccagcatcgtatgaccggaaggcgcggaattggcgggctgagacacggtgttgatgatgaacggccgcggcagcacacctttaagatatgtggacgcgaaacacagcgcggcgaacaccgcggactgcccgaccagccaccaacgcttgcgtaccagcatcaccaccgccgcgacaacgatcagcagcgcggagacgattacggtgaagttcaacggatgcccggcgattgacgtgatattgcggctgatgaacggggcgaccagagcggacgcccacgacggcaggctgtcgtggaagccgctgaacaccatatcctcgtacgattgcccgtcctcggtgcgcacggcgatccaccatgcgccgaacgagatcgcgatcatcagcacgccgaacaccgcacacagcacacggctcgacacgcgcgggcgcacggtcagcgggtcgcgacgcgccaatccgcgctcgatgtccgcctcgtcgtcaatgtccgccgcgtgttcgtcgggcgcggcggccttacgtttgcgcgcggccggcgcgggcgatccgagggtgcgcagcggatgatccgcggtcgtctccaaagcggaccatgcgctggccggggacgcctgcggcaccacgggttctggctcctgtttcgccgacgagcgcgcctgttctggtgcgggggctgatgccgacgcgccagatgacgtcgtatccgatgcggctgcggtatccggctcattcggcgtgtcagcgggcgcatcggtcgtctccgtggacggcaggcgttccgccgacgttgccgcatcagcccggtcgccgctgacctgcacggcgtcaggcggaatcgcaccgtcacgcgagatttcggcgggatcatcaacacgctgttcttcactcatacttcaagactgtagagcctgtacatgtgtcagtcgcctcatcgcgcccatattccgacagaataatcgaaaacctggccccggcatatcaaaatacgggttgaaatcgccgaaatctactattccccgtgtgaaatcgccgtttcaaggtccaaaaacggcgatttcgcacggggaattgccaagaacggcgatttcaacctgtaatttaagcctcacggtgccgcgacggtcagggtgaggggccaagaaaagaaaaagaaaaccttcacgtacccgacagaggccacttacccttgctgcattcctgccctggggggattgggtgacataacgccacgtgaaggctgtactagtatacatcacccccggatatcgggtgcgcaacgacaataatgcccctccccgcgctcgcgggaaagggcattatcggctatgggagactagcgacgcaccgcgtcacgccggcgaatgatcaccagcgtggcaccggcggcgagcagcagcatgactgcgcccgagatgccagtgacagcggcacccgtcttggcgacgccggcattgctgccgttctggccactgttggcgcccgacgcaccgggcttcgccggggcgccaggctggctcggcttgccgggcttcgtcggcgtgccggccttcttcaccaaagcctcttcggccttgaacagagcgccggtcgcgttgttgatctcttcctgagtcgcgttgtcgttggcgagcaccgccttggcggcatcaagcgccttgacgaacgcagcccacgaatccgccgtgtagtcggattccttcagcttggccgcagcatccaccgccgccttcagcttgtccttagacggcttggcggtcgcgttgacgagcccgttgatggcggttcgcaacgccgtgtaggcgtcgttgacctgctgctgcgtggccgtgtcggagtcgagcaccttcttcgccgcgtcgaaggccttcttgaatgcggcccacgaatccgccgtgtagttggattcctggtacttgctagcggcaaagaccagagtctccagcagcgccttgtcgatgttcttcacggtgtgcgcgtcgatgacgggctcatcggtctcgatgttcgggaagaagccgttcttgtgcagcgccagcaccttcggagcggtctcggacgaatcatccgcggtgtggacggcgaccttcgtgccgttctcgtcggggaagctgaccgtgccgttgccttcggtggcggagtcgccgaaccacagggcagggtggtacgcgtcgaacgagtcgtccttggaaccgcccgcagtgtcgacgatgtactgatccttcgcgccggcagcgtaaatcgactcgatctgtgccatgtaggcgatcggggcgaccttggtgtccttggtgaatccaagggcggacagcttcacggagagcacgacctggttggagtcggagacatatgcggggtcgatgggctcctcgtcaacgaccttgccggttgtcgcggaagtcgtcgtggcccatgcggtgtcgtactgcgtgttgccttcggtggtgctcaccgagatcatgtagtcggccttcatgtcgccgtccacgtcgaagatcacgtccggaatgaaattgttgcccaggtgggaccacgtcttgtcggtgatgatgccgaagctcagcaggccctgcgacggatcggagagctgaggtgcggtgctggaataaccgatcgcgcggatgtcacctgcggcaaggctgcgagcggcgtcaccgttgccggtgtagccgtcgaccggatcctcggcaccgtacacgaacgggacgagctcggagtggtagccggtggcggtgtcgccctggtcaaggccatggccggacacggacagcgtgcccttcttgttgttgaagccgctcagttccgtggtggtttcggagattgccttcggcaccgaagtgacgggcacacgcagcgtggtggcgtcatcctcctgggtgaccggagtcgcggtgatgatgccgctggcgtcggtcacgtactggcggtccttgcctgcgacctgcgcggactgcgtggcgtcgcgagtgcgggtcagcttggactggtcgatgctgatcgtcacgcggaagctggtgctggtcccggacttggcgaccacggtgtccccaccgttgtcgccgctcaccgagtacgtgacgcccggcaccggggtgcgggccgagtatgtgagcttgtacgtaatgtcatgatcggtgttgttcacgagccgcatggtctgcttgtcggtgtagccgtccttgccgaccgggatgacgccgaactgcgcggtgatggcctcgttatcctctccggcaagctgcacgttgttgttcactgcggcgagcgcgtcgatacgaccggagcccacacgcagcgggccgtacgcggtcttgcgatccgcggtgagcacgtcgtggttggcggtgttcatcagctgagccttgaccacgttggcctggtattcgggccgggcctgacggaccagcgcggcgacgccggaggtcaacggggtggccatggacgtaccgctcatgatctcgtcgctgttgccggtgccggccgaagcggacacgatgcccacgccgggggcggagacatcgggcttggcggtgccgtcataggagccgtggatgccacgggaggtgaaggacgcgatggtgtcttcgctctcgctggagtagtcggcgtccttgctcatacgcagcttggtggacagggtcaccgtcagcgtgccgtcatcgatggcgctctgcaggtccttgttctcggcggcgttcttgaccagctggaagccggggatgtcggcgttgccgccgatgccggcctcggggatgttcgcctgcgagccgaacaggatgccggtcgcgccggccttctcggcgttgtcgaagcgggtcttggagccgcagttcacagcggcgtcgttccattcgacgtaggcgatgttgcccttgacggcagcggcgtcatcggcggagtatgccttgcagccttccaggttgtccttgtccttgacgcgcacgaccttgccggtcagggagaagtcgtcgagcttcgcgtagttcacggagtactggccggcgagggtctggcccttgagcgaggccgggccgtcggtcacttcgacggcgtcctgcagcgccttgccggactggctcgcggccacggtcagcgcgctcttggcggtgccgggggcacccatgatgtcggtgatgtcgccgtcgttgccggccgcgatcacggacagcacgttgtctgcggtgaggttatccacggccacgttctccgggtcgtcggaggcgccgaaactgccgccgagcgacatggagacgatgctgatgcggctggactcgtcgccgttgacttccgcctcggtgttgtgcttggcgatgccgtcaagcgcttcgagcaccaggtcggtggtgccgccgttgtcgccgaacaccttgtacgagtagatgccggcctcgggagcggcgccggggccaatcttccagctggcgatgtcgccggcggtcagcttctggtagcctgcggtatcggtcttgcccgaggtgccgtcggccttgacgccgtagcccagcgcggtgccggcgacgtgcgtgccgtggtggccgccctggccgtcgatcgggttggcgtccggggtgggattgttgttgccggcgttcgggttgtacgtggcgccggcgtaatcgtaaccgcccttgaacttcgtcttgtcgagcagcttgctgaccttcgggtcggtcagcgggtcggcggtggagttcagcgcggtctggtaggcctcggtggtgcctgcgccgccgaagtcggcgtgcgtgtagtcgaggccggtgtcgacgactgcgatgttcacgcccttgccggtcttgccggtctgttcccaagtcttgacggcgttgaccagctggtcgttgttcttgttcgcgggggcttcgccactgccgttggtcgtgtcgagcgccttcttgggcgtcaggatcgtgatgtgcgccaccgagccggactgctcggcgagcttgcgcagcgacgccgcgtcggcgcgaacggctacgccggacagcgcatacgaggtggagtagatcttcttggcgctggagtccagcgactgcagctgcgagaacacgttcaccgaggtcttctcggcggtcttcgcgctctgcgtggccgcctgggccgactgcgcgcgctgcttcagcgtggacagcgcggaacgctgcctgctgaagttcttgagcacactgttcttacgttccagcgcggaggggctggtggtctggatgaatgcggtgacctcgcccttcgcctgctgaagctgggatgagaccttgctcttcagattgccggtcgacagagtcggcgtcgtggacgccgcgtcaccttgtgccggagccgcgagcgcggtaccgggcaggctgcctgccatcgccagggccgctacagcggcaacccagcgaggccattgcttattggccattattgttttcctctctttgcgtgcgtcactcacgacgacactgtgaaagaaactagacctggcgctcgtccgatatcgttactttttgtcgcatcgcgtaacatttcaggaacatattgttaacactcacatcacaatgccgtatacgccgactctcacgtcccacgcatgacgcacgccatcgtcagacaggcagacctccatcagaccgcgcttttcagcccctcccatgcggccacagcatattcgaccggtatccattacggcagtcgagcacgtacttccggatcccggcgcatccacaatccgcttatgcccggctataagaaaaaactatgaaaatcttcagctgacggtcaatatatgatacacacgaaccgccatgctgccttcggcggtccggacggcgttcgattcaccaccagagaagcattgtcagcgaaccatcagcgacctacactaagttacggtagcgtaagttagtgtaggccgggcattccggccgcagcgaggtgatgatgatgagcgcgtcaatcagtgcaccatccatacgcaagtccgcggcgcagcgaaaaacagcgcggcgacagaccgcgggcggcgggatgcgggcggccgccacagcgcagaccgcaaccgctgccggcatggccgcgacgcagaccggtgcctcggccaccgcgatgaaccgcgccctcgagcagtatcgcgccgcgcgcgcacgctatcgccaagccaaggccacactgaaagccgccgaacgccaggtcacgccggtcgatgcattcggcaaccgcaagcctcggctgcgcggctggcagcacctcatcaccctgccgttgtgcatcgccgcatccatcgtgctgatctgcatcgcgccggccggaccggtcaaggccgcgtgcgcgatttacggcgcgtcggcgatactgctgttcggcaacagcgccctgctgcacgtcgtaccgtggcgcagcgccaaggtgacgcgcgtgctgtgcggcatcgactactccaacatcttcctgatcatcgccggcaccaatacgccggtgctgttcgcgctcagcccttcgatccgatggccgtacctgacggtgatatgggcggcggcgctcgtcggcacggtgatgcatatcgtatggctgcgagcgccgaactgggtgttcaccgtcgtgtacgtggtgctggggctggcgccggtcacactgcttccggcgctgtggaccgcgcccgcggtgggtccggcggcgaccgtgctgattgcgtgcggcggggccgcctacattgcgggcgccacatgcttcgcgatccgcaaacccaatccgattccgggctggttcgagtttcacgaggtgtttcacatgggcacggtcatcgggtacacctgccacgtggtggccatatatctggtcgtgtgcgcgctgtaaaagacgccggacatgccgtcaccgaacgttcatcaaatcgttcacagggatggttgcgcggtcgataatgtgcggtatccttggtcgagctgagaacgaaacgcacatgatggccgttcatattcgacgcggggaacagcgcgaatcatcaaatggaagggtcgcggcgcaaccggcaccgccggcgcgggccgcaacggaaggaagctatgagcgcgacggccgcgtgctcatcctcgcgcccgatgacctgtgcgggctttcgacgctgagcaagtccttcgagggactggaactcatgtaccgcaaaggctacgccgccgccggcgcgatcgccaactacctggcaaactgaggcgtggcgcacacccccaattatcgtgccgggtagggaaggccactcctcccccacccgacgaaagtcccattccgacatgttcggatgggactttcgcggataatgccagcgactggaatatcagccactagctgcggagccgttaagcgggaagcccggtggacttcccataggcgacgccgaggcacgacagtgccgaggaaacatgacggtctgccgaaggcagtccttggctactccagttccaccgcgccggtatagagctggtagtactccccacgttgcgcgatgaggtcgtcgtgcgagccgcgttcgatgatgttgccgtggtcaagcaccatgatcacatcggagttgcgcacggtggacaggcggtgggcaatgacgaagaccgtgcggcccttcatcaggttgtccataccggcctgcacgacctcctcggtgcgggtgtcgatcgacgacgtggcctcgtcgaggatcagcgcgggcggatcggccacggcggcgcgggcgatggagattagctggcgctgaccctgggacaggccggagccgtcgccttcgagcaccgtctggtagcccttgggcagcatgcggatgaagccgtccgcgttcaccagtcgcgcggcctcgatgcattcctcatcggtggcgttcagtcggccgtagcgaatgttgtccatcacggtgccggtgaacaggttcacgtcctgcagcacgatgcccagcgaacggcgcagatccggcttcttgatgccggccacggagataccgtcgtagaggatctggccctgctggatgtcgtagaaccggttgatgaggttggtcaccgtggtcttgccggcaccggtggcaccgacgagcgcgatcttctgaccgggcttggcgaaccaggtgatgtcgtgcaacaccggcttatcgggattgtagccgaaggtcacgtcggtgaagcgcacatcgccgcgcagcaacgtgtagcggccgtccggcgaggtaatcgcctgctccttggccttgacggccacttcgcgcgcggatccgtgcagtttctcggcggccttgagcgacctcgtgccgtcgtcgccttcctcgcgcttccacgcccagtggccggtctcgtggtcgacctcccgcatggtacggccgccctcgccgagctcgacgttgacgagcgtgacggtgccgttgtcggactccacgggctcgtccatcagcttgaagattcgggaggcgccggcgagcgccatcatcaccatggtcagctgctgggagacctggccgatcgggttgatgaacgaacgggagagggtgagcagcgagacgagggtgccgagggtgagcggcttgacgccggtcaggccgagatcgttgacgccggccagcgaaacggctgcgccgatgatggcgagcaggatgtagagcaggtatcccatgttgccgaccaccggcatggtgacgttgccccaggtgttcgcttcggcggacgcctcgaacagctcctcgttcttctcgtcgaaggtcttctgcgtggcgtcctcgtggttgaagaccttgatgaccttctggccgttgacggactcctccacgaaggcgttcacgtcgccgatccacatctgctgcttgacgaagtagcggccggaacggctcacgatcttgcgcacgatgaagtagagcagcacggtgaacacgatcacgaacgcggtgaacggaatcgagagccacagcatggacagcagcgccgccagcgcggagatgatcgaggagaacatctgcgggaacgactgcgagatcgcctgacgcagcgtatcggtgtcgttggtgtagtggctcatgatgtcgccgtgttcatggctgtcgaagtagcggatcggcaacttctgctggtgggcgaacatgtcgtcgcggatcttcttgagcgtgccctgttcgacggtgacgatcagccactgccaggcccaggacgccacgataccggccaggtacaggcagcccataagcgagatggcgcgcagcagcggcgcccagtcgggatttgtctcccccaccatcggcaggatgtacgtgtcgatgagggactggaggaacagcgcggatccggcctgcgcggcggcgccgatcagaatgcagatcacgatggcgacgacgcgccacttgtattggaagatgtagctgaagatgcgcttgatggtgccaggttcggctttgcccatgccgggtttgcggttcttgaagctctggtcgttgctcatcgcgtctctccttccttggtctcggtctcagattgcgccccggccggctccgcggcgaccagctcctcgggtcgggcctggttcttggtctgggattcgtagatggaccggtattcgtcgcaggtggcgagcagctcgtcgtgcgtgccggacgccatgatgcggccgttgtccatgacgaggatcatgtcggattcctcgacggaggcgacacgctgggcgatgatgatcttcgtggtgtcggggatctcgttgtggaacgcgttgcggatcagcttgtcggtcttggtgtcgacggcgctggtcgaatcgtcgaggatgaggatcttcggcttcttcagcagcgcgcgggcgatgcacaggcgctggcgctggccgccggagacgttggtgcctccctgctcgatgtaggtgtcgtatttgtcggggaattcctgcacgaatccgtcagcctgcgcaagctgcgcggcgtggcggacctcctcgtcggtggcgttcgggttgccccacctgagattctcggcgatggtgccggagaacagcacgttcttctgcagtaccatggccacctggtcgcgcagggcttccagatcgtaatcgcgcacgtccacgccgccgaccttgagcgagccggagctcacgtcgtacagtcgcggcacgagctgcacgaggctcgacttggcggaaccggtgccgccgacgatgccgatggtcatgccggagcgaatcttcaggttgatgtcgtcgagtacgggcttttcggagctgtcggagtagcggaaggtgacgtggtcgaattcgatggagccgtcggccatgtcggtcaccggattggccggatcagtcacggtgctttcctcctgcagcacctgacagatacgctcggcggaggcctgggagataatgaccatgatgaagatcatcgacagcatcatcatggccatgaggatctgcatggcataggtgaccagtgcggtcaggtcgccggtggtcaggcccacggcggcgttgttgccggaggcgacgatctgctgcgcgcccatccatgcaatgaggatcatcgaggcgtagacgcacaccatcatcagcgggctgttgaagctcatgatgcgctcggccttggtgaagtccttgaagatgcgctgggagatgcggccgaacttgcccacctcgaaggattcgcggttgtaggatttcaccacgcggatgccctgcaggttctcgtcgaccacgttgttgagcgcgtcgtaagtgtggaacacgcgctcgaacacggggtgcacgagcacggccagaccgcacaggccgatcgccaggatcgggatgcaggccaggaacaccagcgagatggacggggagatgcggaacgagaagatccaggccacaatcaccatgatcggggcacgcacgcccagacggataatcatcatgtaggcgttctgcaggttcgtcacgtcggtggtcagtcgggtcacgatcgagccggtggagaaccggtcgatattggtgaagctgaagccctgaaccttcttgaactggtcctggcgcaggttcttggcgaagcccgcgcccgcgatggccgcgaacttgccggacaggaagccggcacccagcgagaccatcgcacagatcagcaggatcactccgaacttgatggtggacggcatgctgccgccggtgatgccctcgtcgatcagcgaggccatgatcgtcgggatcaggatctccaggatgccttcgaccgccacgagcgccggggccagcagactggccttcttgtactcgcggatcgacttgcccagcgtgcgcaggacatgtttcggcttgtccggttccacggctttgcgcgcttgcgcaatcgcttcttcggtgctgctcacttgttctcctccttcgtgttgatgacctccgcttccgagtattcgggagccgccgttgacggcgtctgggaggatgtctgatgttcaaattcatgttgtgcgcgctcgatgttggcacgcatgcgctccacgtagtcatgcagcgcatcttgctccgtttgcgtgaaaccgtcgaccagaagacgctccacacgctccccgttcgctttgagatcggcgacgatggcgtcggctttatccgtcagcacaatgcgcttacatcgtgcgtcgtgcgccacggattcacgggcaatcagcccgttcttctccatcagcgccagcacgcgggatgccgtggaacgggtgatgcagaatttctgctcgatggtgtgctgatagatctcccgatcccgattgcgcgccaggaacatgatgatatgcgcgttgccgccggtggtccccttggcggagagcggcatgctttcgcccaaataacggtcgacggccttactcaccgcccgcatttcaatgctgagaatacgttgctccatacccctccataccatgtctgtcgatgcgaaaatcgcattccgaacattcaggcaacataacataataatgcataccatatacaacagttgcatatacaacaatcggcgtgttgaacaattgctcccatccgtcgatactcccattccagcgtccgcaaatgggactttcgcgggaatatagggtaatcgacagcgagagagcggctaacaggcatagcaaaggggtctcatggctgaccatgagacccctgattgcttgttacgggcgggtgcccgtcatgccgttaccggcggcggcgaacgacgttcaccgtgacgaagccggcggctgcgagcagcagcatggcaacgccgatgacggcgacgctggcgccggtcttggacagaccgttgcccttgtcgcccttgtcgttgggcttgcccgcggaaggcttgtcgccatcgtcgggcttgccggtgtcgccggccttggccagcgcggcagtggcggacttcagcgtcgtgagcgcgccggagatctgcgcctcggtggcgtccttgtcctccagcacggccttggcgttatcgagcgccgcggcgaacaccttccacgagtcggcggtgtagtccttctcgtcaagcttcgacgcggattcgacctccttgcgcaggtcggccttcggatcggtcggttcgggcttgggctcaggctcggtcttggcggcgaccttgaacgtcaccgtcgccgtatccgtcgacttgtccgaatacgtcaccgtcaccgtggccgtcaccgtcttgcccgcctgcgcgtccgtcggcgtgaacgacaccgtaccgtccgcggcgaccgtgaacccgtcacccgcgaccgcgaacgtcgtgcccgccggggcatccgcggcggcgccgcccttcgtgaacgacaccgcggcggtggccttctcgcccaccttcgccgcaaccgaagccggatacgccgcagcatactgctccgacaggccaggctcgggcgaaggctcggtcttggcggcgaccttgaacgtcaccgtcgccgtatccgtcgacttgtccgaatacgtcaccgtcaccgtggccgtcaccgtcttgcccgcctgcgcgtccgtcggcgtgaacgacaccgtaccgtccgcggcgaccgtgaacccgtcacccgcgaccgcgaacgtcgtgcccgccggggcatccgcggcggcgccgcccttcgtgaacgacaccgcggcggtggccttctcgcccaccttcgccgcaaccgaagccggatacgccgcagcatactgctccgacaggccaggctcgggcgaaggctcatcggcatccgtgtaggtgatgaccgggctgatgtggatcgacgacttggaggcgccggccgcggcatccaccgagaagcgcagcacatcgccgaccgcgaccttgaccgtgcccttggcggacgccaggcattcgttgaacccggtcgccgtcgcgaaggaatcggtcatcgtcgcggagcagatcacctcgtcgttcttcagcagcttcaggaccacatccttgccgttgctgttcgactgacggatgtacggctcgacgtgcgctccggtcaccttgtccagcgtgaccttcacggaaccggccttcggcgcggtccaggccatcgccgtcgccgcggaatcacccggattgtcggcgatcaggccgtggatggcgctgcggtcggccggaaggctcttgttctgatagtccacaccgacgccgtagtacttgtcgtagtacgtctgcgggtacacatcggaaccgaaatcggtaatcgtctgccatttgccggacacctgacgctgcgacgtccagatcgggccctgagagtcggtcttgaagtcgtcgacccagttccaggcgttcttctgcacgaccgtgtagtcggcggtgacggtggagccgtcggcgtagaagcgcagcacgtcgccggcctttactgccgcggcgtcctccagcttggtgccgtcacggtacacggccttgagggccgaatccggctcggcggtcaccagggccagcaaatcggcgacggtggtcggggtcttcgaggtgaacggcacatagatgacgttcgcgccgtccgcggtgccggtctccagcttggaggtgccgagcgccgccggagcggtcacggtgaacgtggccgtcgcctcgatggactcgttggtgtcggagaaggtgaccgtcaccggcacggtgatggtgccggcccgggtgctggtcagcgtgacctcaccggtggcggcgttcacggacgcaccggccggggcgcccgcgccgagcgcgaacttggtgccggcggggatggacgccgcggcgctgtccgccttgagcgtgaacttgggcgtgcgcttgagcgcgacgcccgcgccgccggacacggccgggtacagcacgttgtacttctgcgcgttggacttctcgacgttgaaggtgacggtcgcctcgtcggtggtgtcatccgagtaggtgacgaccacggtcgcggtcttggtggtgccgtacgcatcggcgccgggcgtgtaggtgaccgcgccggtcgcggcatccacggccacaccgtcgaccgcggtcttcagcgcgtaggacttgacgccggtcggggtggcggcggcgccgcccttcgtgaacttcaccgtagcggtggccttggcgccgaccttggcgctcaccgcgtcgtaggaggcagcgtactgcgccgtctgggactcgacgggtgccacatcctgataggtgacgaccggcgagacgtacaggtccggagcggccgcgccactggccgcggtcgccgcgatgcgaatcacgtcgccggcgttcacctgcaccgtgcccttatccgatttcaggcaattgacgaagtcgtcgttcttggtctgcgcggtggagatgtctgcggtgcacagcgtctcgccgttcttggtcagtgcgagcgtcaccgtgcccgaagcgttggcgttgcgccgctgcggctcgttgtcgcggccgagtgtgaccttcacggtgccggccttcggggccttccacacgatggcggtgccgccggccgcacccgggtcgtcgaccaacaggccctgacgcccggggcggtcagctcccaccgccggcaggtccgacaggttgccggtgagtcccgcgccgtagtactcgttgtacttcgacatcgggtactcggtggagaacgtcgtgatgtccgtccagtcaccgtcggcgccattctgcttctgggagttccagaccacgcccgtggcggtcttgaaccagtcgacccagttccaggcgttcttctgagcgatggtgtattcgatcggcgtgtttgaagtgccttcgacctcgaagcgcagcacgtcgtcggactggatcgccgcgtcggccgccagcttgttgccgccgcggtacacgttggcgactgatccgtcaccgaccgtcaggcccgcgcgaagctgcttgactgtggtcgggttcttcgcggtgaacggcacgtagacgaccttggagccgccgaccgtggcggtctcgtacgcgttgaccttgccggagacggagagcacgttgctttcgacggcacccaggtccggggttcccttgatggtgttgccgaagaagtcgttcgtgaccgcgtagtcgttcatgtcggagatgaccttgccggcattgatggccggggagccgtcaacgggcttgtatccgtcgaactcgctgccggaacggccatagaccgaaccgtcggccttcggcgcgctcggcgcgtgtccggcattggccagcacggtcttcacatcggcgacctcgacggcgttggaatcggaggcgggcctgttcgcgtaattgacgtacatgttcttgtcgtacgtctggccgccgtgctggttgccgcggttccacgtctcggtcttcttggtgtcggtcgcgttgatgaagatgttgttctcgaacttcgcctggctgttggatcggccggtcagcaccgcgctgtccttaccgatgtagacggtgttgttgtagatgtggttgcccggaccgttgctcggcaggtcgaacacgccgcggcggtcgttctgcgagatgttgtagcggaacgtcgtgttgatggcgtactggttgcagatcatcagcgaggcgaacgagttgccgtacgagtagttgtactggtacagcgtgccgtcgccgtaatcggcgtcccacgcctggccgtcgccgttgccgtgctcggagttgaggttgttgtacatctcgttgtactggaagatcgggtccttgcagcgccagggccagatgcccgccgcgacccagccgccgtacctgccgccgtgctcgcggtcatgcgggtagtcgacgtcgttcatgtgcttcgagacgctgtcgcccacgttgtactggatgaccggacggtcgcagtacatgagggtgatggcgtcgccgcccgcacccttgacgtagttgttctcgatggtcacgttggtctggccgtacttggcgatcaggtcgtcgtcgatgctgccgtcgccccacgccgcgtcgatgaagttgaggtacgcggtgtagcccacggcgatgccccagcggtccacgtccttgacgatgttgttcttgatggtgatgtggtcgaagcgcgagatgtggttctgcagccacgtgttgtccgcggcgttcttgttctcgcgggcgtagtgagccatgaagtagatgccgccgttggccatgtgcttgttgtagatgttgccgtcacatcgccgagctgcaggagaagggccgcttcatccgcatcaccgacgccggcctgcgcgagtcgcatccgcacgacatcgtgatgaccaccgaagcgccgaactacaccggcttccacaactgataggccgatgccgatcggttcataggattcggctcatatgaatatgatggcgggctcccctcacgatttgcgaggggagcccgccatcttgcatataggcccggccgcgtcgaatcggctccgccgcccgcgtcgtggcgggcgcgggcaggcctaccgcagccgcatccagacggacgtatcctgcggcagccggccgtcatcggtgagcggcgcggacgagagcagcacctcgccgttgggcagcgaaaccggtgtggtgccgaaattcgtcagattcgcccaaccgttggcacgacggtaggcgatcacgccgccgggctggccgtctgcgccgtcgcgcatgccgctcggacggttctcgggaagcaacgtgcaactggtgtccggagtctgcatctcgtgacgcagccgcagcacgcgacgatagaagttcagcatggagccgtcgtcggcgtcctggatgtccatggcgaaatccttgaaccacgcgggctgcgggaggtgtggttcggcgtcgctgacggcaggggagaacccgaacgagccggcatggacgtgcctcttgtcggacgtgtacgtctcgggcacgtcggacgcgacccagggcagcggcacgcggcagccgtcacggcccttggtggactgcgcccgcgaggtgcgcaggccggagggatcctcgatgcggtcccatggaatatccgccacctcaaacaggcccagctcctcgccctgatacacgtaggccgagccgggcagcgccatttcgagcatcagtgcggcgcgtgcccgcaatgcgccggcctggcgatcctcgatataggtggtgccgtcacgcagcagccagtcgttggcgatctgatggtattcgctggtcggcacttgcggcagcgcgtaacgcgtggcgtggcgcggcacatcatggttgctcatcacccaggtggacgttgagcccgacctctcggcgcacgccagccccttgtcgatggctttgctcatcgcgtcgaaggtccaatccgccttggcgaactcgaagttgaacacctgccccagttcatccggtgacgcgtacaggtactggcgttccggccggacccatgcctcggcgaccgcgaagcgcgggggatcgtagcggttgaacacctcgcggcgccactcacggtagatgtcgtgcacctcgtcgcggtcgagcactgggtgggatccgtccgcgggcatgtcgttcgtgctcatcaccacgtagtcgtcgaggtcgtcgcggtcgaggtccttggcgagcccgtgcgccacatcgatgcggaacccgtccacgccgtgatcgcaccagaaacgcagcgtctcaaggaaatcggcgcgcacgtccgggttcttccagttccagtcgggctgctccttggcgaacatgtgcaggtaccattggccgtcgtccacgcgcgtccatgccggacctccgaaatggttctgccagcgggtcggcggctcgtcgccgttcgggcccttgccgtcgcggaagatgtaccggtcgcgcgcaggggagccggggccgtccgccagcgcctgacggaaccaggggtgcaggtgggagctgtggttgggcacgatgtccaccaccactttgatgtctgccgcatgcgcggcggcggccagccggtcgaagtcgtccatcgagccgagcttcggatccacgtcacggtagtcggccacgtcgtagccgccgtccgcgagttcgctcgggtagaagggcgacagccagatcgcgtcgacgcccagctgccgcagataggggatccgcccggtgatgccattgatgtcgcccagaccggagccggtggtgtcctggaagctgcgcgggtagacctggtagaccacggcctgccgccaccacagtgccgggtcggtctcggcgtcgtgccgcgtcgtgatagattgcgtttcctctgccatgtagtcctcctggccgtatgcatgtaccgctgccgttcctgcgctgccgtaatggcgcgtggccggtcgcgtcccgaatgtccaagattatatccgtcccgttccacccgaagcggcgggtcatgtcgtgtagcgacaccaagcttccgtcgtgcccgcgtgtcttcttagcggcgctttagcggggtcccaattggatagggcaagagcatgacgcgctgatcgtcgaccgccggctgcccgacggcgacgggctggatttgattcgtaccctgtgcggctccggcgtcactacacccgcgctgatgctgaccgcgctcgcgcaggtggacgacatcgtggaagggctggactgcggcgtgaacgactacctgaccaagccgttccgcttcatcgaactgcaggcccggctgcgcgcgctgctgcgggggttcaacgcccagacggccagcgtggtggtgggcgactgggcgtgctcaagccgcactccggcatcatcgaggatccggacggcagggcggtgtcgctcgggtgcgcgcgtcatcgccaatgggcgcagatccgcgtgtccgaccatggaccgggcatcggcggcgatcccgaacgactgttccgccgcttcgcccgggacgatgacggcaccgcgcgccaagggtacgggctcggcctcgcgctcgcccgtgatgtggcgaaccggtatggaggctcggtcgcggtggagtcctcgtccccgtccggcactacgatgctgctctctttcccgctggcctgacggcgcgtccccggtctgctatagcctgtaacgttccctaggaaaacacagcaggaaaggcggcttgcgatggtcgacagccatgatgcggaaacgtacagcgcgaaggattcgcgcctgatctggattgattgcgagatgacgggacttgacatcttcggtggcgacgagctcgtcgaggtgtcagtggtgcctaccgatttcgacctcaacgtgttggacgaaggcgtggactacgtcatcaagccgtccgacgccgccgtcgcgcacatgaacgacttcgtgcgcgccatgcacacccgttccgggctcatcaacgaatgggagcacggcctgagcctcgaagaggcggaacgcaaggtcaccgaatacgtgctgcggttcacgccggacggagtcaggccgctgctcgcgggcaacaccatcggctccgacaagaaattcctcgaccattacatgccgggtctcatgagccatctgcactaccgcagcgtggacgtgagcacgctgaaggagctcgcgcgccgctggtaccccgcggtgtatgagaaccgccccgccaagaacggcgggcaccgcgccctcgccgacatcatcgagtcgctggacgagcttcgctactaccgtcaggcgttcatggcgccggctcccgggccgaacgaggccgagtcgaaggccatcgccgaccagatcgtcgccaccagcctgctgaataagtagacggccggtctcgaaaaacagaaaacgtcacgcacacgactgagaggaacgacaccatgaccgcgaacgattggaccgccatctgcgacaagccgcgcgacatccgcctgatcgtggcggacatggatggcacgctgctggacggcgacagcaacatccccgatggcttctggccgctgctcgacgagctgcacgccaagggtgtcgagttcgtgccggcttccggccgccagctcgccacgctgcgctccatgttcgcggaccgcgtcgacggcgccatgtcgtatatcgcggagaacggcaacgtcgtggtcgccgacgacaacgtcatcgacgtgcacggggtgagctggggcatcacgcgtacgctgatcgatctggtggacgccgcggtggcgtcgggctcgcatgacatcggactcgtggtatgcggtctgaacacggcgtacatccagcggcaggacaggccgttcgtcgaggaatgctccaaatactacaaggcgctgcgcatcgtggacgacctgcacgaggtgctggagaccgaggacgaaaccgtgctcaaactggcgatcttcgatttcggcgacgcgcaaggcatggccgcgaacctgctgggcgatgtggaacgcacccatcaggtggtggtatccggagcgcactgggtcgatatcatgaatcccggaaccgacaagcggcagggtgtcgtcgcgctgcagcggcatctcggcgtcacgtccgcgcagacggcggtgttcggcgactatctcaacgatttgcagatgctcgacgccggcgaatggtcgttcgccatggccaacgcgcatccggatctgaaacgcgcggcgcggtacatcgcgccggccaacaccgagcacggcgtgctgcaggtggtacgccggctggtctgagcccgcgggcgagcgatgtcatacgccagggcgcgcggatcgtgcgtgatgcatgagcttaaggagggcatatgcggcagtctgaggcgctcgcgattctgaacgccggcgcgaacgtgttcctgacgggtgcgcccggcgcaggaaagacgtacgtgctgaacgagttcatccggcaggcgcgcgcagacggcgcgaacgtggccgtcaccgcgtcaacgggcatcgctgccacgcatatcgacggccagaccatccactcgtggagcggcgtcggactcgccaacgtgctgacgccgaatctgctgaagaccatcaagacccgtcgtcggcgcaagatacaggcagccgacgtgctcatcatcgacgaggtgtcgatgatgcacgcctggctgttcgacatggtcgatcaggtgtgccgtgaagtgcggcatgatccgcggccgttcggtggattgcaagtggtgctgtccggtgacttcttccagctgccgccggtctccgtgtccgggcgcgaccgcgacgtgctgccgcccggcccggatttcgtggcgtcccgcgaacggtacgcgaaggccggactcaatccggaaggattcgtcaccgaatcgctggtgtggggcgaactcgcgccggtcatctgctatctgaccgagcagcatcgtcaggacgacggccggctgctgcacgtgctcaccgacatccgtgccggatgcgtggatcaggatgaccgtgacgcgctcgtcacgcggctcggtgtgacaccgcagccgggcgaggtggcggtccacctgttccccgtcaaccggcaggccgataacctcaacgattccaggcttgcgcggatagacaaggagccgcacgagttccatgccaagcagatggggccggcccatctggtcgaacggctcaagcgcaacatgctggcgccggagtgcctcgtgctcaagaccggtgccgccgtcatggcgctgcgcaacgacgccgaccaccagtatgtcaacggttcgctcggtaccgtgcgcggcttcgccaacgagagcaagggcggctggcccatcgtcgaattcgagaacggcaacatcgtcacgatgaagcaggccacgtgggagatgatggacggcgacacggtgatggcgtccgtggcgcaggtgccgctgcgctgtgcgtgggcgatcaccatccacaaatcgcagggaatgaccctcgaccgggcggtgatggatctgagccgcacgtttgcgcccggtatgggatacgtggcgctttcgcgtgtggaacgcatgggcggattgtatcttgccggcgtcaacgagcgcatgttcgcggtttcagcggatgcggtgatgctcgacggcgatttgcgcggcgggtcacaggccgccagcgcgcggctgggcaacgagggcgtggctgcgttccggccgcaaacgcctcacgaggacgagcctgctggcgaattcgaacaagccgagctgttctagcggtggctgctttcggatatgggactgctattgggcggaagtagatatcaatcccgcgaaagtcccattatgacgtcgccgaatgggactttcgccgggtagtggtgcgctagcgcagctgtgagatgcgtttgccgagcgattgcaccgatttgaggcttgcctcgtagcgcgcggcggcaccgaatatccagcgcaggttgcgggtcgcgctgccggccattgatggcatgtacgcagccatgcggtggcggccaatgccggcagcagcacatatgcggcaatcgccacgaggtttttctcaaccatgcgattgctgaaatcggcgatcgcgatgacggtaaggctcaaagcgctgatgaaggcgacgatgatgcgctcggcgacatattgcccgggccgataagacaggcggctcccgcgagcatagtgaagacagccacgctgacggcttcggacatgtatctcggcagcatcggcaggtcgcacagcaatcagcgacacgggcaaagagaaagaggcgtacagggaccatgcgcgcaacggttgacggcctttctgatgaaccgcccgcagtgctatcgtcacgcagcccagaccgaacagcaccgcgccgggcggcaatgagcagaacaagcccggtaccgtgccgggtggcacgtcgggtgatggctcgccttccgccaagccgggcgcgaacacgggcgtagttgccgggggcaagacgtccgcggccgattcgctggcccataccggtatcgacatgtcgctggtgaccgtcctggcgatggccatgctggcggccggcattaccctcgaacggctgcgccggatgacgcgataagcgcggcacggctgcgaggccaatacgaaggccgctcgctcggtgagctccgggtgggtggcctttttcgatactgcgggtttgccgaactgaaccgggcccgcaatgtccccgaacgcgaataccttggaacccatgagttccaaagcacttcgaatgtccaccatgttcctgcgcacgctgcgcgaggatcccgccgacgccgacaccgattcggcgaaactgctgctgcgcgccggctatgtgcgcaaggcggctcccggtatctggacctggctgccgctgggtctgaaggtcctcaacaagatcgaggccatcgtccgcgaggagatcgacggcatcggcgcccaggaggtccacttcccggcgctgctgccgcgcgagccgtatgaggccacccaccgctgggaggaatacggcgagaacctgttccgtctgaaggaccgtcacgaggccgactacctgctcgcccccacgcatgaggaaatgttcacgctgctggtcaaggatatgtactcctcgtacaaggacctgccggtcacgctctaccagatccagaccaagtaccgcgacgagttccgcccgcgcgcgggcctgatccgcggccgcgagttcatcatgaaggacgcttactcgttcaccatcgacgaggagggcatgaagaaggcgtactacgacgagcgcggcgcctacgagcgcatcttccagcgtctcgacctgaagtacgtgcccgtgttcgcgatgtccggcccgatgggtggttccgcgtccgaggagttcctggcccccatggcgattggcgaggacacgttcgcgctggcgccctccggcaaggcgtggaacgtcgaggcgctgaccaccccagagctgccggccgtggacagctccgccgtgcccgcgatggaaagccgtgaaaccccggattccaagaccatcgaggatctggtcgccaccgccaaccgtctgtacccgcgtgaggacggtcgcgaatggactgccgccgacacgttgaagaccgtggccgtgactgtgctgcaccccgaggacgatgatcatgaggggccgtggcgcgaggtcatcgccgtggcgctgcccggtgaccgtcaggtcgatatgaagcgtcttgaggcgcagttcgcgcccgccgagctggaggaatccaccgaggacgatctcaaggcccatcccgagatggtggccggctacatggggccgatggtcttcggcaagcagggcgaggccgcgggcgtcgccgaaccggtgcgcttcttcatcgacgcgcacgtggctgagggcactgagtggatcatcggcggcgacgaggcgggcaagcaccgcttccacgccgtgtacggccgtgatttcaaggccgacggcaccgtcgaggcggtcgaggtgcgccatggcgacatgagcccggatggttccggcccgctgagcttcgagcgcggcgtggagattggccaggtgttccagcttggcctcaagtactccaaggcgcttgacctcaaggtgctcgaccagaacggcaagactgtgcccgtgtggatgggctgctacggcatcggtgtctcccgcgtgctcgcctgcatcgctgagacgcatcatgacgagcgcggtctggcatggccgaccgtcatcgcgcccgcccaggtgcacgtcgtcgccaccggcaaggatgcggcggcgttcgacgcggccgagaagctggtcgcagaactggaggagcgcggcatcgaggtcatttacgacgaccgcaagaaggtctccccgggcgtcaagttcaaggacgccgagctgatcggcgtgccgctgattgcagtcgccggccgtgacaccgtgaataacggaacaatcgagatccgcaaccgtgacggctccgattccgccgccgtgccggtcgccgacgctgcgccgacgctggcgtcgcgtctggacacgctgctcggcaagtagtccgacagctttcctgatcgctcgaagtggggtctttcatgcgaaagaccccacttctgcgttttatcccgggaatccaaacgaccagtgtcaggaacgccaataccgccagcaggatattggtctgcttgttgcgcagagatgcaagcattatgcagatcgctatgagcaatgcgacgaattccaggcaggataagatgtacgcgatgatgcgcagacgattcatcgccgtgccgttctgccttgcgctgctcgccacagtgacagcggccatgattacggcaagcgtcagggcgataccggcggtgatgagacctggaattcatgtctgcggtgagctggagacatacagctgctctgctgcgcggccggtggtcgaatcggtcagtcccggcacatgcggaccgaacgtcagatacatggcgaagtgtccgatggaagcgcccaatgcgttgatgatgatcggacggatatcggtgatggcggtgttcgggttggcgaccgtctcggcgaagatggcacgggtcgcgggaccgatcagagactcgatctcatgcaggtcgttgatgtccttgacgaaatcagcgtggatgccgaactgcggcaggaagtcgccgagcgcatcgactgacgccccatacaggttcgtcggcgcgatgatgcggccaccgccctcccccgcgcacatcagcgcgtatgacaccgcggccatgcccgacgacaccgccaccgcgccgacgccaccctccagggcggcaagccggcgttcgagcgcatcgacggtcggattggcgactctggaatactcgaacccggatatctcaccggcggccagatcacggccacgagcggcgttctccaaatcgaaggcggcggaggcgtagatgggcacgctgaccgcatcgtcgttgcggttcgcattatacccgccatgaaccgcaagcgtgctgaaatcagtcatttccaaatccctttcatccgcatgaccgccaaaacaacgaacaccgaccgccatatttcttcaagacacgacagtgcgggcgtcatcgccatgaacgtcgacgcccgcacggcccgcaccgcatgataggcacggtacgcgaccctatgcggccacttccgtcgtcagccggtcgagcacctgaccgcttacgccgtcgatgtccagcgcctcgaacgccttgtcgaagccctgccccagatcctcgatcaggtcggacacgtcctcgatgcccaccgacagacgcaccagctcgtcggtgatgcccaccttgagacgctcctcgcgaggcagctcgaaatgcgtcatgcggcatggcagctcggcgaggctttccaccgcgcccagactgacggcgagatggaacacgtgcaggttgtcgagcacgatggacgggtcgacccccggcaccacttcgaaggacagcacaccgccgaaccccttgagtccattctcggcgagcagacggttgcggtcgccatacacgcccgggtaatgcacggcccgaacgagcggatgcgccagcaggtattccgccacagcctgcgcgttgcgctgctgacactccatgcgcagcgccaacgtctggatgccacggcgcacgtcgttgcattcggtcggggcgagcacgccgccgaaccggttctgcgcgaagtagatgccattgccgacctcatcgtccaacaccaccacaaggccggcgttcacctcggaatggcctgccaggtatttggtggccgaatggatgacgatatccgcgcccaaatcgagcggctgctgcaggtacggggtgacgaacgtgttgtcgacgatggacagcgcgccgtatcggtgcgcgatggccgagatgcggttgacgttgttgatctgcagcagcgggttggtcagcgtctcgaaatatacggcgctggccgcgcggccgcctctgtcgcgcccgctgatcgcggcgtcgagcgcctcgtagtcggcggtgtcgacgctgtcgaactccagcccgcgctcggcgaagtactcgttgaacagcgaatacgtgccgccgtagatgttcttgccgaccacgatgcggtccccgggtttgaagatggacagcaccgcgtgaatcgcggcgagtccggacgcgaacgcgaagccgcgagtcccgtgctccagctgggcgatctgcttttccagaaagtcgcgggtcgggttgccgctgcgcgcataatcccagcggggcatggcgttgaccgattcgacagcgtatgtggatgagttgtagatgggcgggttgacggctccggtgttgttgtcgttgaccggcaatccgtggaccagctgagtgttgaacctcgtcatgagcaccccctgcggtttttttggcgggtttcccgatgaaccccgcgtgacccttatgaaggtagtcagcggccggcggccccgcaacccggacggcatacacattatttataggatgctcaaaacccttgcaaacactggattttcacgacttgcacggcatctttgacgaccggcaagagccatttgcgacacgcacggaatgttctggcggcaaccaaggcgcgactaagtgcgacatggcttcgcgcagaaaccgacgctacgacccatcggccatcgtgatgttcgtcacatccgggccctgtagggcatttggcctcaccctggcagcggaaccgggcgatatgctggagtgacgccggcgggattcacgcgccggagggacccaagcaaaggagctcgcccatgaccaccgtagccatcgtcggatgcactcacgcgggaacgttcgccgccacatccattctcaagcagcatcccgactggacggtccacgtattcgaacgcaacgactcgctgtcgttcctttcctgcggcatcgcgctgtgggtcggcgaccacgtgtccgatccgaagcgcatgttctattcgtcgccgaaggccctcgccgaagccggcgccacgatgcatatgcgccacgacgtgctcgatgtggatgtcgccggcaaggtgttgcgcgcccgtgacatgaacaccggggaagtcggcgaataccgatacgacaagctggtgatcaccaccggttccgcgcccgtggtgccgccgatcgacgggctggacgaggcgctcgaatcgggacgcgtgctgctgtgcaagaactgggaccatgcgatggcgatcaaggagcgcgcgggcagcgcgaaatcggccgtcgtgatcggcgcggggtacatcggcgcggagatcgccgagcagttcagcgaaatcggcgtgaagaccacgctggtggatgcgctggaccgcgtgctggcgaacaatttcgacgcgaccatcaccgatgacgtggagcaggcgttcgacgagcatggcgtgaccctggcgctcggccagaaggtgacggcgttccggccggcggccggcagcgacgggatcgagggctccggcgtgaccgtggtcaccgagaagggcgagtacacggctgatgtggcgatcctgggcgccggattccgcccgaacaccgcgttgttcgcggatcagctgcgtatgctgaagaacggggcgctcgtcatcgacgactacatgcgcgcctcattgccggacaacacggtgctcgacgacgtgttcgcggcgggcgacagcgccacggtccgatacaacccgaccggcgcggacgattacatcccgctcgccaccaatgcggtgcggcaggggctgctcatcggcgagaacatcgtcgccgcaacgaagcggtatcccggcacgcaggccaccagcgcagtgcagttgtacgatctggcgatgtccgccacgggactcaccgccggcggcgcgaaacgccgaggcatcgccgcgaaatcgacgacgatcacgcaggattaccgccccgatttcatgctcaccaccacgccggtgacgaccacgctggtgtggagcccggtcacccggcgcatcctgggtgcgcagttcctgtcgaagcatgacatctcgcaggcggcgaacgtcgtgtccgtggccattcaggcggggttcacgatcgatcagctcgccggcgccgacctgttcttccagccgaacttcagccagccgatcaatttcgtcggagccgtggccattcaggcagtggccgaaagctgaccccaatcgttgactcgcgctcaacgcggacgcgaaagccccgatcattgggaaacagccattccggttctcgtatccgcggctaatgcgagcacacgattcgcatcagccgcgtgacctgttcggcggtgcgggccacgttcgcacgggcgtcgcgcagcagctcatcgaggctcgcggcactcggcgcggcaccgaagaccgcatcgatgccgcgcccgtgcagacactcgatgccgtcgccgacgcggccggcgatggcaatcaccggtttgccgtgacgcttcgccacggaggcgaccccgaccggcgtcttgccgaacatggtctgcgcgtcaatcgaaccttcgccggtgaacacgatgtccgcccattgtacggcggcatccagcccggattgctcgatcaccaagtcgatgcccgggcgaaaatcggcgtgtagcacggcgagtagcgccatgccgatgccgcccgccgccccggctccgggatgatcggcgatgggcatgcgggtacggtggccaggacgggaacggtggccaggagacgatgattcagccacggccgcttcgacttttccgccatcgccattccgttcggcgggcacctgttcagcgagcgcacgttcgatgaccgacgagacgtgccgcagggcgccgtccaacagcgtcacgtcttcgcgactcgcgcccttctgcgggccgaacaccgcgctggcgccctcggggccggtcagcggattggtcacatcgcaggcggcgatgacatgcacgtcgccaagccgtctgtccaggccgctcaggtcaacgcgctccacttcggcgagcgccgccccgcccggccgcacgtcacgcccgtcatggtcaagcagccgcacccccaacgcctgcaggagaccgcagcccgcgtcgttggtggcgctgccgccgagcccgacgatgatcgtctcggcgccggcgtcgagcgcggcccggatcagttcgcccgtgccgtatgatgtcgtggccttcgggtcgcgttcggatgggcgcagcagcgccagtccgctggcggcggcggtctccacgaccgcggtgcggccgtcgccgagcagcgcgaacccggcctgcaccgggcgtccgaggggatcgtgcgcgccggccgtcagcatcgtgccgccggtggcgtcggccagcgcccgcgcggttccctctcccccgtcagccatgggcaggcatcgtatttcggcgtcggggtcaccgcggcggatgccttcggccatggcccgtgccgcctcggcggcggtcaggctctccttgaaggaatcaggcgcacataggtatcgcatcgccggatcacgcctgctattcggtgcgcagcgcggtggccgggtcctgcttggcggccttgcgcgacggaatcaggccgccgataagggtgagcaccatgctgagcaccaccaggatcaccgctccggccaccggcagcgcggcgttcacgtcgttggtgccgatgaaatggtgcagcacctggttgcccggtatgagcagcagcagcgtcacgcctatgccgatcaggccggcgcacaggccgatgagtccggtctccgcgttgaacacctgcgatacattgcgcttcgaggcgcccatcgcgcgcaggatgccgatctccttggtgcgttccagcaccgagatgtacgtgatgatgccgatcatgatcgacgacaccaccagcgacacggacacgaacgcgatcagcacataggagatcacgttgatgatcgtcgtcaccgagctcatcatcaggccgacgtaatcggtgtagacgatcttgtcggccttgggcacggtcttgttgtagtcggtgatggccttggacacgtggtccttgtcctcgaagctgtcggtgtagatgttgatcgtcgagggcacgtcccggctcaccacgccgaacgcggcgaggttgtcgtcatacgtgccggtcgagacgtactggtcgtagatcttgaccagcacgtcctgcgaggcggtggcgatgtactggtcgaagctgtcggcgagctgctgctcgctcatcgccgccatccgctgcccgcccgcggctgactgcccggcctgcccgggctgagccgactgcgctgactgcgactgcatcatggccttggccatgttcgccttgtcgctcacgccgagcgaggccacataggtcttggcatcagcggccttcgccgcgtcgtccgacggcgagaacgccaggccgttgagcacgtcgcgggtcttgtccttctcctggtcggtgacgatggcgctggagttcgcatggtcgatcagctcgtcggtcagtgcgcgggtgtagccgattccggtggccagcggcgtggcggaggcgtccttgatcggcttgaccacgcccacgatcttcagctgctccgccgagtcgaagcgctctgcgatggcgtccgcgtcgtcgccgatgtacgtgtagtcgccgttcgtgtccttcacgtactggtctgcggcgggtatcatggccagcgtctgccccatcgccgtcgcgtagtcgatcttgccggtgggtgtcttgaccgtctcgccgtcgttgagcttgttcatcatgtcggtgtagtcgctggccttgagcaggcccagctcatacagcgtggtgagcggtaccttgttgtcgtcgtcaagcacgagcacgacctggtccttgccggtcggccatgcgcccttgaccacgcggtagttgtcggtgatgaccttgctgatgagctgatcgtccttcgcccccggcatgatttcatggaacgagtcgggcgacgcgctcgtgtcggtcttgccggtcagcaccgtcatctgcatgctcgtcatgtcggacatgctcgacgactggcccatcgagctcatccgcgcagcgttcgatgtcgaatcggacttggcaccgatggtgacgccgttcgcggtgaccagcgtgccgtcgggatcgtggctgaacacggagaacttcacgtcgtacgtgtattggatgccggttccgccgacatattggcgaacctcgctgttggggtcgtccagatacttcttgaaatcggcgaggttgttcttcgtgatgctgctcgtcaggctggaggcctgcttgatgctgcggccatccgggtagatgccgtcgttcttcgccgatctgcctccggtctccttgccgcccgcctgggcgcccatgatgctggtcatgtcgaaggtctgcgagtcgatggtgatcggataggcggtcatcgtgtcgcgctgtatgctgtcgatgtacgcgttgacgccggtggaaaccgacaggatcagggcgatgccgatgatgccgatagacccggcaaacgaggtgagcagcgtacggcccttcttggtcctcagattgttgaagctcagcgcgatggacgtggcgagcgacatcgaggccttgcccagcctcttgtgtacgggtgcctcggacgcgccctcctcgacctcgtacgggtcggaatcgctgcggatcacgccgtcgcgcagctggacggttctggtggcgtactgctcggcgagctcgggattatgtgtgaccatgaccaccagacggtccttcgccacctccttgagcaggttcatgatctgcacggacgtgtcggagtcgagcgctccggtcggctcgtcggccagcacgatgtccgggtcgttgaccagggcgcgggcgatggcgacgcgctgcatctgcccgccggacagctggttcggcttcttgttgatgtggtcgcccagcccgacctgttcgagggccttgcgggcacgctcccgccgttcggtacgggatacgccggagatcgtcagcgcgagctccacgttcgacagaatcgtctggtgcggaatcaggttgtagctttggaacacgaagccgatcgtgtggttgcggtacgaattccagtcacggtccttgtaccgtttggtggagaccccgttgatgatcaggtcgccgctgtcgtaccggtccagtccgccgatgatgttgagcagcgtggtcttgccggaacccgacgggcccaatatcgccacgaattcgctgtcgcgcaggttcaggctgacgtcatccaacgccttctgtacgaaatcgccggtcttgtattgcttggaaatcgacttgatctgcagcacgatgctccccttattacccatgggtggttcgtcgtatgtctccatgatttgcgatatgacaccactgtatccgacccgttcccccagcgcctcgtgattcactgcaagcattgggaataaaaccgacaacaaacgactttgcgtcgctttgacatgacggaaccgtgacggccctcgcgcgtcaagtgtgtgtatcaagcatgctttgcgtttttttagcgcccccctcagcagttttcccatacagtcgaaaccatgacaggactcactacatctgaagtcgaagaacgccgcgcgcgaggcgagggcgaaaccggggcgcgaagcgtcaccaaatcgacaggcgcgatactgcgcgagaacatctgcacgctgttcaacgcactgaacttcgctatagcgatactgctgttcgcggtcggcgcgtactccaacatgctgttcatcgcgatcatcatcctcaacatcgtcatcggcatcgtgcaggaattcaaggcgaagaaactcgtcgacgagctgacgatcctcaaccagccgcacgcggtggtgctgcgcgacggcaaggagacgaccatcgaggccggcgacatcgtcaaggacgatgtcatggtgctggattccggcaagcagatctgcaacgacgccgtggtcatcgacggccgtctggaagtcaacgaatcgctgctgaccggcgaaagcgactccatcgacaagaccgccggcagcgagctgtattccggcagttcggtgatttccggccgcgcgtacgcccgtgtgacgcacgtcggcgacgagaactacacgaattcgctgatcaacgaggtgcgccaggagaagcgcgtgcactccgagctgctggattcgatgcgcaaggtcacccggttcaccagcttcctgatcatcccgctgggcgtgctgctgttcgtcgaggcgatgttcctgcggcactccggcacgtacgacgccgtggtgtcgtccgccgcggcgctgctcggcatgctgccgaagggactggtgctgctgatctccgtgtcgctggccaccggcgtgatccgcctcgcgaaggccaagatcctcgtgcagaacatctattcactggagacgctggcgcatgtggacgtgctgtgcctcgacaagaccggcacgctgacggacggcaacatgagcgtggaccggatcgtgccgctcggcgagcgcggtgccgccgaggattccgacgcgctgctgcgcgcctacctggacgccagcgaggacaacaacgtgaccatcgcggcgctgcgcgcccatttcggtgccgacggctccaccgccgatgccgggcagcccgcggcgatacgagggcgatgcgctctcgcctgatcgcggccgccgtatccgtcgcgactgttcttggacttgccgtcaccggcactgcgattgcggacaatgtggggacagccgtacccgaagccgcgcagtcggccacgacgcaggcatcacaggctggcaccggcccgatcagcggcatcgcacagggcgacagcgctcagcaggaggcgtcatctgccctgaccgatcgcgccgggactggtgcttcggggcagaccgccacggtcaaagcgtcggctgcgcctcgcgccgcggcgaacgacggcaaagtgaagattaacctattcgattattgggacagcagtgatccgaagggcccggcaaaggccgctggcaaagagaacgtgaactatgccacgggcggtaccagcagaaatgaggcggctgcagcattctacttcaactacttcaacggaaaaggtaaggattggaacggctggactggcagtgcagaaacctctccgggcatcgtcaagacgaacctcaccaagaccggcgctgatgcagttccgcagttctctacgatggtgaccaataaaaataatgcacagaccgacatgacgtatttgttcacagaaagcgagtgggccaaggcatataccaatggcggcaatgggctgacggggctgttcgatccgacggaagaggccaagggccactatgtgtacgactccaatacgacgtacgccgcgctgaacagtgccggtaccggatttgaccggtcagcaacatggaccgagagaactgacgcgtggattccgaaattcctgccgttcaatgcggataaaagtcagctgcggatcggctttcattcagtgcgcggcgcccggtacgccttcggtatgaccgcatacgcgaagttcatgcaaccgaaagaaggcaaactcgttgatggttccccgatgacgttcaacttcacgggtgacgatgatctgtggctgttcgtcgacggcatgcttgtgttggatatcggtggcatccatgatgccgccagcggctccattgatttcgcgaccggtgtggtgacgcttgtcagcaataaaaccactacgaccacgttgcaggcattgtttactcaggcgctcaaggaccaaggcaagtcggatgccgagatcaccgcttggatggaatccaatatggtcaaagcctccaatggctcctacaccacgttcaagaactacaccagtcacgagatgaacatgtactacttcgagcgtggccatagtggttccaactgcaagcttgacttcaatttggtgactcttgactccagccatattcaaatcggcaaggagacggagaacgttcctgaagctgacaaggacaagaactatacgttcaacgcttatgtcaactatgagggaaccgacagtgacaaggattacacgttgtacacgggtaaatacgacgtgtacaacaccgccaccggcaccaaggacggtgaaacccggaccacggattccaatggcgtgatcacgctcaaggcgggccagtatgccgtgcttttgggcagcgacgccaagaggatcaccgagtcctcgaagtacaaggtgacggaaatcaacgttgaccaggacacgtatgcggtgagcgccaatggcggtcaggtcaaggtgacgcagaagaaggattctgcgaccacggagccggtgtcggtcggtgaggtgccacgtaccacggtgacgaacacggtcgtcacggcgccccggtaccgcaagtacatcaaggcgaacaatgatggcacctatgacctgtccctgaacgtgaccggcacgcagtccggctcgtcgcagacgaccgtgtccccggccgacatcgtcgtggtgttcgacacctccagttccatgagtggctcgatgggacacaactctcgtcttgaggttgcgaagactgccgtcaacagcatggcgcagcatctgctgacgtctgagaaccagggcaaggatagcaacatccggatggcgctggtccccttctcgacgacggtgggcaatgtgtcgaacttcaccgacaacgcaatggacatagtcagtgccgttaatggtctgcgcgccgatggtggcacgaattgggaggccgcgcttaaagccgccaatgccaagctgacttccggtcgtaagggcgtgaagaagtacatcgtgttcatgtcagacggcgacccgacgtaccgcacgagttccgtgcggaccggcactgattggtggggccgtccgacctatgatgacgatgatcgcaggggtcttcctgccggggttcatggttctggcagcagtgatcgatatggggcgaatctcagctccgctgttgccgaggctaacaggcgtggcgatgcgacgttgttctcggttggcgtgtcctccgatccgaccaagatgcgtggcttcgccgatcagacgaagggctcgtattacagcgccaccagcacggatgagctgaacaaggcatttgccgatatcatcggtcagatcaacaggaagtcttcgtacaagaacgtgtccatcaccgatacgctgtcggactacgcggagttcgttaatgctgacttcggctcgaatgatgtgacggtgacggcatctaaagacggtaatagtgtcgatctcaacgagagcgattacacggttaccgtttcgggcaagacggtgaaggtcacgttcgcggacggctatgagcttcaggatggcgtgacgtatacggtcacgttcaaggtcaagccgacgcagaaggcctacaacgagtacgccgccaacaaacagaatgacgacaagaccggatataaggatgttcttggtgccgacaacactgatgcggatggtcaccatacttcgtccaatttgcccggcttccattcgaatgcggatcacggcgcgaagctggggtacaccgtcgtcaacacggtcggcgaccagaccaccgagacaccgggttccgtggagtacccccaccccgtcctgcaggtaaagaccggcaagatccaggtgaccaagaactggtccgatggagcggagaagcatgggaatggctcggtgaccgtcacgttgaagcagtgcaatgcgcaaggtgaggattgcaaggacatcaaccgggccgtgaccctcaacaaccagggtcagtgggctggcgcgttcgagaacctcgcccctggcacctaccgcgtggaggagtccagcgtgggcggctacacggcgtcctacaaccccgagaaccagttggtaaccttcactgccgacgacctgtgggcggctccggataacaacaacatgacgaccttcgacaacgtcaagacgtacccggtcacgatcaccaacaccttcgttgccgtgtccgctctgccgatgaccggcggcgccacgactcgtgactggcttgtgtatgggggcggcttcggcctgctcgcggcactggtcagaatcggatacttcatctggcgcaagcgtcggctcgtctgacctgcggcggatgctccgccctcctccctcgtcggggagggcacacgggggcggcgaccagtcgcccccgacaactcaagatttgcggactgcggaagcctcaacgactgccgcttccgcagttgcaatatacaaaacaacgaaaggaagaggagtttctcatgaagttcaagaagcttttcgcgggtgtcgcagctgcggccacccttctcgccggcatggcgttcggcaccggtgccgccaacgcggccgagacgacagtggacactgctgcaacagtcacgttcaaagcgcccaaagaagagcagctgaccagcgcccggctgagcgcatacaagatcgcggactacgtgaactatggcactgccgaaaacccggtgtatggtgtgaagaccgctgcgggcgccaatcgcacgaagctggctgcggctctgaccaccgccggcttccagaacgtgccgaccgatggcaccactgatttgatggcttgggctatgaatcaaaaagcgaccacgggtacggatggtaacgtcacgcaggttcagttcgatcagtccgagacccgtccgtggaatgatccgtccgtgacgcgcaagttcgcggatgcgctgcaggccaacaacccgttcaccgccaccgcggatccgttcgcgctgaacacggcgactggcagcgacacggatggttggaccgccacgaacaagaccgcgctgactgctggcgtgtatctgttcctggacggcaacgcatcgaccgataccctgactcaggccgtcccgatgatcgtgagcaccggctccgttaacgctggcgttctgtcgcttggggatagcaccgcagaagtggacatgaagagcacggtgagcggcacccagacgaagtccaccaccagcaagagcgcgtccgtgggcgaaaccgtgccgtttgaactgggctacacgattccgaatccggtcccgaccggcttcaccctgcagttcagagatgtgccaagcaagggcctgaccgtcgactttgccggactgaccgttaaggccggcgataaggtgctgaccggcaccgattacacggtggaaaacaacctgactgccaacaagggcgacggcaccaatactttcgtggtgaagatcaccgacccggccaagtacgccggcaagcagatcaccatcacctacaacgccaccgtcaatgacgaggccgagacagtcaagggccaggattaccacgcggtgaccaacaagctcgtcgacaatgatggcacccccatccccggcactgaaaccctcaccaagatcttcggcttcaagttcacgaaggtcaacgcccagggtgaggccgtcaagggcgcgaagttcacgctgagtgtcgcaaaagaccagaacggcgtgctgccgaacagcgataagtacccgctcgaagtcacgtccggtgccaacggcgtcgtcaagttcgacggactgaaggccggcagctacaccgtgaccgagaccgcggtcgccgacggataccaggacttcaaggcctcgttcaccgtggccatcgaggaaaacggcaacgtcaccttcgccggcaccgactcctggggtctcgcgcccaaggacagcgccgccgactacaaggtgaccaacgtcaagtccgtcttcgaactgccgaagaccggtgctgcgggcatcgcgctgttcgtggtgatcgctgcgctgctcggcggcgctgccgccaccgtgtacgccaagtctcgccgcaccagccgtgcgctgcactgactgacacgataacaggccaagccgccgcatgacgtgcatcccgcacgagcatggtggcggcttcggcttgctgtaaccattcgcccccggcagcacccctgccgggggcaacacagtacatacacgaattcgtttcacggcgattgcagtgacggccggcacaacaacaggaggatgcgcatggcatcgaggagacacggatcgaaacggccggccacctcatccggcaacgacccagccgccaaatcctcccatgcgcccgcacggtcaacgatgacccgcagcctgccggacaatgacgagcgatcctcgaataattcccgcaaatcctaccgaaacagccgtcacaaacccgccgtgcagccgcagctcccgtactcgatgctgagcttcaatcaggcgaccgacatcttcgaccttgtcgcgcaacgcaaacgactgcgcatacagctcatcatcatgcgcatcgtcacgctgatactggtcatagccgctgtcgccatcgccggatatcccctagcgctccaataccagagctcgctcaagctcgcccaaacctcacgcaacagcgcacagcaggtcgctggctggccatacccgcaagccgaagacgccctcgccgccgcccgcgcatacaacgcaaaactcgccagatccggtcaacccgtgctgggcgaggccatcgacccgttcagcgccgcacaaggcgggtcgagagccaaaggcgaggactccgccgcctccaaagacaaggaataccagtccctgctcgactcgggcgacgaagtgatgggaaccatcaagatcccgaaaatttccgtcaacctgccgatctaccacggcacgtcacagaccgcgctggcctccggtgccggtcacctgtacggctcctcgctgccggtcggcggggacggcacgcactccgtcatcaccgggcaccgcggtctcgtcaacgcgatgatgttcacgcggctcgacgagatgaaaaccggcgacttcttctacatcgaagtgatgggggagacgctcggctacgaggtcgaccgcatcaccgtcatcaacccggacgacacgtcgcaactcaagatcgtgcccggcgaggaccgagtgacgctgatgacgtgcacgccgtacggcgtcaacacgcagcgcctgctgatatccgggcatcgcgagccgatcccgatgccggcgccggacccgtccgacctgcatgacacgcgcaccatcatgacgatggtggtggtgtgcgggctgctcggcggatggctgctgctcggcgtgatcgggcggattcgccggctgccgttcaagccgatgcggcacgcgtcgtcgtggccgcggcgcatgcgtgggtgaggtgcgacgggttcacggggggggtgtcggcggcgtcgccggtgaggtcctcgaaggcggacttgcaaggttttcgagggatctcgccgtgcgaatcgaacttgccgtgagatgaacatgaacttccggtcaataccgtgcatatcacggaaagtgagtgtacgctgaggattagccgatcaggtgcatacagcgttgcatgtggccggttgcggtaacaatgatttgacccggtcgacgggactctctgcaaaagggggacatatgagcaacacgtatccagatggagcgccgcagactccgtatggtgatccgaacaatgctgcgggcgcggaaggcgcgcccgaaccgcagccaacgcaggctttcccgccggtgccggtcgttcctctgcccgggcagggggcgggcgtgccgacgggagccccagccgccccgtacgggcagggcggggctccttatggtggtgcgccgactgccgcgtacggcgagtcgctcgccgggccgcagggcggcgccgagccgtatggataccaggcggcgccgtatgggcaggagccgggagcgtacggacagtcgggcgctggctccgcatacaaccagggtggggctccttatggtcagcagcctgaagccggtccgaaccccttcagccagcccgatggcggaactccgtatggtggcgaggcgcctaccgccgcgtatggtgagccgcttgcagggccgcagggcggcaacggcaatgcgcctgccgcgccctatggtcagcagcccgagccggagtatggtgccggcgcgcctaccgctgcatacggtgagccgcttgccggcggtgctccgggagggtacggtcagccggccgcaccgtacggcggcgagcagccgaccgccgcgtacggacagccatacggcgccaaccagtacggtggcccgcaatacgggaaccagccgcccgcaatcgcgccgcaaggctacggcaatccgtaccagcaggaaccgccgaagaagaagagccgcggcccgctcatcgccggcatcaccgccggtgtcgttgccgtcatcgccatcatcgtcgtagtcgtgctgttcgccaccggtgtcatcggcggcaagaaggacagcagcgccgacgcgaaacccaacacgtccaccagtcagacgcagggcgacagcaaatccaagagcgacagctccagcaacggcaactccgacggatccagcagcaacgatctgaacaaccttgacgacgcgttgcagaacggggccgacgacaccaacaacgatctcaacaacgacagcttcaacggatcctccagctccggcaagccgtcactggaagagttcgtcaactccagcgaaatccagtcgcagctcgacagcatgacctcgtcgtaccagggcatgggcatcagcatcaaggcgtacgcggaaggcaacacgctcgtgtacgactacacgctgtctgacacgtacagcagcatgggcgacatgatgacgtcgagccttgacgggatggacagcacgttcaagtcggtggcgcagacgctcaacgaaacctgcgacaccggcggcaacgccaaggtgcgcgtgtacctgcataccgaaagcggcaagacgctgttcgacaagagctacacggagtaagcgggtccagctcgcgagaatccgacaaggcgggacggccatgattggccgccccgcttttcgtatgcgcgttcttcgtaaggattgcactcgcactggtttacactggtgggtatgagaatcgcacgtttttcactcaacgacaagccgcgctatgccttcgtccagcaggacccggccgacggcaaggactacctgatcgaactggacggatacccgttcggagccgcgcccgtcaagcccacaggggagcggtacgcgctcgacgccgatgggctgaggctgctcgcgccggtgattccctccaaggtgtacggtctcgccaagaactacgaggcgcacgcgcagttcatgcacgagagcgggcactccgagattgctcacgcgccggaagacatggtgatcttctcgaagccttccacgtcggtgatcgggccggacgatccgatcgtcatcccgtcgtattcgaacgatatgaacttcgagcccgaagtggcggtgattatggggcgtatcgccaagaacgtgccggtcgagaaggccatggactacgtgctgggcttcacgtgcgtcaacgacgtgacgctgcgtgacctgcaggggctggatccgatgtggacgcgggcgaagggcttcgacacgtcctgccctatcggcccgtggattcagaccgagctggactggaaggacgcgaagatctccttcacgctcaacggcgaggacgtgccgatggcaagcggcaccactgcgaacctgattcacggcatccccgagcagatcgccgttacgtaattctgggaacggcggtatccagggactttctgagaactgtgattccaattgaagacacaagtcgccgacggacttgattcttttagtaaacaatgtatatattagcatgagccggcaaagctgctggctgccctataggagaaagaaccaaatatgaaacatagagcgatgtcatcgcgtctgatgccactggtggcatcctgcgcgacggtcggcatgctgctggccggactacctgcgtcggccgtcgcggtcggcacgacgagatcggcagcgtccgacgcctcgtcctccaccacagcaaccatcaccccctccgccgataccacgttgcagacatggacgagcgagaagaattcctcaatggcgtccaagccgtacatcggcacactgcaaggggcctcgcaaggcgtgttcggcgagaagttcgagtccacggatgccgcggacaccaccgatctgaagaccggtctgctgacgttcgacctgagcgcctacgaccatgcccccgattccgcaacgttcgagatgacgtacctcggctaccgcggcaacccgacggccaccgacaccgacaccatcaaggtgacccccgtcgacaccaccgtgtgcaccaataacgccacagactgcggcgcgaatgtcgcgaccggcgcgaccaagccgaagttcagcatcaacgactcctcattcgtcgccgagtccaagccgttcgagtacggtacgacggtttacacgggcgacgccatcaccgtggttcccgccaataccaagaaggtcaccgtagatgtgaccgaaatcgtgcgccagcagttcgccgaaggcaagaaggtcatcaccctggccgtgggcgagaccaagaagaccgaggttcgtttcgccagttccgaaggcacgacgtccctgaacggcgcgaccgcagacatggctccgaagctgaccgtttccgtgtccaccaaggacgatctcaagccctccgccgacaccacgttgcaggcatgggccagcgagaagaacgagaagaagaacactgcggcctatgtcggcgcgctgcagccggaaggcgattacggcgacttcggtgagaagttcaagtccaccgacgtccacgatgtcacagacgccaagatgggtctgatgacgttcgacctgtccgattacaccgcggcgcccgagcactccatcctcaccttgacgtatctgggctacgccggtgcagacaagaccgccacggccaccgataaggtcaaggtggtcgctgttgacacgtcgcggtgcaccggcaccgctccctgcgacaccaacaatgccacgtgggcgaaccgcccggacttcgaggtgaccgataccacgaagaccgcgacgtcccatgcgttcgcttatggatctaagaagtattccgatggcatgaccgtcgaatcgggcaacgccaagaaggttctgctcgacgtgaccgacgtcatcaaggcagagttcgccaagttcggcaccgacgccaccgagaagaagatcacgctggccctgggcgagctcaacaagtccgacatgcgtttcggcagcaaggaagtcacctcgctgaccggcgccaccgaggccatgcagccgaccttgtccgtcaccaagaagccgaaggcatacacgctgagcatcgaaggcccgaccaaggtcaagtaccagaagggcgaggcgttcgacaaggccggactcgtggtcaaggccaccagcacggctgacggcacggtcaagacgctgaccgaaggcaacggtgaggataactacaccatcgacaccagcgctttcgatagtgccagcatcggcgtataccctattaccgtgaagtacaacaaggaccccgaaatcgccgcttcgttcaacgcctacgtcatcgccagtgtcgaggacggcggagacggcgacaccagcaaagacgactggctgtggtacaagcagcccgcgtcgcagactgacgccaccgccaccgccggcggcaattacggcaaccccgacaacaaccgttggcagcagaccaccttgccgttcggcaacggcaagatcggcggcaccgtctggggcgaggtcagccgtgaacgtgtcaccttcaacgaggagacgctgtggaccggcggccccggatcctcgaccagctacaacggcggcaacaacgagaccaagggtcagaacggcgccacgctgcgcgcgctcaacaagcagctcgcgaacggcgccgagacggtcaatcccggcaacctgaccggcggcgagaacgcggccgagcagggcaactacctgaactggggcgacatctacctcgactacgggttcaacgacacgaccgtcaccgaataccgccgcgacctgaacctgagcaagggcaaggccgacgtcacgttcaagcatgacggcgtcacctacacgcgcgaatacttcgcgtcgaaccccgacaatgtcatggtcgcccgcctcacggccagcaaagccggcaagctgaacttcaacgtcagcatgccgaccaacacgaactactccaagaccggcgaaaccacgacggtcaagggtgacacgctcaccgtcaagggcgctctcggcaacaacggcctgctgtacaactcgcagatcaaggtcgtcctcgacaacggtgagggcacgctctccgaaggcgccgacggcgcttcgctgaaggtctccgacgcgaaggcggtcacgctgtacatcgccgccgcgacggactacaagcagaagtatccgtcctaccgcaccggcgaaaccgccgccgaggtgaacacccgcgtcgccaaggtcgtgcaggacgccgccaacaagggctacaccgccgtcaagaaagcgcacatcgccgatcattccgccatctacgaccgcgtgaagatcgatttgggccagtccggccacagctccgacggcgccgtcgccaccgacgcgctgctcaaggcgtaccagagaggctccgcaaccaccgcgcagaagcgcgagctggagacgctggtgtacaagtacggccgctacttgaccatcggctcctcccgtgagaacagccagctgcccagcaacctgcagggcatctggtcggtcaccgcgggcgacaacgcccacggcaacacgccttggggctccgacttccacatgaacgtgaacctccagatgaactactggccgacctattcggccaacatgggagagctcgccgagccgctcatcgagtatgtggagggtctggtcaagcccggccgtgtgaccgccaaggtctacgcgggcgcggagacgacgaaccccgagaccacgccgatcggcgagggcgagggctacatggcccacaccgagaacaccgcctacggctggaccgcacccggtcaatcgttctcgtggggttggagcccggccgccgtgccgtggatcctgcagaacgtgtacgaggcgtacgagtactccggcgaccctgccctgcttgatcgcgtgtacgcgctgctcaaggaggaatcgcacttctacgtcaactacatgctgcacaaggccggctccagctccggtgaccgcctgaccaccggcgtcgcgtactcgcccgaacagggcccgctgggcaccgacggcaacacgtatgagagctcgctcgtgtggcagatgctcaacgacgccatcgaggcggccaaggccaagggagatccggacggtctggtcggcgataccaccgactgctcggccaacaactgggccaagggcgacaacggcaacttcaccgatgcgaacgccaaccgttcctggagctgcgccaagagcctgctcaagccgatcgaggtcggcgactccggccagatcaaggaatggtacttcgaaggtgcgctcggcaagaagaaggatggatccgccatcagcggctaccaggcggacaaccagcaccgtcacatgtcccacctgctcggactgttccccggtgatttgatcaccatcgacaactccgagtacatggaggcggccaagacctcgctgaggtaccgctgcttcaagggcaacgtgctgcagtccaacaccggctgggccattggacagcgcatcaattcgtgggctcgcaccggcgacggcaacaccacgtaccagctggtcgagctgcagctcaagaacgcgatgtatgcaaacctgttcgattaccatgcgccgttccagatcgacggcaacttcggcaacacctccggtgtcgacgaaatgctgctgcagtccaactccaccttcaccgacaccgccggcaagaagtacgtgaactacacgaacatcctgcccgccctgcccgatgcctgggcgggcggctcggtgagcggcctcgtggcccgcggcaacttcaccgtcggcacgacctggaagaacggcaaggccaccgaagtcaagctgacctccaacaagggcaagcaggcggccgtcaagatcaccgccggcggcgcccagaactacgaggtcaagaacggtgacaccgccgtgaacgccaaggtcgtgaccaacgcggacggcgcctcgctgctcgtgttcgataccactgcaggcaccacgtacacgatcacgaagaaggcgagcgccaacgtgcccgtcaccggcgtgaccgtgaccggcgccaacaccgccaccgcaggcgacaccgtcactcttacggctaccgtcgccccggccaatgcgaccgacaagtccgtcacctggtcgacctccgacgccgccgtagctacggtcaacgccaacggcgtggtgaccacgaagaaggccggcaaggtgaccatcaccgccacgtcgaacggcgacaagacgaagttcggttccatcgagatcaccgtctccgccgcgaccgtgcccgtcaccagcgtcaccgttgccggcgacgccgcgatgaccgtcgatggagagcagaccctgacggcgaccgtcgccccggccgatgcgaccgacaagacggtcacgtggaagtcctccgacgccactgtggcgacggttgacgccaacggcaaggtcgtcgcgaagaaggccggcgaagtgacgatcaccgccacggccggtggcatgtccggcacgctgaagatcacggtgagcgacaaggccccgaccgtcatcccggtccagtccgtgaccgtgacaggcaagcaggagctcgtcgaaggcgcctccacgaccctgacggcaaccgtcgccccggctgacgcgaccgacaagacggtcacgtggaagtcgagcgacgagtccgtcgccacggtcgacaaggacggcgtcgtgaccgccaagaaggccggcacggtgaccatcaccgccacggccggtggcgtgtccggcacgctccacatcaccgtgacggccaagcccgtcgagaccgtccccgtcaccagcgtggaggtcaccgtcgaggccggcaccaccgtctccgtcggcaagacactccaggctaccgcgaccgtcaagcccggcaacgccaccaacaagaaggtgacgtggaagtcgagcgacgaatccatcgcgacggtcgacgccaacggcgtcatcaccgcgaagaaggccggcaaggtcgtcatcacggccacctcgaccgacggcacggacaagtccggcagcgtcgagatcaccgtcgtggatgagaccaagccgacgcccgaccacaagtccgtcaaggccgataccggcgacgtgaccgccggcaagaccggtacggtcaccgagccgaaggacgtggcgggctggaagagccgctccatcatcaagcaaggcaagctcggcaaggccgaaatcgccgacggcacgctcgtgtatgcggccggcgacaagaccggtgacgacagcttcgtcgtgcagtacacgatggccgacggcacggtcatcgacgtgacctacagcgtcacggtcaaggccgccgaaaccggcaagaacgacggcgacggcaagggcgacggtgtcgcgaagaccggcgccgccgtcggcgcgctcgccggcctcggcctgatgctgctcgccgtcggagtgagcgtggtgatgattcgccgcaagcgctccgcctgatccccagtcagaccggccagtcgtgaccggtcggcctgactgactctttttccaccgtcccccgtcggataaaccccggcgggggacggtggcttgttgcggccggtctgccgtcgcgtgcggtgtggcctgcagacgggtgccgcacgtcacgctcatgcgcgatactggagacatgaagatttccgctgacttcacggtgatgcccgacgacttcgccaaagccgccgcgcccgaataccgcaccgacggcgtgcccgtcatctccttcccgttctatatcgacgagatcgatcccgccgcccggtacctgcactgggcgttcaccgaccccgactccatcccggtctgcggattcgaatggattcactggacggtcgccaatctgcccatcgacgcgctgatgtacgacttcaacgattcccatgcactgcagattccgccggacttctcccggcagctgccctccatgattcccgagaccgtgcagggccgcacgtcggccgcgagcaagctggtcggcagcacgaatccgcaggtgacgatgcgctacaacgggccccagccgcccgacaaggaccacgactattcgctgcacgtgtggggcaccgcgaagccgttgccgggtctgaaccaaggattctggctcaacgagctgttccacgcgctgcgtgacgtcgaccacgtcaccgatcagggtgtgatgttcatcaccggaaaagcctgagggctgatgccgtatactcccgtacggagtcatacactcatgtgacaggaggcgcgccgcagatgcgcgccgcaacgtgcacgcgacagcgtgtgcacagcaagaaaggacagtaccgaatactatggcatgcaccacgattctggtcggcaaggacgccagctatgacggttcgaccatcatcgcccgcaacgaggattccgccaacggcgaattcaacccgaagcggttcatcgtcgtcaagcccgatgaacagccgcgcaaataccgcagcgtcatcagccacctgaccattgacctgcccgacgatccgctgcagtacaccgcagtgccgaacgccgacctgaaggaaggcatctggggcgaggccggcgtcaacgaggcgaacgtggccatgagcgccaccgaaacgctgaccaccaacgagcgcgtgctcggtgccgacccgtttgtggaataccgggcggcacgcggacgggaaggtgactcggattacgagccggccgtgcccggcggcatcggcgaggaggacttcctgaccatcgtgctgccgtacgtcaccaccgcgcgtgagggcgtgcagcggcttggcgaccttcttaaggaatacggcacctatgagatgaacggtgtcgcgttctcggacgccgacgagatttggtggctggaaaccgtcggtggccatcactggatcgccaagcgcgtgcccgacgaagcgtatgtgacgatgccgaaccagctcggcatcgacgaattcgacctcgatgacgccctcggcgagcaggagaaccacatgtgctccgaggatctggtcgaattcatcgagcgcaatcaccttgatctgtccgtcgaatcgacgtcaccgttcaacccgcgtgatgccttcggctcgcactccgactctgatcacgtgtacaacacgccgcgcgcatgggtcatgcagcggttcctcaacccgtacgacgagatgtgggacggccccgaggccgaccaccgcccggacagcgacgacatcccgtgggcccgtcagcccgagcgcaaggtgacgatcgaggacgtaaagtacgtgctcagctcgcactatcagggcacgccgttcgacccgtacggccacctcggcgacgagcacacacgccacatgtaccgcccgatcggcatcaaccgccagagccagctggccgtcatgcagattcgcccgtaccgtccgcagtcggaccgcgcgatccagtggatcgcctacggctccaacccgttcaacacgctggtgccgttctacccgaacgtcaacgaaacgccgaagtatctggaagacacgaccacgcgcgtgacttccgagaacttctactgggagaaccgcatcatcgccgcgctgtgcgacgcggcgttcgcggagacctccaacgccatcgagcgctatcaggagaagaccggcgcgatgggccaccgtttgatcgccgccaccgacgagcaggtcgcgcgtctgggcggtgccgacgaggccgcggccgccttggccgacgcggagttggaggcggcgaacgcggacggcgacgtcgagccgatggatcccgaggacatcatcgacgcgacccgtaacgacgaggtgcgcgacatcctcgccgccgccaaccagaccatggccgaccagctcaagaccgagaccgaccagctgctcgacaccgtgctctacaccgtgagcatgaagatgaagaacggtttcaaccgctccgacaactgatgcgctgagaggctcccggccaagcgttttcggccgccagccgcttcgacggtaagcaagcgtcatacatctacagaaaggttcacctactgatgactactatcgaggagttcaccagccagtacgggctggtcaagaagatcgacgccttcgggtttatgaagtacctgcacgacaatcccgacgcgccgcgcaagcacggcaaggtcgtgctcgtcaccgccgatacgccgctcaaggcgtcgcgcggcgagggcaagaccacgacgacgatcgcgctgatcgatgcgctgcgggctcgcggcatcgacgcgaccgccgtgctgcgccagccgagcatgggcatcaccgccgccacaacgtgaccatcgcggcgctgcgcgcccatttcggtgccgacggctccaccgccgatgccgggcagcccgcggcgcccgccggcgacggccgtttcgccgcgcaggccatcatcccgttctcgtcgaagcgcaaatggggcgccatcacgatgcgcgcagcggctggtgcggcagacgcgcctcgccacgcgcaggagggcgagtcggccgcggcggcgaccggaaccgtgttcctgggcgccccggagcgcatccttggcgcgaacctgcccgatgaggcggccgcgctgatgggtcagggactgcgtctgatcgccgtcggatacctgcccggcgcgtggacggacgaggagcgtctgccggatgcgctgcagccgatgttcctgatcgcgctgcgcgacaacatccgcccgcgggccaaggagacgctggcgtacttccgcgaccagggcgtcgacgtgaaggtcatctccggcgaccatcccgacaccgtcgccgccgtcgcccggcaggccggcctggagcgttggcgtgacgtcatcgacatgacctcggtgccggcggacgccccggattccacgttcaacgacgtcgccggccgatacacggtgttctctcgcgtcacccccaagcagaagcgccagctggtgcaggcgatgcagcgggccgggcatcaggtcgcgatgaccggcgacggcgtgaatgacctgctcgccctgcgcgaggccgactgctcgatcgccatcgcctccgggtcggacgccgcgcgccagatctcgcaggtcgtgctgctcgactccgatttcacctacctgccgcaggtggtgctggagggccgcaaggtcgtcaacaacgtgacccgcacggccgccgtgttcttcatcaagacgatctactcggtgctggtgtcgttcttctgcctggctttgaacgtcccgttcccgttcattccgatccagatcacgcttgtcgatgcctgcatcgaggcgtggccgtcgttcctgacgatattcgaatcggacacgcgacgcatccgcggccggttcctgcccactgcgctcggcaaggcggcgccgttcgcgatcgtcgtcaccggcatgatcatcgcattcagcctcatcgctccgttcggcgagacgcagaaccgcacggtcatgttcgcgctgctggtcgccgcgtcgatggtcgccgtgatcaagagctgcgtgccgttcacgaagatccgcgtgttcgtctgcgtgacgatggtgctgggtgccccgttcgcgctgctcatcctgccgcacctgttcgaagtggttgcgatgaccggcccgatgtgggcatggttcgcggtggcgttcgtggtgatgatggccgtcaccgccgcgatcatcgcggcgcagcgggcatggctgcggtcccggcgctgaccggcgagcgattccccgtgataccggccggcgtccggccaatgttggtgagcagccccgcatcctcgtaataccgcagcgtcgacggctccatatggaacatgtcggcgacctcgcggattgtgtatcgttccatgcttgacatcgtagccgcgaggatgacacgccggcgcccttgcactcaagccaacttgaagcgtgacaatggagacatcggaccgatcgacgacacctggaggcacccatgttcgaacccaccggcacctacgcgcccgccacgacgcgctacgacgccatgctgtacaagcgctgcggcgccagcggcctgaagctcccggccatatcgctgggcttctggcacaacttcggcgacatcacgccctacgaccagatgaaggccctagtgctcaccgcattcgaccacggcatcacgcacttcgacctggccaacaactacggccccgaacccggcgccgcggagaagaacgcgggacggctgatccggcaatacctcgccgcccaccgcgacgaactggtcgtcagcaccaaggccggctacgagatgtggtcgggcccgtacggcgattggggcagccgcaaatacctgctcgcctcactcgaccagagcctggaacgcctgggactcgactacgtcgacatcttctaccatcaccgtccggaccccgagacccctttggaggaaacgatgggcgcgctcgcccaggccgtcgccagcggcaaggcgctctatgttggcctgtcgaactacgacgggccacagctggagcgggcggcgacgatcctcgatgaactgcacgtgccattcatcatcaaccagaacaagtacaacatcttcgaccgcaccgtcgagcgcaacgggctcaaggacaccgccaagcacctgggcaagggtctcatcacgttctgcccgctcgcgcagggtctgctgaccgaccggtatctcaacggcatccccgcggattcgcgcgtggcgcacgatccgcgcttcctgcacgccgacgacgtgacgcgcgtccacggccagatcatggccctgaacgagatcgccaagcagcgcgggcagacgctcgccgagatgtcgctcgcctggctgctgcacgacgacgccgtgaccagcgtgctcgccggcgcatccaagccgcagcaaatcatcgacaacatcggggcgctgaagaacacggacttcagcgacgaggagctgaaagccatcgacgagatctccatgcagtgacgaataccgctggaagtcgcatccggaaacggctcccagggtaccggaaggaaacgtaccggcatatattcatgccaatcacagcacagcttccaggatggtggagtgatatggaggttgtcggcaagagccggcgaggtcactcaaggtaaccccacaattgtccccctctctcttctccttctcacccggcccttttgggccgggtttccttttcttcggagcctgcgacaccggaaagccgacgacggcgaatcgtatcgcaatggtgatgtacagtagtgagttcgccacgaccattacgaggcggcttcatgccgccgggaggagacaccgatgctgcccgacgggacactgcccaacgattatgtcgtactggatctggaaaccaccggtgtcaactggtatcgggacaccatcatcgagttcggagcggtgaaggtcgtcgaccgcaagcccgtcgacacctatcagcagttggtcaatccgatgcgcaacctcaatccgttcatcacgcagctgaccggcatcacgccggacatgctcgaaccggcaccgacgctggacaccgtgctgcccgacttcctgcgctggtgcggcgacgacgcgatgatcgggcacaacatcatgcagttcgacatcaagttcatcgatctggcggcgcagcgcatcctgcaccatgcggtgccgaaccgcatcatcgatacgttgcagatgagccggagcatgtacccgcagtacaaccgacaccggctggtcgacctgatccagcgtttcgacatcgccgacgtcgaggagcaccgcgcgctgtcggacgccgagcagacgcagatgtgcttcgaatacatgcgcgacgagcagcgtcgcagagactgctgagagcggagagagctgactgatggcattgggcgttggcgcgcggtctctgacgccgcccgccaacgtccaatgccatcggcgcagttttctgcttccgtcagcgttgattcagggggatgtaggcgcgctccacctcgccggtgtacacctgacgcggacgaccgatcttcgtgttcgggtcggcgagcatctcgcggtactgggcgatccatccggggatgcggccaagcgcgaacagcgtggtgaacatcgccggatcgaaaccgatcgcgcggtatatcaggccggtgtagaagtcgacattcggatacaagtgacgtgacacgaaatactcgtcgttgagcgcgatgtcctcaagctcgaccgcgacgtcgaacagggcgcgctcgtcggcgggaagcttgcgggtgtcctcacgcgcgatgatcttctccagatacaggcgcgcgatcgcggcacgcggatcatacgacttgtacacgcgatgccccaggcctgagatgcgatgcccctcggccttcgcgtcctccacgaactggcggacggacttgccggagtcgcggatcgccttcaactgacgcaacacggcctcgttcgcgccgccatgcaacggcccggacagcgcgttgatgccggcggagatcgccgcatacaggttcgcgtgggcggagccggcgatgcggaccaccgacgtggagcaattctgctcatggtcggcatggatgatgagcagacggccgagcgcgtgcacgtacagcgggtcggaatcgaaccgctcgtatggcacggcgaagcacatgcgcaggaaatcgtcgacgtagccgcgggcgaggtccgggtagagcatcggctcatcgcggcggcgccggaaaatgtagctgaccaccgtgcgcgccttcgccatgatgatcttcgcggcctcatccagctggtcggagtcggtgatgtcggtggtgtcggggtagaacgccgcaagcgcgttcaccgccgcagcgagcacgctcatcggatgggcggcacgggggaacgagcccatgaacgtgcggaaatcctcgcccaccatggtcttgtggttgatgtcgctgcaaaaccggtcgtattccgcctgcgtaggcaggtcgccgtgtcgcagcagccacgcgacctcaaggaaatcggaatgctcgcacagctgctcgatggggtagccccggtagcgcaggatcgaccgattgccgtctatgaacgtgatcttcgattcgcactgcgccgtggtcaggaagccgggatcaagcgtgacccagccgtcattgcgcagcttggagaccacgatgccatccgggccggccgaagccttgacgaccggcagcgtgtactgattcgaatccacatgaagttcagctgtcgccatgcacgctccttaatcccttgattgagtcgttcgaattgtcaagtcgtcgaaattatcgaattcgtcgtcccggtgccttgtattggacacactatattgcgtgcatgtttccaccaaaaacgccgctccagcacgtggacatcatcacatgccaaagcggcgacggcatcgcccgatacagaccgtggacgatggacgaccggttgccggtcagtcgcgggtggtcaggatgaccggaccgttctcggtgatggcgatcgtgtgctcgctgtgggcgccacgcgacccgtcctcggaacgcagcgtccagccgtccttggggtcctggtagatctcgtcggtggtcttgaggaaccacggttcgatggcgatgaccagacccgggcgcaggcggtagccgtggccggccttgccgtcgttggcgacgtgcgggtcgccgtgcatgatgtggccgacgccatggccgccgaattccaagttgatcgggtagccgtacgaacgggcgatgtcgccgatggtggaggacacgtcgcccagacggttgcccggacgggccgcgtcaatgccggcggcgagcgcctcctcggtgcacttgatgagcttgaggtcgctcgggtcggggtcgttgccgaccacgaagctgatggcggagtcgccgacccagccgttgacgctgatggccagatcaaggctgatgaggtccccgtccttgaggttgtagtcgaacgggatgccatgcagcaccgcgtcgttgaccgacgtgcagatgtagtgtgcgaacgggccggtgccgaagtccggcgcataatccacgtagcacgattcggcgcccttgcggtcgacgatcttcttgtgcacgtactcgtcgatctccagcaggttggtgccgaccttcgtcatggccttgagttccttgagaatctcgccgacgaaacgaccggccggcttcatctcctcgatttccttagcggttttcagttcgatcatgcaacccagcctactgtgcgggggttacttacgcctcggacggccgaacttgaacgcgcggaccatcgaggaaacacccatgacgatcagcgcacatccgcagaaaatcaccaggaacagcatcgacgagaccggcgagaccagtacgacgagaccggcgataatcgagatgatcgcgtacagcaccgcccagccggagctcggcaggcgccatgattcggcgagcgccatcacgccttccatcatccagccgaggccaaccaccatcgtgatgaacactgcgagcgcctgtccggacagggccgcgttcttcagcatgagtacgccgccgaccgacagcattatgccgatgaggatgtccaggatgcgccatccggccggcagtcccaatgtgacgatggcgctgacgatgcggatcacgccggagaccacgaagtagatgccgagtgcgacggccgcgacgccgagcgtcttgccgggccagatcagcagcgcgacgccgagcacgatcgccgcgacgccgatgatgccgtacaggccgcggatcgcgttcttcgccttctgcggcagcatctcctcgatcagccggaacgggctgaagtcctcccagccgccctgcccttgctgctggccgggctgctgttggccgaacggcggctggtaggcgtagggctggccgtacggacggcctggctggtcggatgcgacgcctggctgcgtctggtattggccggatgaggcgccgtcctgcggcgctcccccgtacgggtattgccggcccgcaggctggccttgaggcgcgtaggctccgtattccggctctccggcacggccggtctgttcgttcccgccgggctgtccgccgtcaccgcgcccgttgtcgccatgtccgtcgctgtgcgggaaaggcccgccatcgtatgtgctcatcatgactccttcaccgttcatgcggcctgccgtcaaccgtgtgcgggcatccgaagcgggccacttcgatatcgtcaccgtcaccaccatattttagacaagttgtccaattcatgccatcaacacaacccgccgttccgtccaataccttacgtgtcgttcgctatgggaaaagacgggccgcggaaggtcagaaggaacgtcaccgaacccggatagtatgagaccatgaccacagatttgacgtccggcctcgatacggccgctttttcctctgttatcaaaccatccgacgatctgttccgtttcgtcaacggcccttggatcgacacgtaccggctgcctgacgacaaggcgcgctacggttcctttgacaagctcgcggaagacgccgagagccagatccgcgacatcctggaggacgaggactgccccgcagccaagtcgcaggcgctgtaccgctcgttcatggacaccgacgccatcgaggcggccggcgccacgccgatcaggcccgccctcgacgccatcgaccacgccgccgacaaggcggcgctgacccgcgccatcggagccctcaagcccatcgacatggggccggacgtcttcgacatcgccgtattcggcgaccccaagaaccccgacacgaacgtcgtgcacctcgaacagtccggcatcggcctgcccgacgaagcctactaccgcgaggaccactacgccccgatccgcgaagcctacgtcgacatggtcgccaagcagctgcgtctggccggctacggcgacgaggagaccacccgcgcacaggcgggccgcttcctcgatgtcgagacccgcatcgccgcgaaccactgggacaacgtcgccacgcgcgactcgcagaagacctacaacccgaccgatttcgccacgctgagcgacgaattggcccacttcgacatcgcggcgtgggccgacgcctggcagggcgcctacgacgccacgccggcggcgaagacccagccggtggacctgacggccgcgctgcagcacaccatcgtccacgagcccagcttcctcaagggcttcgacgccttctggaacaacgctgaccttgacgacctcaagctgtgggctcgcgtgcacgtcatcatcggcaccgcgagcctgctcagccacgactacgacgccgccaacttcgacttctacggcaaagtgctgtccggcaccacccagcagcgcgaccgctggcgtcgcggtgtctccctggtcaacggcgtttgcggcgaggacgtcggccgcgaatacgtcaagcgtcacttccccgaaagctccaagcagcgtatggggcagctggtcggcaacctgatcgacgcctaccgcgtgtcgatcaccaacagcgactggctcggcgaggagaccaaggccaaggcgctggagaagctgtcgaagttcacgccgatgatcggctacaccgagcgttggcgcgactacaccgcgttcgacgtgcatgccgacgccggcctggtggcgaacatgcaggccgcggcgctctacgagtggggcttccagctgtccaaggccggcaagccggtcgacaagggcgagtggctgatgaacccgcagaccgtgaacgcctactacgagccgagcatgaacgtcatcgtgttcccggcggccattctgcagcctcctttcttcaacccggatgccgaggacgccgcgaactacggcggcatcggcgcggtgatcggtcacgagatcggccacggcttcgacgaccagggcgcacagtacgacggtgacggcgtgcccggcgtaacccaggcgaacgtcgtcaaacggtatccgcgctcgctggagattgacatcaaggcgcagcagcccgccgccatgctcaaggaaccagatggaaccctggtggcggtcgaccgcaaggcccgcgtgctcaacgcggtgggcaaggcgtccatgaaaggtattccggtcatcgaggtgagctcggtggacaacggtctgaacagccgcgccgtcaaggaggcactgaccatcctcggcggtctgcccgacacgatgcgcaccgtcatcaccaaggtgagcgcgaaaacgcaggattccatcaccaccgagctgagttccggcaaatatgtcgtcgtctggggtgattcgtccgagctgaaactcaagtcggcgatcgtcgacaagctgctcagcgacccgtcgctgataggagacaagcatcagatcgacgtgtcggccccgagccgacccatcatcaaatagcgcgcgtttcgccgtgggcaggacgcgaaacgtgggtgaaaatacgaaaagggccgcatgatcgttggaatcatgcggcccttggagtggagctgcggggaattgaaccacggtcgcccatgctccgggatgctatgagttaagccgttttcccttgtgcgagtagggctgagcggcttttctgtttatccgtgtttttccgtgtttcacactgtttttccgagggaatgtgggcaaaatgtgggcaaaaaggagcgcgccgtcatatgggtggcggcgcggcattgccctcgatctgtcagcaagggttagtctggcattgcgacacgcgcggtgtattgcctacttgataatacatcgcatgccatgggcatcgaggcgtccaacaacacgcccgtcaccatcaacgtgcggatcggttgaacgccgcaccggcgtataatcaaaatatgtcgcggacaacctgcaggtcactctggacgagttctggctgctctgccatccggcataggggtcggcaacgcacccgattgagaaccgcgtaacatcaaaatagcgcccctcgactccgggaaaatggagtcgaggggcgctgtttgttttagaatctgccggtgttgagccgggtctgtagggcgcgtgcggtgccggggccgaaccatgagtcctgcgcgacgccgaggtgctgttggatggcgcggatggtggcggggccgagcagcccgtccgcagtgaggttgaggcggtgctggacggcgcggatgaggttgctgccgccgcccccgtagcgcacgcacgagtccacgagcgcgggacgcccccacgtgcggccgtccggcctgacctgtccgctgatgatgccgtccacggtggtgcccatgacctgctgccatttgcggatggtggcggggccgcatgagccgtcgaccgcgagcttgcccgtgccgccgctgcttgcggagccgccgcccgacgacgtggcgctgccgttgtaggcggggcgcaggatggccgcgaccgtgttccatgcgcgggtgcggcgggctacgcgcccgttgttggtgttgccctcgatggtctggatgtacgagccgtggttggcctccacgaagccgatgtggtcgaccacgccgccgtcccagttgaagatcacgaggtcgcccgggcgggcgctgcgcgtgctgaccgcgcgggagcgtccggctgacagcacgtagggcacgtaggcggcgggcagtccggggaacggctggcccgccctgctcatgacccatgacacgaacatggcgcagaacgggactcccgacgcgccgtagtaggagccgtgggattgcgcgtaccagcggccgtatctggtgccgggctgcgggtcggtccagcggctgtagccgatttcgcccgccgcgatcctgaggacatcactcgccgtcgccataggtcacctcctcgatgggtgccacgtcggcggtcgcgtcggctcccttggagtcggacacggcgtgcgccacctgcgtggcctcgcctgtggtgtcggtagtggtggcgacgatgttggctttgagcgcgttggtgagctgctgtccctgcacggcggccgtggtgacgttgttgttgcgccaccacgcccagacggatgcgatgacggcgatgacgccggtgatcgcggtgctcacctgatccgacgtgaacggcagctggctgatgccggcgatgctcaggccggtctgcgcgacgctgaagagctggacgatcagcaggacgattgccttggtgcgttccacggtcaggccgggaatcgacgggctgacggccttgtggtcgggctggtttggcgtgtttgccatgatggttctccttacatgaagaagccccacggggtgtggggctttagttggttttatagagtcgggcgcccagatgggcgttcgcgtaggttttgccggaactggcgcggattttgagcgtgtagctgccggccgtgaggtgcgccgtgagcacggggttggcggggttgccgttcatggccgcgtcccatggcgcgaagttgcgcatgacgaacgagaacaggccggggcgtcgaatcggcggcgcaccggcgagaactcggcggaacccctcaccgggtcgaggctcccgtcagccttcggtcgcttgacgctcagattaatcgttgtcattgtgccgctcctttggttggctatcggtggtggacatggtttcgggcgcgatgtccgcgcgcagctcatccggcaacgacggcttgggatgccggacgaggaaatccggtttgaccagctcgcagaaatcctgcagccagtggaacaggcggcgcgtgtaccccaccgccgtgaaatacttgtgctgcacccgctccagatgcctgatctgctcctcctgataggcgacctgctcctgcagcgggtcgatgatgctctgcgtgaggatcttcacggccttgtcggcggcgtccgcggtgatgccgtctatgtcggcctccgtcttcctgcggttgctccacgctcccacaagaccgccgacaccgccgccgccgatgagcgcgaggatgatcgacgtccagaactcctggctcgcgaacaattcctggaatggtggcatcatgccttctttctgctaaaaaacgggaatcccacacggtgcggccgttccatgaggccgttatgcgtgtgggattttggaggttgagagatgttgttgcaagagttttggaacgaccggttttggccgtattgcgtcgataatctgcgcgagtccacgtgggtcggctacgagagcgcatggcggttgcatgtcatgccggttttcggtggcatggatctgggcgcgatcagcgtggagctcgtggacaagtggctggcccgattcgacgagccgggagccgcccgcaaagcatgggcagtcctacgcgccatgctcaggaaggcgatacgctggaacctgctggacgtggacatcacgagacgtgacatccggctgcctcaacgccgccgttacgagccgcggctgctgaccacgcggcagacgcgcgacatgctgcgcggcttctacgggcatgacttggaggcatggctgatctgcgccgcatcatgcggattgcgcaccgaggagggactgggactcgaatgggccgaccttgacctgcgccgtggcgtcctgcacgtggagcgcggcctgcaatgggtcaaaggccacgatgtcgtcgtcgagccgaagacagagctgagccgccgaacgttgccgttgccgcgtttcgcggtcaaacggttgcgcgagctcaaaccgcgcgacggtggtcggcttatcggcgagcgcacgcccccgcaggtcgcgagagcctacgtgtcatggtgcaagcggcataatctaccgcacgtgcccgcgaggaacctacgccactcgtgggcgacgaacacgctggcggcgggagccgatatcgccatcgtgagcaaaatgctcggacacagcgacatcaaaaccaccgcaaagtattacctcaaaccggacatctcagccctgcgtgacgcacagcgcctcttcgagcgagccttgatagcctgtgggattcgctaacccagtttgagacggggcagctcaagatgccgtacagcgacaggaccatcaccctgaccaaggtagggtgcgtggtcgtcgcgaacgcgtacatcacgctcaccggtagtttcaagagcgccggcaacgtggcggtcaacgagaagattcccgagggattccgtccggcggacggcgctaacgcggtgctgcacggctccgacaacggcggcgacgccacattctaccttgtcgtgagtcccgacggcagcatgcggttgaacggcaccggcaatgtcggccgattcatcggcgtctccggctgctggattaccgtgtggaaccgctcctaggcgaacgtgaccccgtcggggatgggtagcgtgcggggcgtgtgtatgcaccggtcaccattcgccagtcctccgatcaccgtgatggtgccgtccgtgttccaacgcgcctgtttgccgtaattaccgttcgggatcgaccacaggcaaccaaggttgattgtcttggacggccgcgggccggacgcatactggaacaccgggaagttgccgactgtgaccttgctgcggaaaccgctcaggtccacatgcaggagccggttgcgccggtccacgatgatcctcatgccgccgccgtaactgtccgccacgaacgaccccgtgtcctgccacttgaatttcgcgataagaagcgtctgggttagcgaatcccacacgtcgctcatcggcttcaacacgttgaacaacgcgacgggcgtgccgatggtgatgccgtcgagcggaatcctgtagaggggcatgtcgtaggtggtgccgccgtccaacgggctggtcgtgttgatcgtggggtccgtgggcgtgcccgtggtgggcgtgcccttgaccacgagcagttgagccgattcgatcgactgactgcctttcgtgtaccggcatacgaccagatcgttgcgtttcatgccctgcgagccgttcgtgacgatcaggtcctcgggcctgccctggttgacgtgtcggccctgcatgaccagctcgcccgtgccgatggtcaccttgttggccgagacgaccgagattttgaacttgtcgtgcacgttgagcacgtagtcgtcgaggccgaggatgccggcgttcaatcccgcggcctgctccggggtgacgtgcgccttgcccgcgtgtcctgttacgagttcagccattctgcttgcctccgttctgcatccaactgtcgaagctgttatcaaagtccttgagcttgttcgcgtattccttgtaatcctggtcgcagaacaggtagtcgtggcccgtgccggtggagtccagccggttgacgttgtaccacgtcttgatatccgggtcgtccaagtccttgtaccatttgtgtttcccgcaccggtcgcattgcatgaccgtcgcattgtcgatacgcgccatagcgtgtcctcccttgttattcggcctcgtaatcgacggacaagacgccgcccgagaccttgacgattttcttggtgatagaggcgttgacggtgatgccggtgagattgtcacgcgcggtcacggtgtcgcccacgtcgaacaccacgttcgcgtcatcacggacggtgaccttcacatcaccctcggactgcaagtcctgcaacttatcacgtgtcttctgattcagctcggcggtttcggcgttgctgtagtcgtagacctgcgttatctcgtccacgcccttgagcgattgggattggctgacattgcctttggcgtccgcataccagtggacgacggttctcgcggccaaatcgcccttgcccaggccgatcatgtggttcggcttgcgccacgtgcgggtcgcgtcgaaatcgatgaggtcgctgtcaatcgagtcgccataatgcgcgatgggttccgcccagatgttgacctgaccggacgcataggcgagcttgagtttcagtccgttggctgcgcacatctttcgcaaaccggtatacgcatccacgtaacggtcgaactggtagcttttgatggtctgcgcgccggcagtgggcgaatccaccgcgtcaaacacgccgtcaagaccaacacgtctgatgagcgaaccgatgaccgaggacgcggaaccggaaaccgtcagataatccttgcctgagtcgggggcgagaatcttattagccagcatgccgtgccatgtgcggccggaataggtgagggtggattcaccacgtttcagagagtccttcagcgcgtccaccacgccgccgcactcgccgccgtcaaggtagacgtagctgccggattcgatgagtctgccgctaacggtgagctcgaaatcgttttcgtcagaaccccatgcggagtccagcttgtaatcagcgacgctttcacggtcaacgccttgcgcgtcggtgataatcagttcggccatggcggttcgctttcctccgcgtagacggtcagatcaacaccgaagccattccactccacggtgctgtcgccgggcggaattggctggaatatgtattcgccgccgttgagcccggttccgcgccggcctttgtcgaacacgttggttttgtctccgttctcagcggtcatgacgatggtgcgaaggcctgcaatcgaagtgacggtcacgtaggagccggacggaatctccatgttgagcgcgtaccggttgcctcccaacgtgaactgcgggttcgacacgggcccgtatatcaccatctggaacggcatggccgtaggcatgggattgttcgcggtagcgtttcgagtggtcatcagataatcatgcgggtaatcgtgcggatagtcgaggtcgaggccgggcgtgagcgcgtccgaccagaaatgctgcacggatccggccttgcgccagatgccgtccaacaggacgacggtgagcttctgttggattatcgccggcgtgatggtctgcggttccgccttgaccacgtaggcgcgcgtggtccatccgtccgcgtcgaacgtgccgggcgttccggcggccacgtccgcgtcgaacaggcggcgagtcgaatccaccttctcggggcagcggacataggttaggtcaagctcggcctcgcgcgccgtgcgacttactccggttagactccggtatccgagggtgtacgaccattcgcggccgcgcagcccctccgccgtctgagcccagatatcgggcccttccagtgggatcgtctcaccggtcgaggcgcacacataactaagcgatcgcattgcgtatcacccttccgagttcacgaccatcgacttcgatgccaagtttctccataatcagtggcatatccgcgtgcagcgcgcgcagttccgacaggagttcgccgagcagttcgcccgataacggttcgccgccagtcgagacggaggctctggtcgggctcagaccgtagccggtggctacatcgggagtcgtgaaccgtgtggaggcgatgtccgaggccatgccgttcatgctggacatgacggcggcttggctgttgctgatgccctgggcgagaccgagaccgatgttccgacctatctggtcgcggaacaagcgtgacggcgagtggatgccgagaaagttcttcacgccggagatggcatctttcacgccgccgagaatggcgctgccaactttgccgatgctgcccgtgatgccgctgataatgccctgcacgatctgcgagccgatggacaccatgcgtcctggtatggatgcaagcgtgttgaccagattgctcaggaactgctggcccgcgcgaagcgcgccggatgccatgctgctggcgaacgagccgaccgcgcttatcgcgccggaaagcccggcaccgatgcgtccgggcacctgcgagatgtaggagccgatggacgaaaggaaccgtgaaccggcgttgaccgcgttcgacgccatccggccgacgaagctggctgcggcgcttacggccccgctcagccacgagccgacgttcgacggaagctgggagatgaacgtgccgacgttgctgaggaactgggagcctgcggaaagcgcgttggcacccatctgcgcggcccagctcgccaccgacgcaaccgtggaggtcagccagttccagatattgcccggcagttgcacaaagaacgtgccgaggttcgcgagaaactgctggcccgcagaaatcgcctgagagccgagctgcgcggcccacagcaccacgaacgtgatgccataggcgagccagtaggctatcgtcgccggaagattcgtgaggaagttcgctatgttcgagacgaactgctgtcccgcctgcaacgccgactggccgaagctcaccgcccacgtgccaatcgacgtaatcaggttcgacaacgccgtcccgatcgcggaaggcagttgctggaaccattgaatgacagactggatcgcgttcgggattgtctgcgtgaagaagttggcgatgttctggccgagactcgtgacgaacgaaaccaccgactgccatgcggaggagagtcgacgagctcgccaggcagcagcggggtgtcaccggaatcgatcacggtgacgcggcgcagcatctggtgcacgatgacctcgatgtgcttgtcgtggatatccacaccctgggaacggtacacggtgtgcacttcgttcacgatgttgacctgggcggcacgcgggccgaggatgcgcaggatcttcttcggatcgacggaaccttcgaccagctggtcgccggcggccacgtgatcgccgttcttgaccagcatcggcgcgcgacgggtgtcggtgtagacgatcggttcgacgctcgtgtcgtccggcgtcagcgtgatctgacggccgtgatcggtgttctccaccttgaccacgccggcgaactcggcgatcggcgcctcacccttcggggtacgggcttcgaaaagctcggtgacacggggaagaccctgggtgatatcggacgcggcggccacaccaccggagtggaaggaacgcagcgtcagctgagtaccaggctcgccgatggactgggcagcgacgatgccgacggcctcgccgacgtccaccagcgtgttggtggccagcgaccagccgtagcacttggcgcacacgccgcgcttggactcgcaggtcaggacggaacgcgcctgcacctcttcgacgccgtgcgcgaccaggtcgttgagcacgtccatcgacagggcgtcgtcgcgcttgtacagcacggtcgtgccgtcggccgggtcgatgacgtcggccgcaagcagacgggagtaggggccaccgtcggcggccttgacgagcgtcaggttgccgttctcgtcgcggtcggcgacgcgcatggtcagaccgcgcttggtgccgcaatcctcctcgcgcacaatcacgtcctgcgagacgtccaccagacgacgggtcaggtagccagactctgcggtacgcagtgcggtatcggccagacccttacgagcgccgtgctcggagatgaagtactccagcacggacagtccgcggcggtagttcgactcgaccggtcgcggaatgatctcgcccttcgggttgttcaccagaccacgcacgccggaaatctggttgatctgggtcatgttgcctcgtgcaccggactcgacgatgatcgagaggttgttcttcgggtcgaagttcttctcgatggccttggagacttcctcaccgcacttggtccacacgtcgatgatcgcctggcggcggtcctcttcggtgtagaaaccgaggtcgtactgctcgttgatcttggcgacctcctcctcggactgggcgaccagctcgttacgctccggcggctcgacgacgtcggagaacgcgaaggtcacgccggaccaaggtgcgcgggtgaagccgagatccttgagcgcatccagcgaggcggccacctgggcggtggagtaccgggtggagatgtcgtcgacgatcttggccagcttcttcttcttggcctgctcgttgacgaacgggtagtcgacgggcagcgtctcgttgaagaggatgcggcccatggaggtagcgaacagcacgctgccgtcgtggaagcgctcttccttgacgacgtcggggctgcccggttccggatccacgacggtgatctcgcggggctcccagccggtcggcagcacgaagtccttcggcaggcggatcagcacttcggcctgcatgtcgatctcgtgcaggtcgagcgccatctgcgcctcagcgtatgaggagaacacgcggccctgacccttggcgccgtccatgacggtcgtcaggtagtacaggccgaggatcatgtcctggctaggcatggaaacgacgtggccgtcggcgggcttgaggatgttgtcggaagcgagcatcagcgagcgggcctcggcctgtgcctcggcgctcagcgggaggtggacagccatctggtcgccgtcgaagtcggcgttgaacgcggcgcaggcgagcggcggcaggtggatggccttgccttcgaccaggatcggctcgaacgcctggatgcccagacggtgcagcgtaggcgcacggttgagcagcacgggatgctcggatatgacctcttcgagtacgccccacacctcggagtcgccgcggtcgacgagacgcttggcgctcttcatgttctgcgcgaagttcatgtcgaccagacgcttgatgacgaacggcttgaacagctccagcgccatcggcttcggcagaccgcactggtgcatacgcagcgacgggccgacgacgatcacggaacggccggagtagtcgactcgcttacccagcaggttctgacggaagcggccctgcttgcccttgagcatgtccgaaagggacttgagcgggcggttcgaggcgccggtgacgggacggccgcggcggccgttgtcgaacagggagtcaacggcttcctgcagcatgcgcttctcgttgttcagcatgatctcgggcgcgttgagctcgatcaggcgcttcagacggttgttgcggttgatcacgcgacggtagaggtcgttgagatcggaggtcgcgaagcggccaccgtcgagctgcaccatcgggcgcaggtccggcgggatgaccgggatgacggtcagcaccatggcctccggcttgttgccggtggtcaggaaggcgttgacgaccttcaggcgcttgagggcgcgggccttgcgctggccggagccggagtcgatctcctcgcgcagctgcttggaggcggcctccaggtcgaagtcctgcaggcgcttctggatggcttctgcacccatacaaccctcgaagtagtcgccgtagcggtcctgcatctcgcgccacaggtccacgtcgccttccaagtcgcccggcttcaggctcttgaagcggtcgaacacggcgttcagacgctggatctgatcgtcgtaacgctggcggatggcggccatgtcgcgctcggcgccgttgcgcagcttggtgcgtgcggggcccctgccctcgccttcggcctcaagctgggcgagatcctcctcgaccttgcgggcgcggttctcgatctcgttgtcacggcgcttggccatgttgccgatctcggtatcgaactcgtcctgcaggtcgggcaggtcgttgtggcgctgctcctcatccacgctcgtgaccatgtaggccgcgaagtagatgaccttctccaggtccttcggagcgatgtccagcaggtagccgagacggctcggcacgcccttgaagaaccagatgtgggtgacgggggcggccagctcgatgtggcccatgcgctcgcggcgcacgcgggacttggtgacctccacgccgcaccgttcgcagatgatgcccttgaagcgcacgcgcttgtacttgccgcaggcgcactcccagtcgcgggtgggtccgaagatctgctcgccgaacagaccgtccttctcgggcttcagggtacggtagttaatggtttccggcttcttgacctcgccgtggctccaattgcggatgtcgtcggcggtggccaggccgatcctcagtttgtcaaatgcgttgacgtccagcactctgtattgtcctgtctttgaaattgatgttcaatcacgtttcgtccgggtcgtccggcccgccgcgccgcgcgttcgctgcgcggccgcgggccggacgacccgtggggaatcactggtattcgggttccggggccttctggtcttccttggcggcggcgtcggggcgtgcgccgatgttgaagcccaggtcagcgctggaggagggatcgtcgtcctcgtccttcatgtcgatggcgacgccttcggcgttgagcacttcgacgttcagggacagggactgcatttccttcaggagcaccttgaacgattcggggatgcctgccggcgggaggttctcgcccttgacgatggcaccgtagacgcgcacgcggccgtccacgtcgtcggacttggtggtcatcatctcgtgcagcgtgtaggcggcaccgtaggcctcaagggcccacacctccatctcgccgaagcgctggccaccgaactgagccttaccgcccagcggctgctgggtgatcatcgagtatgggccggtggaacgggcgtggatcttgtcgtcgaccaagtggtgcagcttcagcatgtacatgtagcccacggagatcggcttcgggaacggttcgccggtgcgaccgtcgaacaggcgcgccttgccgtcctcgccgaccatctggtcgccgtcgcggttcggcagggtggacttgagcaggcccttgatgacgtcggggcgcacgccgtcgaagacgggcgtggcgaccggcgtgttcggagcgcccttttcggcgcccttgggcacgtacttcttccactcggcctccagatcggggtcgaggctgatgtcccagccggagtgcgcgatccagccgaggtgcagttccagcacctggccgaggttcattcgcgaaggcacgcccagcgggttgagcatgatgtcgaccggggtgccgtccgccaggaacggcatgtcctcctcgggcaggatgcgcgagatgcagcccttgttgccgtggcggccggacagcttgtcgcccacggtgatcttgcggtgttgcgcgatgtacacgcggatcatctggttgacgccgttgggcagctcgtcgccgtcctcctcggcgtcctcgcgggtgatctccttgaccgcgatgacagtaccggtctcgccgtggggcacgcgcagcgacgtgtcgcgcacctcgcgggacttctctccgaagatggcgcgcagcaggcgctcctccggggtcagctcggtctcgcccttcggagtgaccttgccgacgaggatgtcgccggcctcgacctcggcgccgatgcggatgatgcctcgctcgtcgaggttggccaccgcgtcctcgccgacgttcggcagatcgcgggtgatctcctcggcgcccagcttggtctcgcgggcatcgatctcgtactcctcgatgtggatggagctcagggtgtcgtcctgcacgaggcgctgcgagatgatcacggcgtcctcgtagttgtagccgttccacggcatgaacgcgatgagcaggttcttgccgagggccaggtcacccttctggatggcagggccgtcagccagcacggtgccggcctcgacgcgctcgccgtccttgatgatcgggcgctggttgtagcaggtggtctggttggaacgctggaacttggacagcttgtaggagctggtggtgccgtcgtcgttcatcacgcggatgatgtcggcggacacgtaggtgaccacgcccggcttgtcggcgatgatgacgtcaccggaatcgtaggcgacgcgccattcggagccggtgcccaccagcgggcgctcggactcgatcagcggcacggcctgacgctgcatgttggtacccatcagcgctcggtggccctcgtcgtgctccaggaacgggatcagggaggagccgatcgagaccatctgacgcggcgacacgtccatcaggtcgacttcgctgaccgggacatcgaccgcctcttcctcgtccttacgggcaagggcctggctgttgacgaaccgaccgttctcgtcgatctcctggttcacctgggcgatgacgtggccgacttcctgatcagcggtcatgtgcaccacttcatcggtgatctggccgtcgacgaccttgcgatacggcgtttcgatgaaaccgaacgggttcacgcggccgaacgtcgccagcgagccgatcagaccgatgttcgggccttcaggggactcgatcgggcacatacggccgaagtgggaggcgtgcacgtctcgcacttccatcgatgcgcggtcgcgcgacaggccgccggggcccagggcggacagacggcgcttgttggtcacgccggccagcgggttgttctggtccatgaactgggacagctgggaggttccgaagaactccttgatggtcgcgttcacggggcggatgttgatcagggactgcggggtgatggcctcggcgtcctgcgtggtcatgcgctcgcgcacgacgcgctccatacggctcaggccggtgcgcagctggttctggatcagctcgccgacctggcggatacgacggtttccgaagtgatcgatatcgtccacgtccacgtgcaggtcgacatcctcgccgttgcgcttgcccgggaaggtcttgccgccgtcgtgcagggtgaccaggtacttcagggtggcgatgatgtcgtcgcggctcagggagcggtcgttgatctcgtgctccaggccaagcttgcggtcgatcttgtagcggccgacgcgggccaggtcgtagcgcttggtgttgaagtagaaggagtcgagcaggttgcgtccggcctccggggtggcggtgtcggacgggcggatcttgcggtacaggtcggtcagggcctcgtcctgcgtctcgatggtctccttctccagcgcgtcgagcacgagcgagtagccttcgaacgcatcgcggatctcgggcttggtcatgccgatggccatcaggaagacgatcgcggactgcttgcgcttgcggtcgacacgcacgccgagcacgtcacgcttgtcgatctcgaactccagccatgcgccgcggctcgggatgatcttcgcgccgaagatctccttgccggtggcgcggtcccggctgcggtcgaagtagacgcccggggagcgcacgagctgggagacgatcactcgctcggtgccgccgatgatgaaggtgccgtgcggggtctgcagcggaaagtcgcccatgaacacggtctgggacttgatctcgccggtgtcgccgttctcgaattcggcgttgacgtacagcggcgccgagtaggtgtagtccttctccttgcactcctgcacggtgtggcggggctcctcgaagtacggctcggagaacgtcaggctcatggtctgcgcgaagttctcgatcggggagatctcgttgaagacctcgtcaaggccggacatgtggggaacggtgtcggtgccgttcgcctcgtcctcctcgacgcgcttcttccaacgctcgttgccgatcagccagtcgaagctgtcggtctgcacgcccagcaggtagggcacggggatgggctcgcggatggagccgaaattcacacggtccgacgccttgtgcagatcaatgtcatgctggtcggcgcgtgcgatgatggtggtggtattcgtcgtagcttgagtgtcagccaatggacgttccttatcgctcgctaatgtcgttatcgatatgttcccggaaacgccgcagatggccaccatatgccgaatcgcgggcgtttcatctttgtcgacatgcccgctatatgacatgcacttacgcaaattccaagttttagcacaaatcagccgtcggcgcaacatacatcacatgcgcgacacgccgcacgctgcggccggacgcggcaaccgccgagcccgcggcgagcggcccgctcagggccgtcgccacacctgaccgtcactgcacctggatggtgaccggatcgctgaccgccttgggcgcgttcttcagactcaactgcgcggtatatgtgccacggtccaccttcggcagtttgctctgatcctccacgcactggtcccccgtgcgggaggcgccccatatcatcttctgcgacgtcctgttcatgtcgctggtcttcgccagcagctgacggttcgggtcagcggggcaggagtccgaactgtatatcgtctggtcgccggacgacaccgtcagcaccacatccgacagatccagcaggcagctcgacgtgccttcatagctgatgctcgccgtgaagtccagggaacctcccatcggaacgccttgggaagccgccgtcagcgacagcttcacatcggacgcgccacaatcattgacgccgctggtcttcttcggcgccggcaccgattcacgcgcgatcggtgtgggacgcagcaggctcacgccatccgccacgccgcggccgagactgtacacgcagaacaccaccagcgagaccgcggccagcacaacgaccagcgcgaccgcacggcgacgacggtacatcgcccgtcgttgcgggctgacgacgcgctgaaggtcaactctgtacttgtggaactgctgctgcaagtggtgaacgcgctggtcaagctcctgtacctcgacaaggcggaacaggtcggcgtcatcgatttaggcaagtggttcccggccatcttcggcaaggtattcgatctcaaggtgctttcggaaggcaacgtgctgtacgtgaacctgttcggactgaaggtgagcgttgctctgtccaaggctgatgatgaaaaccagcagcagaccgacgtggcgattgtcaccatcggcgatagtgtcatcaaactgccttgcagtaaagacggcattgatatgaatgggtcgggcagcaacctgaccgtccagctcatcaagggcaaccgtactcgcgtggaacagtccactgtaacgggcatcgccagtggctatgacgtgttcggcggaggggcaactcaggataccgacggtgtgaaggatctttccacaggctacacgggcggcttcgccggactgaacgacgagggtgtgctggcagacgaccacatggtctacgccgacacgatccgcggtgccagcggactggtcgacccgttctcgaacaccaaactcaagtccgtatgggacttcaacaccatgagcgacatcctcggaccggtcgatgccggcaagggcggcaaggcatacaacacctatcgcatttaccgcaaggcggccgcgaacgctagtgaggcccgtacctccgcacaggacggcaacaagatcttctcgcagaagaacacggcggacgatgcgctgaacaccggactcgatcgttgggaagtgaagctgttcgacgtggtcaacacatacgacagcagcgctgtgcacagctccgcatccggcgacgccggcaccacttgggtcggcattaaggacgccgtggtcaactccacggacggcagcaccaagacgaagctcgatgcctaccagtccccggccaaggccgtgctcatgctcgacgcgaccgtgaccgacaacaacggcggactcacccccgaaccggacgacggccaggacccgtgcggcaaggacggttgccgaaccattgacctgaccgtccagaaggtatggaaggacggcaacctcgaacggccgcagtcggtcgaactgaagatcgccgcgcactataccgatggcagtggcaatacggtgacgccgcagacgattcaatgcttcggcgcggattgcacaaccgtgacgcagaagaatccatggacggtgacgttggactcctccgatgcctcttcctggagcaacacctggcgcaaggtgattcaaggactgccggtcgcattcgtggatggacaggatgccaacggcaaggacatcgtgcgttactacacgtacaccgtggaagagaccgccgtgacctataaggacggcgataccaccaagaccatcaagcccgcggaggccggataccaagtatcggtctcctacaacaccaaggaacgcgtggccattgttaccaatgtggcgttgcttccggatacgggaggcgcgggcacgatgtggttcctgatgttcggcttgctgcttatgggagctggcgtggtctggtacgtgcgtaatcaacgcgttcaatccggcacagtccgctcgggctccagccgtatacgaaagcgaggtgcccatgcctcgtgacgaccacatagacaaaccgtacctgccaaacagaaaagatttccatctagagaaaggaacagtaatgaagtcactgatgaaaaaggttttcgctgccgccgcggcgattgccaccgtatttggattggctgcgacgacagtcgccacggccaacgcagcgggtggtaatgccacgctgacggtcagcactactgacgcgaagttcgccggtaagaccgtgaacgcctacaagatgttctccgccaccgtgagcggtgacggccaggctgtctcctacacgttgactgacgagtggaagccgttcttcaagaactccactgcttccggactaactgatgttaccgacgcgaacatcaacgataaagcaaacgactacgtatccaagctgactggtaatgccttggttgctttcgctaccaaggcatcgaactgggcgcagaccaaggccaacaacatcacggttggcgcgaccgctacggtatctgccgatgcctcgaacagtaagtacactgcgacgttcactggtctcgactacggctactacgtggtcgctgtgccgggtgcgaccttggccaacgccagtagtcaatacgccacgctagtttccgttcatagcaccagtgtgactgccgagattaagggcaacctgcctaccgtcgacaagaaggtacaggtaaacggcactggtaaggacgccaccgacgcgaagatcggtgataccctgacctttaccctgacttccaccattccggacatgtccgcctatagcacctacaccttcaacttcaaggatacgttgtctaagggcctcacctttggacaagtcacttccgttaaggtcgaaggtgcgaatagtccactgaccgtgaacactgactacaccgtcaccactcctacggcctccaacaacaatacgcttactgtcgccatgaaggacttcaagaccaagcagcaggtcaatgccggcaagaagatcaccgtcacctacacggccacgttgaacaaggatgctgttgtgggcggtgctggtaacgtcaactccgcaacgattcagtactccaacaacccgagcaccaatggcaccggtgagtccgaacccagcaaggttcgcgtcttcacttatggcttcaccgtcgataagtacactggtgaccaatatactgatgccgctactcgacttgctggtgctaagttcacactcgcacctaagaacggcgaccctatgagcttcgtgcaagtcaatgccggtagtgcgaccgcgaacgctgtataccgtgtagctacggatgatgagaaggcaagtactactacgacgactatcaccactcctgaaaacggtaaggttgacttccagggactgaagaacggcgagtacacgctcaccgagaccgaagcgccggccggctacaacaagctcgccagcgccatcggcgtgaaggttgatggccggaacgacggcactgacaacacggatgccaccgtcaccatcacctacaacaacgacaatggcagcgtctacggcgagcacgcatcgaacggtgtcatcccggtccggaacaagtccggtgttaccctgcctggcactggtggcatgggtaccatcgccttcacggtgattggtgtgctggtcatcgcgctcggcgttgcctggactctcaagcgcaagaacgcctgacgagcatggccgtgttttgggcgtgaagggcacacacccgctacgcccacaacacggtttcctcgcgaaaagaacgctcgatgaaacgactgcgcaacatcctgcccttactggtcattctcggtggaatgctcattctgttctatccgacgatcagcaacttcctcattatgtgcaacgccagccgcgccgtaaataactacgacgccagcgttgaagcattgagccaggaacagtaccagaaggtgctggatgctgcgcacgcctataacgaaaagctcgcccagaacgatgcgggagagaccgacgctcttgccagtgccgtcaattccgcatccacggacgaggaatacaacagtctgctcaatattgacggtgacggcatgatgggatacatcactgtgcctaagcttgaggagaccttgccgatttatcacggcacttccgagaaagtgttgcaatccggcatcggacatctcgaacagacctcactgccagttggtggcgcgtccactcatgcggcgctgtctggccaccggggcttgcccacggcaaaactgttcacggacttgaaccttatgaaaaaaggcgacaagttctacatcacaatacttaaagacacgtatgcgtatcaggtcgataagatcactaccgttctgccgaccgataccaaacaactggcaattgagcccggcaaggatttggtcacgctcatcacttgtacgccgtatgcggtcaatacgcatcggctgctggtgcgtggccatcgcatcccatacacgccgcagcagcaggatgacgccaaatccacgttccacgtggacattccgctgcagtacttgttgccgtctcttgcactgattgccttgctcatcgcatggcatttatggcagcgccatgagcggcgacgccggcagagtgggagcgccaaggtcgcatctggtgattctgactctgcggatattgagccggacggtgacttgcctcctcagccagacagtacaaataaccaatcacattcatcatggcggaaaggaccgggcagacatgttagacctgcatagcggaagcgagtatggtgcggcgcgcattgctgccatgattgccgccgccgttactatcgtcctcactgttcttgcagccttcggctctatggtgccgtatgcgcaagctgattctttcggcgctctcaccatcaatgccgtatggggccgagacacggcttcgcccaaattgcttgccggcgatacctattccatcgtgcgcgtcgccaccgtcacaacgaacaatgatggtagcgtctcctcatataaaaccgtcggcgatttttccggcctcactgccgattgggaacgcctgacatcaagtgaatatcacgatgcggccaagaagctcgctgcgcacgcggcgaaaaacaagctgtaccagcattccggcaccactaacgtagctggtcagctcactttccagaatctgccgctcggcctatatctggtctcccgcacgagctcggcgaaagccaacaaggcatacgactgtgatccgttcctcatctcgattcctggcagtggaggcacatccgctgatctcaacatcacagtagagccgaaatttagcactggaactcctgttgtcccgcccgaagataacccgagcgaggagccgggcaatcctggccttatcggtcgtacgggtgccgccgtaggcagcattgccgcggcagcggggctcatgttacttgttgcgttcattttgttcagattgcgcatgaggcgtcgcatacgggacgtcaattcggccggcaaatcccatacagatgatctattcgtatgcgagaataatgcgccgaagtcgccgctactcgctgcacttcccaagcaccacgtagaatcgaacacatggagttgaacgatttgcctcagatggatccgcgcgcgctgaaggccacgtccgtcaaagccgaagacgaacatgccagttcagctgagccgcaagcattgaagatcaccgccgccagctcgaacccgaagatgttcacgctgccctggcataagcccctggccacctggcccgaggacctgctggccaacctgccgcgaggcatctcccgccacgtggtgcgttttgtgcatgtgggcgacgaggtgtacgccatgaaagagatcacccgtcaggtggccgagcgcgagtatgagattctgcgccgactgcagaagctcgagttgccgaccgtcatcccgattgccgtggtcaccggtcgtcatgaccgcaacggcgaaccgctggaagcgattctggtcacccgtcacctgaagttctcactgccgtaccgcgcgctgttcgcccgcaatctccagccggatactgccgagcgtttgatcgacgcccttgccgtgctgctggttcgcctgcacttggccggcttctactggggcgatgtgtcgctgtcgaacgtcctgttcctgcgtgatgccgacgcgttttccgccttcctggtggacgccgaaaccggtgatttgcaggtgcagcttaccgatggccagcgtgaatacgatatcgacttggctcgcaccaacatcatcggtgaattgatggatttggcttctggccgtctgctgccgagcgacgtggacgagatcgaggtgggcaaccgtctggtcgaccgctaccactcgttgtggagcacgctgaccgacaccgacaagttcggcccggatgagatgtggaagatcgagcagcgcgtcaacaagctcaacgacctgggcttcgacgtggacgagctggagatgaagaccgcggaggacggcaaacgtgtgctggtccgcccgcgcgtggtcgatgccggctatgcgtcgcgcaagcttctgcgactgaccggtttagatgtgcaggagaatcaggcgcggcgcctgctcaacgatctggatgcgtaccgtgcctccacgtggcgtgaaggcgaggagttggagatcgtcgccaccgattggatgcgtgaggtgtatgagccgaccgtgcgtatgattccacgtgaatatcgttcgcagatcgagccggcacagttcttccatgaggtgctggatcaccgctggttccttgccgagaaggccggccacgacgtgccgatgggcgaggctgtggaaagctacatccaatccgtgctaccgaactacaagctggatgacaaagccgtgaacgagctcaacgctgaagcggattccggcgtggtcgacgatgaggcgaattacgaaaagcccatcgacgatgatgattacaatcccgacgacgatcctgatgccgcggtgtggagccactgatatgtggagctgctgagcgaaaccggacggggtggtgcgccgattgcggcggccaccccgattttcgttccgctcgatgaccccgccggcagcagggggagatatgggtattacttcgtggcggctgccgctgcttcgcgacgggcgcgggcgaccgcgtacaggctgataccggctgcgaccgaggcgttcagagactccaccatggacgtgatcggaatgccggcgatcgcgtcgcacgactcgcgcacaagtcggctcagtcccttgccttccgaaccgagcacgacgatcagcggatcggtctcgaaaccggtttcgccgaccagcttatcgccgccgccgtctaggccgaccgtgtaatatccacgttcgcgcatgctttcgatggccttggtgaggttcaccacgcgagccaccgggatatgcgccgcggcaccggccgataccttccacgcggcagcggtgaccgaagcggaacgacgctccggcagaatcacgccgttggcaccgaaggcggcggccgaacgaatcaccgcacccaggttctgcgggtcggtcacgccgtcgagcgcgatgaacagcgggcgtgcgttgatgcgcgcactcggcgaattcaccacgtccatggccttggccttgcgctcggcgatatccgccagctcggcgagagacgaatactggtacggttgcactttgagcacgacgccctgatggttcgacgaccgggcgatgcgatccatttccagacggtcggcctccagcaggtgcaggctttgtgcgccggcgagcttgatgatctcgcgtgtacggtcatcatgctcgatacgtgtcgcgatatacagctgcatgctggggacgccgacgcgcagcgcctccagcacggcattgcggccgatgaccagatcgtccgaatcggacgtgaacttcgcggcgcgacggcgggctgccagtcgtggatctgccatcttgcgacggttcgtcgcctgcttggccttgtatgccttgtgatacacgcgatcctcggctttgggcgtcggccccttgccgcgtagcgcattgcggtgttttcctcccgaccccttggtcggacctttcttgattgccatacgtgccattgtcccagacccccacgccaaacagccattcgcggcgcgcgaatcgccccaatcccctgagagactcggtttgcgttcctaagtgcgcgccggaacgccgagtgcgcgaacataggaacgcagatcgcatagtttgcgttcctaagtgcgcagaggggggtgcggatgaaaagttggacgctttggtgtccggattggagttcgcatgttttcgatggaggatcggcgcagggcaggaagcgtctcaggcaatcgacggtcgtgacgtcacgtatgactcctacaggaatctgccggcgttcatcgacaccatcgaacgcctgctggtgcaggaacgtaccgtggccttggccgacagcgccttcgcgaacggcggagatcccctgctggtcgatgagcttgaccgtgacggcatgattcctgcgctgacgtcatacgccggatggaacaccaacggcaatacgcttggtacctccatatcccaggcggtggccgctcaggtccgtggcaccgacactgatcgaagaatgctcaacgtgaacgtagcgtaccggatcatagaagacgtgttctatcagagcatcgtccgctggcaggttgacgcccaggtatccgatcacggaggatcctaccaggacatcggcgtctgccggcgatgggtcgaggatcatacgcgcaaccttctgcaacacatggtcgatgagacgatgctgtcgaaggcgttgcctcttcaggttgcacgagtgagttttccatggcgacgtttgttcgagatcgatatgaatcttgaaatcacctgatgggaggctgcatcatgaatcacccgacttatgttcgtgaaaggggagtctgacaatgaacgacggaaccgatgaagagggcaaactgatactggcgttggacgtcggtggcacaaagattgcgggtagtgtcctgcgattctcatcggggcacatgcctgagctgatccgtctggtacaggagcccactcaggcgcaggagggcggattggccgtgctgcagcggatcgtcgagttctcctgcgagttgctgggacgaatcgaccgggaagtgatgggcataggtatcggtgccgccggtgtgattgcgctggatggttccattgaatccgcgacctcgctgatgccgggatggtcgggaatgcccttggggccggcattgcgagccgccactgggaaaaccgtttccgttgtcggagatgtgcatgcgcacgcgctgggagaagcgcattggggtgcgggccgcgatgtctcctccatgctgctggtcgcggttggcacgggcatcggtggcgcgatggtgcttggcggtcatgttctgcatggtgcccacaacgttggcggtcacataggacatgtgtgccatccggatgctcgccgcatcaggtgttcgtgcggccggtacgggcatgtggaaccgattgcctccggactgggcatcgaacgttgctaccacaagctcagcggtaaggacgcaaggggcgatcgcatcgccgaaatggcaaggaacggtgacaatgacgcgcaatccgcagttctcatggcgggacgtgcacttgggaataccctggggatgcaggccaacatgcttgatcctgagatgatcgtgctctccggatcggtgtgcggtgccggtgagctgtggctggacgctgtgagacagggctatcaggatcaggtgatcgatgccttgtcggacattcccatagtgcccggaacactgggcgctcaggctccgattctgggcgcggccgttccgctggcccagtacctcggactgatcgagggcgatgaaggcacggctgtggagaaggatccgatatgcgtgatttcgtgagtcaactgcagggcggactgatcgtcagctgccaggcctatccgggagagccgatgagacacccggaaaccatggcgcagattgcactgtccgctcaactcggtggtgcggcgggcatcagatgccagggcttggccgatatcagtgcggtcaaggggcaggtgtcggtaccggtcatcggcctatggaaggaaggcgagagcggagtgtacattacgcccaccttgcgccatgcacgctgctgcatgatggcaggtgccgatattgtcgcccttgacgccacgtcgcgtcctcgaccggacggcaggactctccggcagacggtggatgttctgaaggaggaaggcgccgtgctcatggctgactgcagctgtctggacgacgccttgcaggcagccgatcttggctttgacttcatctccacgacattggccggttacaccggcggccggccgatgtccgacgagccggactgggacctgctggagtccatggtggacagactcccaaacgtgccagtcatttgcgagggacgcattcatacaccccggcaagcgcggcgtgcacgtgacatcggagcctgggcggtggtggtgggtaccgccatcactcatccgaggcgtgtgaccagctggtttaacgccgcgctgcacgaataaagatatttagttattcttcgatgatgcacctgcggtgcagattaaggcatctaggagtggaaaagggtttccatgggtcgttatctgctgccttttgactgctggaggatgttctgtgccttctcgttggcttctatgtaggttgcgtcttcaagcagctccctcagtctagggctgctcaggagctgttcgactttcaaggccagccaagggccgcgggccatgtccatgccgacggcggcgcgggataccagctcatactccgcatcggacagcttcgccaggacggaacggtactgtttgtcatccttccagtcggtgtgacctgtgcggaagcggggtgctcggaaaggtttcttgttctttgctgccagctccccgggttccaccatggtcgcggctagtctgatgatcaatgcttccgtgacatggttgtctttgctggcctggtcgagcatgtttccgacatgcaaagacatcctcatgagcacgcttcgcttgtgataattcgtgttttcgtagctcatggcttgttcctttctatctgcgtgccagcggaaagcgttttccaccgtattgtgccggcgacttggaaaatgctttccaatggattgtcaatttggcctgaaaagtttccaagactggttgggctcgtgcgctatgggtttggctgcgactggtgtatctgctgagcagccaggcgatggccgcggtggcgatggcttgccaccagtgtgtggtggcggcaacgccgtctgtcatgagagtaagaaccgacacgaacaggcaagtcgttcgatgatctcggcccgcgtggctggcgttccgatgccgctggcgtgcgtgctgtcgtcctccaatgcggctttcaactcgtccgcgttcttcgtcttcatgtcgagccaacggctggcgtgttccatcgcattgagcagggtcgcgtcggtgaatcgtgccggaggcttggtctctcccttgtgaagctccgccggacagaccggggtgagcgtcacgtcttcgacaaggttgggcgggatcgtgtcatgtcggctgacattgtccggttcgtcgtcgcttgtgtcctctgcttgctggcatgatggttcgatggctttccacccgtcttgcagggcttgctcctggcgtgtggtgaaacctgtctctagatcctcgtcggtgattccggtggctgtggtgccgcattcagggctgatgcgggcttgcacagtggtgatttccacgatttggtcgtcgctgacggcttcccacatgcgacgtacgattcgtgtgagaacgagccgttcctgttcgttcaagtctgccaggcatgtctggttgacccggagagtgggcaggatcgcggtgtggccggcgactttcttgtcgttgacggtcaggcccaggcgaggctggtcggggcgcgtgtctggggtgatgaattcggtgacacggtcgtctctctgggtgagtcggacgagggtttccaaatcgtcgtgcgtgatgtactggctgtcggtgcgcgggtaggtggccagcttccgctcgtacaggctctgcaatgcggaaagggctttgatcgccggtgagccccatgcatgcgggacatgtctttctgcaagccggtcagatcatacaggcgtggtggtttcctatcctgtcgcttacgctcgactttggtgatggtcacgcgcatgccaggcatgtccatgatgtcgagcagatgccgtgcccggggctcctggtcgatgcgctggctggtcaaatgccagccgcccatgtcgaggatgattttccagaacggagtgggccggtggctctcaatctgccggtcacgtcggacgatcatgccaagggtcggcgtctggacccggccgacagtcaagcgccggccgtagacgagcgtgtaagcgcggctggcgttcatgccgatgagccagtcggccttggaacgaagttcggcggctgtgccgagtccgtcgtatgcggattccggtttcatctcgctcagggcctgtcggatggcgggttcttccaggctggcgacccacagacgcatggccggcttgtccacgccggcatggtgacggaggtattggataacgcgacggaagatcgactcgccttcccgatccgggtcacatgcgttgatgagcgtggtcacgtcatctcgttggatgagctgttggacggtcttgaattgcctgtcggcgcctttctgccggttgacgacaagtttccagtcaggtgacgggtcaaggggcagcgtatccatccgccagcgcccccaatcgtggtcctggtactggtccggggtagcgaggttgacgaggtggccttgcgcccaggtgacgagcgtgtccgcgcattgcagatacccgtccttcctgatggcagacgtgtcgagtgcctgggcgatggcttgagcgacggaatgcttttccgcgatgatgagtcgggtcatgaccgatgggtcctttgtcgaaggatcgtgtctgatagaacgaggcaagggccggaatcatacggcaggtcatatggttccgacccctggtcgtggattggctgatcaagcaaggccgatgagtggcgcgaacacggctgccagtccgagcagacaggcaagcagacacacgaccatgaggatgtaggcgatgacctggatgattttttgccgaccgcggaaccgtccgtttccgtgaagacggggtggctgagccgcatcgcgaccatgcgacagacgcctgccacgatcaatgcgaccagggtgaacacgatttgtagtgctcccggcaggttcagagcgaactgccagaccgatgacgctatgtcggcgatcatcccgagcagatgttccattgattgtcccatgagatgttgtccctttttctggatgagcggtccaatggtcgtctcccagcatccatcggttctcgcgtcatgccggagcggcccctctacacgtctcccaacggctgaaaggtgtagagggggccgctccgtcactgcgcgtcgaaggtaggagcatgacggatgacaaggcaaagagccatgaggaacggagatgctgacgcagccgaacaacgagatgcgtaatttcaaacgccaggtactgacgcgtgtgcgcgggttgcgtgaggaacgcgagaaagcggcggacgagtacgcatccacgctggtgaaccttcgaagcctgcgcgcccgtctgcaagtagcggagcatgaggcgcagacggtccgtgaacgtgcaaggaaggccggaaacacggttgccgaactgctcgccatcgaagaactgattgaaaacagttggaaggacagccgggagccggccgtatctgaatcatcggaggggggggctgcttcagacatgcgcaaagagatgcaggctgcgtcttctgcggatgacgagcccgtcatggcagctgccggcggcgactggccgtctgatggtatggaaggcggcatgtgatggtgtcgaggccggcgcccaagccgatgtcgaaatgggcgaagggcgcgtgcatgggggttgcgatactgctggtgctcgccttgggatcgcggtcactgattggacgaggggcggcgacgagaacgagtcctcgatccagacggatgcttccatgaccgaggaaggttcgtcatccgacgggaacgacgcggacgggtcgtggcgtggtctggagacggcggggatccccaagcccggagcgtggtcacggcaacgcatgtcccttgccgcgatacgggacggcaagattgattatggaacgaaggatggcaagactgattattcggcggatcatccggtggccggattgtatggagccattgacacggcgttggcaaccgtgaaccatctgcttgatcccgaatcaagcgatgacgagtggaatgatgtgatccgcaatggtctggctgtggacgggggcggtgtggagcatccgttctctgacgcgtcgcgttggtggtgggcgcaacgacggttccaacctgacagcttgtgctctggccaggcggacagcaactatctggcggcgaaactggatgacgggtgttctcctgacggcgcatggacgaggaaggccacggacgcgatcacgaacaacgtctactggtacacggacgccaccgggttcccgatcccggacgggttgcagttggattcccgcgtgaacccgcaggaaatcgtgagccgtgcgtatgacgcggtgctgattccgatggatgacggtgattggcatgtgaccgtgtactgtccggccacgctgagccggcctgtggtggatcgggacggcaatgagatcgacatcaccaggatgaaacctggcgacgaggcgtattggaatcctgcctcccatgtcggtgtcggcaccaagcagcatccctgccagacggtggaggtcacagtcggcgggcagaaaccgttctgggccgctgtggatggggactaccgatgagacgccgcgcgtggggacgacttccggcagctcctggatccgttgcatgcatgctggtcacgttgacagcatgttccccgttggatatgctcgccttcctgggcgggtgcaagaacacgggcggttccagcacggtacaggtgtcacaggcatcaggcgaatggacgggcctggtgggcaggcaccaggatcagatcaagcagatgtggcctgggcaggtgagtttctgcgcaccatacgattatgggttccaatgcacctggtgggcgtgcatacgacagaagtcattgggacatgacatcggccagtattggggtaatggcggcgaatgggacacgagcgccaggaacgctggctgggagcagggcgcacaggcgggtggcattatcgtgttcaatccgggcgccggcggttccagcagcgtgtacggtcatgtggtcgtcgtggaacaggtgaacggggacacggtccacacgagcgaaggcgggacagggtggggcaaggtcgccacgcgctcgttcagcgcgtcccatcctcctgcaggcatttcctactggcatcccaaaggcggaggaggcgccggcgcggaatcggtcgtgcaggcggattccccatcccactccggtccggcttctggattggctacattgtattagacagtccgatgggggtcgattgacatgaggttggaggccgacgatggccggcccgaggcatccccgccactgcgaggagtcgttcaagcggcggatcgtgcggctttacgagaacggcaagccggcgcgcgagatcagggacgagtacgacatctcgcgttccacgctgcaccgttgggtccagggcatccgcgacagcggctccgcgaaagccgacgacaaccgcacccctgagcggaacgagccggtcgagctgtgcaagcgcaacggacagtcggagatggaggtggacgtttcagaacaggcggcgccggtattcgcacgaaagtagcagtgatacgggccaacgcctcccgctgtccgatatcggcgcagtgcaggataccgggcgttccccgctccgtctgctgctggatgatcgaacatcccgaagccgggcgggtggatccgatcgccggcgacgtgcgcgcggtccggcgcgacggccatgagcgctgcggcgccgggaagatcaaggccgcgctgctcgcccgcgcattcgacttcgaatgcgccgcggtgcacgccgaccgcacggccatcatgagccgtcacttccccggcaacttcttcaccgtataaacaatgcgggagggagcacctgcgtcatgccaccgccaggttttcttgtgcctattcgccacgctcgcacatcagtggcgccgacacgtcaatcgccgcgccgagcggtgcagcaagcaccttatggatgtccggagcgatatacaggttgccccttccggccggatacgcacggagtatacccacggacaccagacgagacagcgcgtgctgtacggccgacgggctcttgccgaaccttctcctcaacatactcgccgtgacggtgggcgcccgatgaggtacatcgccgtctgcacggacaggccgctgtatctgtgctcatccaatagactgcgatacctctgccgcacattgacaagacgcttcacgcgcagcagcgcgtcctcgcaggattcctcgatgtcttggcagaagaacagtatccagtcatcccaatcccctttcgtggaaacaccgagcaatctgtcctgatattcgggtcgacggcgctcgaaccacggggatacggacagcagcggatggctcagcaggcctcggctcatcatctgcaacagcaccagcaaccgcccgattcgccccggaggcatgggcgcgaaacgcgcatcctcgatgcgccgcgtgggtgggccgatgaacacttgggtggatcgtatatcccaggcctgtggattgtcggacttcgtgcccttcacaagaagcttctgcaattcgcgcacgagagtgcaggcttatgggatgcccggactgaatctggcctatgccgcattccgccgcgtcgaggtagttcagcacctcgcgcatggactcgctcagtccgcttttgtcctcgcccacctcataatcctgagcgagaacggtttcgagcggctcgaacgtgccttccagggcgctggtgctctgcgcttcgcgacgcatggtcgggcgacgcagcatatcggggttaggcaggtccccccagctcgccgggcgcatctggcgcgaacatttctttctccataacactagctgtacatttttttaaatcattcatactaagatttgcgaaatcttagtatggacaatgattaatcatgcgctttaccgcacctcatcacaccgcatatgcaaaagcgacgccgtacacgagccggcaaaacagccgaatctcgtatggcgtcgctctcgtttgaggcagtggaatcacattatggtcttataggcgtgactccctcagatgttccactcggacgggttgtagaagtcgccgttgagggccttggcggccttctcctgcgcttcctcaagcgtgacgccggcgagttcggcacgcacgtcgtcgagcgcgaccggggtcatcgacagggagttgacgccgatgccggtgagcacgacggccagatccggatcggcggcggcctcgccgcacacacccaccggcatgccgttcgcgttgcccgcgtcggcgatcagcttgatcgcgcgcaacaccgccgggtgccatgcggtctggtagttggcgaccgagccgagcgtacggtcggcggccagcgtgtactgggtcaggtcgttcgtgccgatcgacacgaagtcggcgaccttggccacctgatcggccatgagggcgatggacggcacctcggccatcacaccgaccttcttcagaccgaaggacttgccgagcttgacgaagtaggcggcctcatgcgcgtcggcgaccatcggcgccatgacccacaggtcggcgtcggtctgggcatcggcggcggcaagcgccttgagctgcccctcaagcacgttcatgtgggtgcgcagcgtgcgcaggccacgcaggccaagcgcggggttcggctcgtcttcgggggtgaggaacggcagcggcttgtccgcgccggcgtccagcatgcggatgacgaccttcttgccggggaactgggcgagcagttcggcgtacgccttggtctgctcctcaacactcggcggttcggcgttgccgatgaacaggaactcggaacggaacaggccgacgccttccgcaccgtactccagcgcggtcttgccgtcggagggcttgccgacgttggcgagcagcgggatgtggtaaccgtccttggtggcgcccggcttgccgcgcagctccttggccttcgcggccttggccttcgcggcttcggcggcggcgacctgctcgtcgctcggctcggtggtgatggtgctttccgcggcgttgacgataaccgtctcgccgttcttcaggtcgtcggcgccggcggcggacacgacggccacgatgccgcgggcacgggccagaatggccgtgtgcgaggtcgggccgccctgcgaggtgacgatggcgagggtcttgtccaggtcgaggccggcggtgtcggccggggacaggtcttccgcgaccagaacgaacggggtgtcggagaccgggacgcccggcgcgggaacgcccatcaggtcggcgatgacgcgctggccgacgtcgtgcagatccgccgcacgctcgccctgatagccgccgatggccttgaacatctcttccacggcgccgaagccttccagcacggcgcgctcagcggtcttgccctgctcgatgagcgtgttgatgctctgcgcgagcgccgggtcggaggcgaacatggcgatggcctgcaggatcggagcggcctgcttggcgccttcgtcgccgttcgcggcctcttcggcacggcggttcagatccgcgttgaccagcgccagagacttggtcacgcgctcgatctcggattcggccgagacactgtcggcgcgaggcgcatcggacggttcgggaagcgcagctgccatacgaatgaccgggccgaccgcaacgccgcgtccgatgccaacacccttgataaccatatgttctccttatgttatggcctctcgccgcgaatgaccggtacttcccatccgcggaccgctttgttgacccaccaacttcatcgccggtaaatcattttctgtccacgccagtatacaccctcaaaagcgcgacacgactagaagtaaacgttttccagaaaattggaaaatcatggtacactgctgtgtcagcagccaaaagaacggccgcccagcaattggcatagagtaatgttattgctaatcggtatcggcgcgggccaacacggcacacgcacgctgacgagtgtcgatatcgacgcacgacaaaccgcaccggaaccaccggcgcgacgacgcaaaggagtgtctccatggttacccgcactaccaccatcaccgatcccgtcggcattcacgcccgtccggccgccaagttcgctcaggccgcgaccgcgtccggctgcaccgtgaccatcgccaagcagggcggcaaccccgttcccgccggctccatcctgtccatcatgggcctgggcatcaagcagggcgacaccgtcgaggtcaccgtggacggcgacaacgccgagaccgtcatcgacagcctcatcgagacgctcaccgcggccgagtaacctgcgcacgcattcgacggccgcccgcacgaaccgcgtgggcggccgtcagcgtattcccgtccatcagatgcgcaccgacgcgcatcgcaagcatatggcggccgcccgccgtcataccgaacactgcgagccccatgaagagacagccatccgccgtaatggacgccataccggcatccaagccagacacgacgtccgtcaacgacgacccggcgcccggcccggaacaacgcccacagccggcgaccagttccatcaccaacgtggccgccatggcccacgtctccatcgccacggtctcccgtgtgctctccggcaaacgcaccaaggacgacgacatcgcacggcgggtccgggccgccgccgaggaactcaactattcggtcaactatgcggcgagttcgctgcgcggcgccgccaccaacaccatcggactggtcatcccctcggcgaccgaccatttcagcgccggactgcttgatgagctggaaccggtcatcgacatggaaagacagcaactgctgctcggcatcggcaacgagcagcatacgcaggacgaacgcatcgaatcgctggtggcccgcaaggtcgacggcatcatcatcgttcctgccgcgggcgtcgatctggcccacacgcttgaccgcaccaccatgacgacgcccatcgtacaggtcggcggacggcagcgatccttccgcacgtccatggtcggcatcgacgagaatgcggcgatggaaagcatcgtcgcgcacctcgccgagcagggcgtgcgttccgccgcctatctggccggcaaggaggtatcgttcgaatcggccgagatgttcgcgatgttccatacgcagatgcgcacgcaccggctcgtcaccgacacctcatggaaccgattcggcgattcgaccgtggagcgcggttatcagtgcgtgtggcgcatgttcgccgactcggatgcgcgaccgcccgaagcggtgatatgcgccgatgacatgatcgcgctgggcgcgatgatcgccttgcagacgctgggcatccgcgtgcccgacgacgtgcgcgtggtcggctacgacgactccccgcttgccttgacgacgatgccgacgttgacctcggtccgcccgccgttcctccagatcgtcaccgaggcgctgcgcctgatcgggcaggggcccgatcaggcggcgcacatctcgctgctgccccaattgattgtccggggctccaccgtcgtgcgttcctgaccaggtgccgtcatagcctccccggaatcagcgcgcagaacagcgcctcgaacaccagcatcgggttgccgttgcccagcaaccgcttcctggccacggcgatggcctccaaccgatcgaccacttcctgacggctcagccgtgccgacagctcggcgatggccgtgcggttctccatgttgatcagcccgactgcgtcctcggcgttgttctgcagcaccgctatgtcgcggtagatgctggcggccgagttgagcgcgcggtcaagcacgtcgcggctccggcgcgtggcccgccgcttgatctcgtccttcttggcgatggcgttgtaggcgccgcgcagcttcggcgggatgcggtcctgctcgccgaggccgttgatgcggcggaaatccgcttcggcggcggccgtctgccggttcacgtcggcttccgcctggcttttggcggtgtcgatgagatcatcggccagcagcaccgcatccgatgccttgcgcagtcccagcagcccgacgatgagctcgtcccggtccgacatgacctgcgtgtcggaggcgtacagtttcgctatgccgatatgcccttcggcgagccgcgccgcgcgcaccgccacatgacggtcgaattggcgttccgccggcagcgccggattgacggatgccatcaggtaatccgcgaccgctttcgtggacggcacggcaaggttgacgatgcgggtacgcgagcggatggtcggcagcacatcctgcgcgctgggggcgcacagcagccatatggtgtgcgggctgggctcctcgatctccttgagcagcacgttcgtggtgcgttccagcatgcggtcaacgtcttcgatgatgatgatccgccacggcgccgtgctgggcatctgttcggaggtgaggatcagctggcgcacgtcatcgatgccgatggtgaccttgttggtggccaacgtggtcacgtcgggatgagtgccggacagcacctgacgggttatattggtcggctcgtcggaaagacccctgtcagggctttccagcgcggctgcgaacgcgcgcgcaacattcgagcggccggaaccgggcggtccgcagatcagccacgactgggccagcgccttcgggtcgccggagacgatggcctgcatttggccgaccactgcctgctggccgacaatggagtcccatacgctcatcgcgcacctccagccggagtgttaccgtcgctttccttagtgacggcagcctgagcggcagccgcctgcgccgcggcccgctcatccgccgcggcatcggccagcaccgcgtcaacgtccgccttgatgtgctcccatacggcctcgatcggccatgcggcgtcaatcacgcgaaaacggcccggctcgtggcctgccagatcgaggaacgcctgcctggtgcgctgctggaattcgtcgcccgcggactccatgcgatccgcgtcatgctgcagacgccggtgcgccgccgtcgggtccatgtcgagcaggtacgtgcgcacgggcatcagcccgccggtcgcccacatgctcagcccgcggacgtcgtcggcggtcagttcacggcctcccgcctgataggcgagcgacgaatcaagataccggtcggtgatcaccacggctccgcgttccagcgccggacggaccacttcagccacgtgctgcgcccggtcggcggcgaagatcagcgcctccgcgcgcggtgcgatatcggcgccgtcggcttccgcggcgtctcccggctcacgcagcagcagctgacgcaagctgccgcccaatgccgtgccgcccggctcacgcgtcaccacgacctcgcggcctgcagcctccaagtagtcgcgcaggcgctcgacctgcgtggtcttccctacgccgtcaacgccttcgaaagaaatgaacaatccagtcatatctacccccttgcccacagtgtacgcgatggcggcatgcgacgcggccaggccgccatcgcggcggctgcgacgcgactctactcggcggtcttcttcgcggcggtcttcctggccgtggtcttcttggcggccgtctttttcgcggtggccgtcttcttggtggcagatgccgtggagctcttcttcgcggcggtcttcttcgcggcggcacccgtcgtcttgcgacgcccgcgcttggacgggccggcggcacgcttctcggccagcaggcggaacgcctcggccggctcgatggactcggccgtgtactgcttgggcacggtccgattcgtttcgccgtcggtgatgtaggcgccgtagaagccatccttgatggtcacgttcttgccggtttcgggatcggggccgagctcgcgcagcggcggcttcgcggtgccgcgtccacggccgcgtccgtatttcggctgggcgaacagttccttcgccttgtcgacgtccacggtgaagatctcatcctccgaggcgagagaccgcgtctcggacttgccgtcggctccggtcttggtcaggtaggggccgtaccggccgttgttcgcctcgaccgtgacctcgccaagttcgccggtctcggtgttggcctcctcgtaaacgcccacggtgcgcggcagcgacaacagtttcagcgcatcgtccagcgtgatcgattcggggctcatcgtcttgaacagggacgccatcttgggcttgggcacagtggtcttcttggacttcgtctcggatgacccgccgtccgtctcaagcggcaccaaggccacatacgggccgaaccgtccgttgcgcacttcgaccgtgccgccgcttgccgggtcgacgcccagctcgcgcgggcacggagtagttggagaagacgaccatgttggagaacacgttgagcttgtccgtcaggccggcggcgtcgatcagataggcgccgatccagtagacggcgagcatcaggccgttcaggacggtgttcatcagcggcatcatgaacgccatgacgcggttggtgaacagctgcgtgtcggtgaggtccttgttggccttggtgaacttggcctcctgatagtcctcggcgttgtaggcgcgcacgacgcgcaggccggtgaggttttcgcgggccacgaggttgatgttgtcggtgagcttctgcatggccttgaacttgggcatgaccatggccatcatgatgacgacggcgacgagcaggatgacgacggcgatgccggtggcgagagtccattcgaaaccttcgccggcgatcttgcatatggcccatacggccatgatcggcgacttgacgatgagctgcaggccgatggtgatgaacatctggatctgcgtgatgtcgttggtggagcgggtgatgaggctcgcggtggagaatttgctcatttcggcggggccataggattcgaccttgcggaattcgagcgagcgcaggcgctgggtgaatgacgagccgacgcgtgcggagatgtagccggtgacgatggcacaggcgacggagccgagggagatgagcagcatcttgccgccggcgatccagatgtcgctcatcgcgctgcccggcgtctcgacgagcgtggtgatgtctgacatgtaatcgggcagtttgaggtcgaagaagacctgcccgacgatggtcaccagggcgatgagcatctgaccgatctccgctttggagaggtatttcaggatgcgaagcattggctttccccttgtgttttgttggtgattggttacgttatttgccgcggcatcgatatccgatgcccgaattagtttctgttgttagattacttacagtgtaagatattacgcattattctgtgtattcgctgtgaatggcgcgctttgcgctgactgcgcacgagagacacggcacgcacgcccccccacgtcatccgcagccggcggaagaagctactcctcgccggccttcgcgcgctcggtccgcatgtgatcggcgacacgcctgtcacgctcggcgaacgctgcccgcacctcatcgggggtcgggcgcggagcgccgggatggcagatggccatgtatgtcgagaactccgacagcagatcaacgaactcgcgcgtgcgccgctcccccatctgcgagaagatccaacagattgccgaacgcatctcctccaagtcgcacttggaccgctctcgcccagcatccgtaaggttcacgcggatgatgcggcggtcgtccgggtcgatgtctcgggtgatcaacccttttttctccagagcggcaagcactgtggagatgcggccggagctggccttcagcgaactggcaagctgcgacggcgtcatggtgccgcgcagtgcgagctcgtgcagaatgaatggctcgccatgcgcgccgcgcgcgaactccttctgcatcttggaacggttgccccacacgctggcgtacagttcgctgagcgcctcccgctcaaaacccatttcgcaccgccttccgattcgaccattgccgcactaccgcgctccgcggagtaccgccaatacattccagcggcatatacatcgtgcaaacatctgtaatattatctcacaccgtaaacaatttacagtatgtgattatatgtccgcgctttgctcccccgctactaaacttgatctgtacgcatttttccgtacaacaattctatggcgacactaacgaagcaaacggtatcgaaacagaaaacgtcccggcttgacattcgactgacggatgcgcaacggcagctcatcgagcgtgccgccgagctgaccggcagcacgctcacgcaatggaccgctcgccatctcctggaatcagcccgtaaggatatagaagaagcaaccgtcctgcatctggaatcacaggcattccaagatttcatacaggcattggatcagccggttccgccagcagccgaaaaactcatggaaagggatccgcagtgggcatgatccatcattcccaacgtccgcgcaagctcggcccggaagagagaatggggaaagttctcttgtggagtaccgttcatcgacaagtgggccgcacaacacgcaccgtcatcggcccagcatgggacggccgtcgcgtacgtgtcattcactgcgtcaggtgaaccggcgggattctacacgctgagtgcatattcggtactgcgagcacgatccgccagcggcgcactagggtcacgtgcgctcattgtggaaccttacgacgataaagcacgcgcgttctatgcgcatttcggttttcaaccgattcccggaaccaccagcatgtatctcaggctcgtttgacgacgagcctgttccgtatttatgacggtgactcatagcgttgattcacggcagtaaagacagctcctcaggggcgagcgtgagattgactgcggcgaacgagtcccggacctcatgcgggttgcgggcactgggaatggtgaacagacggtcatatctggtcagctcccacgcgagcaccacacgctggtacgagacgccgcgggccgctgcggccgtgcggaacggatcatacgcatgactgtcgaatgcgtctaggaacccgccgagcggcgaccagcacacaaaatcaagaccgagatcggcacagtgacccatcgtatgctcggggtcgggatgcgatggcgagaactggttctgcaccgcaatcagacggtcgccgagaatcccacgggctgtgtcaatctgcgcattgtccacgcgcgagatgccggcgaaccgaatcacgccctcatccagcaaggttttcagcgcgccgaccgtatcctcatacggaaccgcggggtcagggccatgcgaatacaacaaatcgagcgcgtcgacgccgaggcggagagcggactccttcgcgtcacgaatcatcgtctccgggcgcgagtcggccatccacccgtaccggctgccggccgcctgcaggtgctgtcgctcggatgcggatgcgctcgcgccgtcgcccggggattgctgaggatcttccgcgtcgcggttcgtcacttccagcgttcggcgataaccagtcttcgtggcgaccagaacctcatcgcgcggaccgctccagctggcgagcgccgcatgaaccagcatctcgccgtacccgaaatcacgcggcacgcctgtaccgtcaggccccggttcgcttggcagataatacgaccatgcggtgtcgagataacgcactccggcgtcaagcgcggcatggatcgtgccgatggccgtcgcccggtccgggcgtccctcgatagagagcgccatcgttcccatgccgaggcgcggcatgcgcgctttccccgcaaactccacaacgttcgatgtcaccatgccaccatcatcccacgcgacacgaacacagggccgactggcaatgcgccagcccatgagtcccggccccggttcctttcgacttgttccggcgaaagtcccatccgaagacactcagatgggactttggcgggatgggtggacttcacctcccgcgtgaggccccggcagtcaacaaaaagtcggccggccaccgaataggtgaccgaccggcatcatatgccgatccgctgattcagcgccggggctcgcgccgacggcgggcggcaagcgccgcgccgacaccgaccgcgagcagtgccgcgaacgcgccgaacacgccgctcacagaggcgccggtcttcgacaggccgggctgcttgttgccggcatccggcttgttcggcttcaccgtgtcgccgggtttcgtcggctcagtcggcttcgtcagttcggtcggttcgatcggcttgctcggttcgatcggctcggacttctccctgacggtcacgacacgcttgaccgtgtacgacgcaccttcggagtcggtcaccgaatacgtcagcgtgtattcaccggccttctcggtgttcaccgaaccttcgaccaggatcttgtcggtcagatcgccgtcctcctcatcggaagcggccgcaccggccttcgggtcgaacgcgtcgacgttgatgttctgcttcgcggatgcgttgagcagctggtaggtggcaccgtcggacgtgtcgaaaatccaccgggccgcggggtcggacttggcgtcttccaccgactcatcgctgaaggcgttggtgccgtccttggcgacgagcaccttgcagtccgtattggtgatgacgtaggccttgaggccggggcgctcggtgtcggactggtcgatctgggtgaacttccaggcctgcttcttggtgtcggtcagggtctcgggcgtgtcggcgatggacagtgcggaatcgccggaagccgtggcggacaggttcttgccggactgcacgccgacaagctggtaggtgtgcccgactaggcgatcaccgagacgggatggaacgcccacaaggcgttccgcgccatgccgcacgacgcgcagaccgcatttgccatccgcatgctgttcacccaccgcgacgcggaccgctacggcgccgacatgttcctgcactacgagcgcggcttcaacgtgcgcttcgagggtgccggctcgaacaattactgaattcgggcatcggagcgccggagggatcccggacgcgcgagccgccaagcgcgacacacgcacaacacgcgacggttttgcttgtccgcgagtctgtggtattctcttcgagttgtctgttgaggccaaaaggccgcggcaaacagcgtaatggaggattcgcctagtggtctatggcgcacgcttggaaagcgtgttggtgtaacagcctcacgagttcgaatctcgtatcctccgctagcagggctttcgaagaaattcgaaagcccttttcttttgccgaaaacagtttcctttcaacgattccgaacggcttggactgtcggaatagtttccttgtagtgtcttcagagggtgttcggcccgacgatatcggtggcacgttacgtggtgcatccggtaggccaaatcggtgtaccactctatgtctgaagggagccactcatgacattcgatgatcgatcggcgtgtcatatgagaacgtctccgtcgattccgacggtgtttacacttttacattttcctacacaagaaaacatagaaagtatgggagatataggtaatcgtgacacctcttgtcggcgtgaaggtatggaaaagcgcaaatttccttctggcgggctttgagcggcgaacagagtggtacactcattctgggaattggtagaaagccttgccgttgctgggtttgtgggtttcggtatatagagtctccatgatgtgcgcagacctcatgatgcgacgggctcgcctgttcgggccgctgctcgcctccggctgcgaggtgctgatctcggggaaggggacgcgccgcgtgcgattgttcgacggtgagcgggccttggtcgggaacgccacggccaaacgaagaagggaattcacggagacgcgtcttttggcccacgaggccttacgacgtatcggccatgacgggcccatactcaaaggttcggatggtgaaccgctctggccgtccggcatcgtgggatcgctgtcgcattgcccgtcgctgtgcgtcgccgccgtggcgtcggcggaaagaatccgtgccgtgggagtggacgtggacgattcggacggattgtccgacgggatcatgcggttcgtgttctcttccgaagagctcgcatcattgcgtatggtctcctcggtggaacgtagggcggccttctgcgcgaaggaggccgcctcgaaggcgttgtccgcattggacgggacggggacttccgtaaggtatccgtgagcctgaaggcggatggaacgttcgccgctgtgagacgggatgtggcgttgcgcggccaatggcgattctacgatcggctggtatccgcgatggtcgccgttccctcggagaccgtctgaggggtgcggacccctcgaatgagcagccggagcagaaaggaataggccgcatcgtcatcgtcgacgggcgtatcatgttcgggtcgtgtctcgaattggacgaatccgtgcacggcggaccatatggaccatgcgatgaggtgcgggtcatccctccggatctttcccgcggcctgcccgtagcgcaccagctcggtcatggcggcgaggcatgcctccgaagcctcgcccgcatgccatcgccacaacagggcgtagatgccgggcgacgccttggcgtgcccgcggtatacgactcccgcatcgtagagtctttgcaggggatcctcggtggtgacgcgcaggagcttctcccgtaacgtctggaaactgtcgtcgatgagagcgtcgatgacggcctgcttgtcgccgatatgccggtagatgctcgcgggggacacatccgccttttccgagagaagccggatggtgaaggcgtcatagccgtcctcttcgatgattcgtttcgaggcgtcgagtatgaggcccctgatctcggtggtgggcgtccgctggctttttgtcgttttccgaatagtcctcatatgcttctccgcatcatcccgccgttacggatgaaaaacgccatccggcccataggtccctgcaccgtcccatgatgggtggggtcgaaggtccagccacgctcttggaccgcgcctcgatgggtgtgatggctagtcccaccgcattgagattgccaccgagccaagacatgtcggggaacgctggccggcgcgggcgtgccgtcctcccgccgcgtgccatgccggggcatcgcgcatatgatgccgtcggcgtgtgggacggcggcaccgtggcatcgtcccgcacgcacgtcaggcatgcccgtcggctaccggtggtgccgcagggcgtccttcagaatgcggagctcccgcatggattggctacaatgtgttagacagttcgatgggggtcgattgacatgaggttggaggccgacgatggccgacccgaggcatccccgccactacgaggagtcgttcaagcggcggatcgtgcggctttacgagaacggcaagccggcgcgcgagatcaaggacgagtacgacatctcgcgttccacgctgcaccgttgggtccagggcatccgcgacagcggctccgcgaaagccgccgacaaccgcacccctgagcggaacgagccggtcgagctgcgcaagcgcaacggacagttggagatggaggtggacgtttcagaacaggcggcgccggtattcgcacgaaggtagcagtgatacgggccgacgcctcccgctgtccgatatcggcgcagtgcaggatgccgggcgttccccgctccgcctgctactggatgatcgaacatcccgaagccgggcgggtggacccgatcgccggcgacgtgcgcgcggtccggcgcgacggccatgagcgctgcggcgccgggaagatcaaggccgcgctatgccgggtctcatatgtgagatccggcatttcgttgtgccgcaaggcgtcgccgcctcgtgcagtggcgtttttcaggccctgacaggcgagcttgccgggtatttgcgcttcaagggggtgattttcggtctccggaacatctatctgcatttcaaggggttgcggcacagaggcatccgaggtatatgagccattcacttattggaatgacgcggttctagcagtgttcctacttggtcaccaaccccttgaaacgtagatagatgttcgggaagtcgaaatcaccccctcgaaatgcagatagccgtgtaatccacgcctttcgcgcaatattcgtgccgctcagggcaccgacatcgagttttcagctctcgtcgtcgggcagcgccatgtcgctggagccgaatcgcggcccgctggtcgattcgcgctgcactagctgcggcgggtacgcggtgtgcgccggaagccagtgtttgctgctggcactgacgctgatgagtcgcagcgcttcatgggcgatgagccggcacggcgggagaatcgacgagagcggcgggtcggcgatggccgccgcgggggagtcgcccgacccaatgaccttgacctcgtccggcacgcggattcccagttggttcagcgccatcagcgctccgatcgccacatcgtcggtggcgcagatgagcgcgttcgggcggttgcccttgtccccgaacagtctcataacgtcgtgatacccgcgcttcgcggaattgtcgccgaacgtggtccaacccggttcggtcatcaggttcatgaccctcgttgacgtctgcaacgtggcgaacagctcggcggcgctggcggagttgacgttgccgctgaggaatgcgatggagttggcgttgtactctgcaaggtgcgaaagcatcagcttcatggaggcgctttcgtcgacgccaacccagttcacgtggaaggacgtggagtggccgaacgcctgaaccagcgaggtcatgccgacgtggtcatccaggaacgctgcggtgttggcgtcttgcggcggcatgaccaccagcccgtcgacccggcgggcgagcatggcttcgatgcgttccgtctgggttcgctggtcgtcgccgaggcccagcagcagctggcgtcccgagcggttgacttcgggctccaactccgcgagcagtcgggctgccagagggtcggtcgggccgggcatgatgaggccgatggtattggtcgtgtcgctgcgcagtgcgctggcggcggagttggcctgatagttgagctgttccgccgcgtcccgcacgcgtttcgcgatgttgtcgtctttggtgcggcgccctgaaagaacgcgggagacagtggctttggatacgcgcgccaatgcggcgacgtcggtgatggaactcgttgagctcatcgttcatcacctcggattgtctgcttcgattacttctgccgggcaccgcgtcgctgcccgttgtatataggatacatgaacgcacattgcgctcattggtcgccgcgatgccgtatgggcgtgattattgccaatgtttccagtggacagacgtaatggtttctgtatagatcataccatttcattacaaaattgagaaatcggtttccgggtttactaagcggattttagggtgtatagtgacggatgaaagaaacgatttgctcgcgatggtgtcagcaaatcaccaacccatccagcggtggatggctcagcacggaggagatgctatggtcgccgatattgacgggttcctgccggacagcgcgtttctgctcgacgttcccgccaccgattggaaagatgccatccggcttgccggcaaaggactggtggcggctggtttcaccaccgacgcgtatacggatcagatgatcgagacggtcgagaaaatgggcccgtacatcgtcatcgccccgggtctcgcgctcgcgcactcccgcccgtccgaggccgtgctgaagaccggcctgagctgggtgcgcctgtccacgccggtgaagttcggcaacaaggccaacgacccggtatcgctggtcatcggtctggccggtcatgacgagaacgagcacatcaccgtgatgtccgccatcgcctcggccctgatcaatcccaagaagaccgcggcgctcgccacggcccccacgccggaagccatccgcgacatcctgcatcaatagcagggcggcgcaacccgagccgggccgccggcgagcggcacacccacacttccataactgaatccaataactgaaacccaatggctgcgcggcagtcattccaacgaaagaaacgagggaatcatgaacatcctctgcgtatgcggcaacggcatcggcacatcggtgctgttgaaggtcaatgtcgaatcggtcgcggccgaccttggcgtcgatgtcaatgtcaccacctccgatgcgggcagcgccaagggcaccgccaacatgaacgatctggtgctcacctccgccgagctcgcgcccgagctggaaggcaccaccacgcccgtcgaagtcatcacgaacttcatggacaccgacgagattaagtcggtgctggagaagtacgccgactgagacgcgccccgttacggccggcgtgagatgccggccagaaaccataacaagaaaagaaggaatccatgaacgttgtcgttcaagtgctgaatttcatcagccaggaaatactgaatgtgccggcgtatctgattggcatcatcgcggccatcggcctgatcgcactgaagcgcagcgccgggcaggtcgtgtcgggcgccctgaaggcggccatgggctacctgatcctgggtgccggcgctaccgtcgtcacctcggctttggccccgttcggcgacctggtgctcaagtccaccggcgcgcacggcgtcgtgcccaccaatgaggtcatcaccgcgcaggcgtccagccagtacggcgcctcctcggcgtacatcatcgtgctcagcttcatcgtgatgctgctgctcgcgcggttcaccccgctgaaatacatcttcctgaccggccaccacatggtgttcatgtccaccatgctggccgtggtgctgtccgtgggattcggcacggaccaccagctgctcatcgtgatcatcggcgccatcctcatgggcgtgatcatggtggtcatgccggcgttcgcgcagccgttcatgaacagggtgaccggtagcgacaagctgtcgatcggccacttcaacaccctcggctacattgtctccggtgctgtcggcgccggcgtgggcaagaagtcgaagtccactgaagacatcaacttcccgaagggcctgagcttcctgcgtgactccatggtctccaccacgctgctcatggtcgtgctgtacctggtcttctccgtgtgggccgccatcgtgctgccggccaaggaagcgttcaagatcttctccaccaaccccgacaactacggttcgttcttcatggccgcgttcgcgcaggccctgcagttcggcatcggcgtgagcatcatcctctacggtgttcgtatcatcctcggtgaactcgtccccgccttccagggcattgcgaacaaggtcgtgcccggcgcccgcccggcgctggacatcccgatcgtgttcccgtacggcgccaatgcttcgctgatcggcttcctcggctccttcgtcggtggcctggtggctctggcgatcatcgccgtgtggctcggcccggtctggggcgtcgcgctgatcctgcccggcatggtgcctcacttcttcgatggtggtggtgctggtgtgttcggcaacgccacgggtggtcgtatcggtgccattgtcggctcgttcatcaacggcctgctgattaccttcctgccggccgcgctgatgaccgtgatgggcagcttcggtctggccaactccaccttcggtgacgccgacttctgctggttcggtacgattaccggcaacatggctcacctcggtcctgtcggtggcgccatctgcctgctgatctttgccgcggtgctcttcgccgccgcgtggatctggcaggtcaaggtcgtcaacaccggctggactccgggtgccaagcacgccgagtacatcgagcaggtgaaggccgaggagaaggccgccaaggccgctgctcgcgccgccaagaaggccgctgcggaagcgtgatactgttccgccgccgctgagcgattatgcgggagcgtgagggtgcgagtgccctcgcgctcccgtttttgtgcgtgggaaggcgtgagatcgcgggtggtttcgcggagtgcgcagtattgtgctcccgctagcgggagctgttgagcgcagcgagactgagggtggttctgtgcagtggctggtcagaccacccccagtcgctgcgcggcggcccccgccagcggggcgttgtattccttgcctcatgctgactggggacagcgtctgcgacaatggctcgtatgccattgcccaatcagcatcgtcatgcccgaaaagcacccgcgtccgcctcagccgccgccgcgtcgaccgtgcttgaggtggacggcctgcaattgcatgtgacgcgcaagcgcatcaagaacctctatctgcgtatcaagccgcctctgggaaccgtcgaggtgtcggcgccgatgcgcatgagccagcgtcagatcattggtttcgctcatgaacggcactcgtggatcgtgcaacagcagcggcgtatggccgaggcccgacggatgtcattgcggcaggccgagacgttgacgcccctccccagcgctcccgccggtgatggagggaatgccggtgtcgatggccgccggggcggcgatcagccgcagctccccatgttcgaccgttcggccatgtggaccgatgagcgcaaacatgccgccgcggccgcgatcgatgccgcgcttccggggctgttgcgcaagtgggcgcccatcgtcgggcgttcgccgagccatgtcaccttgcgggtcatgacgtcgcgctgggggtcatgcacgccgaaaaccgggcgtatccggctgaatcttcagcttggtctgatggagcctcgatttttggagtacgttctcgtccatgaaatgacccatctgtgggccaatggtcacggggctgattttcagcggcggatgagcgcttatctgccgagctggcgtgagctgcgccgtgaactcaacaagcgcgtactgctgtgaaacatatcgtgaaacatgctgccgacatgtcgcggcagcaaaacaaatgatggcggcggctcagcattgccactgaaccgtcgccatcattgatgtgcatcttttgcgtcagaccatgccggtgtgcatgggagcgggcattcacccgccatgcacgctgcctgctgtctgccgcgatctatcgcgtcacgccagatgcgaacgcatgaaccactggaacttctcaagctcctgcacgtggtcctggatgatgttggagctgatcacgtccagctcgtccagctcggcgatggccttgcggtcatcggcgatgaacgcgtcgtaatactcgatcagggcctcaaggtacttctcggtgccggcgcgaccgtcgacgtcgaacggcttccaggtgcggttgcgggtgatggcatcggcgcggccgtcaggcgttccgcccagcgtggcgatgcgttcggcggtctcatcggcctgcgcgagcactgcctcgacctcagggtcgagcatctcgtgcacggcgatgaagttcggcccggtcacgttccagtgagcgtgcttcaggaccagcgcggcctcctgctcctggctcagtcggttctgcagaatggcaatggccttctcggaggcggcttcgtccagtcccggcacaacgaatgcaagtgtcatattcgttccttccttctgggatatcagtcaccctccagtttatcgatgaagcctgcgcgatgtgtcagctgccagcatagttatcgctcacagtgagcgacgtaacagaaacgtaggctgatgatcatcagcggtacaggtcgggtggaatcagtgtgccacaccaggctgatttcgggccgtttttacgctggtgtggcacggactgggctgagagatgggacatgcggcggtgcgactgggcaaggcatgtgcagcgggggggggcaacacgaaacacggcagacggcgtgactggacgtagctgcacattcagcaggtacaatacggcaggtcaattcgcgtcagtcaacgcggtcagtcgccactcgccgtcatccgcgtcggtgccggcggacacactggagtacacagccggaccccgcggcgaaaaggagcgtgcagatatggtcgattcgcgtcgcgatgtggctggccaggccggccggagccccagcccatccgtgcaggctaccatgattggtctgatggcgattctgctgtggagtctgatgaccgggctggttcgcgtggtcgccgatgcgttcggcgcgacgctgggatcggcgttgatatacacctgcggcgcggtgctgctgctggtttttcgccggccggcaccgttgcgcaagtatccgcgaacgtatctgatcgtcggcggcctgctgttcgtgttctatgagtcgtcgatttccttgtcgatcgggctggcgtcttcggcggcctcgtcggtggaggtcagtctggtgaactacctgtggcctacaatgatggtgttgctggcggcggcattcgtaccgagcggcgagaagcgttcggcgcggaacgaggggataggacgggaacccgcagcgcccagcgacgcgcaggctcaagatgactcggtccagtgcggcacaaactgcagcgcaggcaagccgccccgccattctcgtggccgcgcggtgttcgggaacattttttcaagcatcgattttttgaacacgacgagcttgtcatacttacgctgatgaagggtgatgagatggtcaacgctctccagacaagctgaaattgcccgctgctcttcgagatttgctggcattgtggcttcgatatccgcaaacctgtcatatttcagagtttgggtatctttcgagtttccctgtgaatcgcacaggtatttatatagcatctcaggccgcttcagaagatagccaaaacaagtcgagtctaactcgatggtgggcctagcaactacgtaagctgggctaacgataccatcgtaatcacttgacccaacggccccctgccacattcgcatgctgttgtagacaacatctcccttgtgaaccactttgtaattcacaagactcgcacctggatttgtatccctatccgattctgatgcaggatatattcctttagctacactgacagatagaatctccattgacgatgagcgttcattgctttcgaagaatagctctcccaacttacgctgttcccaagcgggtgtaaccctgtcatgtcagttgtcctcaagtaaggcaaaaggctcccctgcgcatatgcgcaaaagagccttgcaaatcagcgggagccgttcgacgatattactcgacggtgttcttcggcacctcgatgccgttgccgaacttgacgtcgcgggcggcggccacgcgggacggcaggccgtagatgtcgatgaagccgttggaggacttctggtcgaagctgtcgccggagtcgtaggtggcgaggttgtagtcgtacagcgagctgtcggagcgacggccggtgacgacggcgcgaccgccgtgcagcaccatgcgaatctcgccggagacgtacttctgggtgtcctcgatgaaggcgttgagcgactgggtggcggggctgaaccactgcgcatcgtacaccagctcaccccagcgcttgtcgatgtcacgcttgatgcggtgctgttcgcgctccaggcagcagttctccagctcctggtgtgcggtaatcagagccacggcgcccggggcctcgtacagctcgcgggacttgatgccgaccagacgatcctcgatcaggtcgatacggccgatgccctgggcgccagcgcggcggttcatctcctcgatggcctgcagcggggtgacgtcgcggccgtcgatcttgacgggaatgccttccttgaactcgatgaccacttcgtcctcgacgggcgggaacgccgggtcgtcggtgtaggagtagcagtccttggtcgggccgttccacggatcctcaaggaagccggtctcgatggcgcgaccccacacgttctggtcgatggagtacggggacttctcggtctgggtaatcggcagcttgtgctccttggcgaacgcgatctcgacgtcacgggtcagcgacaggtcgcgaatcgggctgattgccctcagggtcgggtcgatggacgagatggaaacctcgaaacgcacctggtcgttacccttgccggtgcagccgtgagagatggtgtcggcgccgaactggtgggcggcgcgcacgaggtgcttggagatcagcggacgggaaatggcggagaccagcgggtacacgccctcgtacatggcgttggccttcagggccttcatgcagtactcgttggcgaactcgtttcgggcgtcgaccacatacgcctcgacggcaccgcaggcgagcgcacggttcttgatggtctccaggctttcgccgccctggccgacatcgagggacaccgcgacgacgtccttgccggtacgatccttgaggtacgggatggccacggaggtgtcaaggccaccggaatatgcgagtacgattcggttgttgtctgccatgggatgcctttctacaaaaacaaactgctgcaagtatatacgaatgtctgtatatttatgcaatcggtgtggcgaatactgaaacgggccccttcccgagcgattcagttcttcgacgcgagcgtcagcagccactgcgagcgctcgaaggcgatgtcgtcctcggcgcatatcaccatcaccgtgtcatcgcctgcgatggtgccgagcacgccgtcgatgggttgcttgtcgatgacgctcgccacatactgggccgcgcccgaaggcgtgtggatgacgaccaggttcttggccgacgcgaccgatgtgaccaagccgctgagcacgcgggacatctgctgctcggccttggacccgatgccgctgccgaccgactccctgagcggacggtcgccgatcgtataggcgatgctgccgttggacagtcgcgtcttcatcgcgttgatctcgtccagatctcggctgagcgtcgcctgcgtaacctcgatgccctcctgggagagcagatccgacagttgcgactgggacgtgacgatgtgcttgagcagcacctgttcgatggcgctcaatcgcgcggcacgtgtggccggccgctgcacgggaggtgtcgattcactcatttatgccctttccggtggtttgccgaacgtctgcgcaccctgcaagccacccgcatactacggcatcgagcattaggccagcagcgattcgtcgccccgctgctgcccgatcaaccaggtcaacagcgccttctgcgcatgcagacggttctcggcctcatcccacaccacggactgcgggccgtcgatcaccgacgcggtgacctccttgccgcggtatgccggcaggcagtgctggaacagcgcgtcgggcttggccagagccatgagctcatcgttcacctgataatcccagaacggcttggagcggatggcgtactcggcttcctctcccatcgacacccacgtgtcggtgaagatgcagtcggcgtcggcgaccgcctcccgcggatcggtggtgaccaggatggagccgccgttctcggcggcgatccgctccgcgtcggcgacgatggcgggatcgggaagatacccgaacggaccggcgatgcggacgttcatgcctgcggtggcaccgctcagcagatacgagttggccatgttgttggccgaatcgccgagataggcgatggtcttgcccggcaaagcatccacaccgccacggtgctgcgcgatggtgagcaggtcggcgagcacctgacaggggtggaactggtcggtcagcgcgttgacgaccgggcaggtggcgtatttcgccatctcttcgacgcggtcctgaccgaacgtgcgccagacgatgctgtaggccatgctggtgagcactcgcgcagtgtcggcgaccggctcgccgcggcccagctgggaaccggacttgtcgatgaccagcggatacccgccgagttccgccacgccgatggagaagctggaacgggtgcgggtggagggcttgtcgaacagcacggcgacggcctgggggccggcgaacggctgacggtagaagcggttctcgcggaatttcatgccgagttccagaatctgcttctgttcggcatggttgatgtcgtcgtcacgcagcatatggcgaagttgaccggccatgaggtgctccttctgtggttcgggatgggtgcggatgttgtatcggcttgggcgtgcggggcgggctggttgtcgcggcccgtcccgtaatcgtcgtggaggtcagtcgttgggcaggtcggcggggatcttcgcgaggatggacacggcttcgtcgatttcctgctcggagacgatcagcggcggtgccaggcgcagtgcgtcgggtgcgaccgcgttgacgatcaggccatgttccagggcccagttcatcgccgcatgcgagcagcggtgggacaggaggatggcgttgagcagaccgcggccgcgcacggaggtgaacagcgggttgccggatgccatgatgccctggcgcagttgctcgccgcgctcttcggcgttctcgaccagatgctcgttctcgatggtgtccagcgtggcgagagccgccgccgcgcccaaggggttgcccgcgaaggtggagccgtgggatcccggcgtgaacagcgcggacagcttgcctccgaatgagatcatgccgcccatggggaatcctccggcgacgcccttggcgaacgtcacgatgtcgggagtgatgccgcccgtcaggtcctcgcgctggaacgcgaaccacgagcctgtgcgaccgatgccggtctggacctcgtcgatgatgagcagggcgtggttgatgtcgcacaactcccgcaccttcttcacatatgcgacgtccagcggacgcacgccggcctcgccctgaatgagttcgaggatgaccgcggccacaggacccttgccgtactggccgagtccggtggcagagaacgcctcatacatcgcgatggggtcgcctgcacgcacgaattcgatgttcggcaccagcggctcgaacggcttgcgaatcacgggcttccacgtggcggacagagcgcccatggtacgtccgtggaatccgtgggtgagcgccaggatgcgcgccggcttgccgccgatgctcgggctcgcgcccggcagcgtgcgaccgtacagcttggcgagcttcagcgcagcctcattgccttcggcaccggagttgccgaagtagacgtgggagccttccggggccccggcgagctcaatcagtcgcgacgcgagcctgatctgcggctcggtcgcgaaatagttgctcacgtgggcgcatttcgcggcctgctcggacaccgccttcacccatgcggggtgcgcgtagcccagcgaattgacggcgatgcccgcgaggaagtcaaggtattcgttgccgtccacgtcccatatgcgcacgccttcgccgtggtccatcacgcgcagcggcgtgccgaacacgttcatgtggacctggctgtactgtcccagccattgcgagtcggtggggccgagcgtttccttagtaggcataggaactcctcatttcgatgccatcatcgggcacaaccatggtgccgatgccggcggtggtgaaaatctcattcaggatggaatgcggcttgcggccgtcgatgatgtgcgcctgcggcacgccgccatcgagggcgcggacgcaggcctccatcttcgggcgcatcccggattcgaggtcgggaagcatgtcacgcaggttctccacaccgatgcggccgatcagcgagttcttgtcgggccaatcggcgtacaggccgtcgacgtcggtcaggatgatcagcttcctggcgccgagtgccgcggccagcgcggcggcggccgaatcagcgttgacgttcagcacttccgtggcgtcgtcctcatcgggggcgaccgaggagacgacggggatgcggccggccgagatcaggtcctccaccgcggaggcgtcgacgctcaccacgtcacccaccagcccgatgtcggtaggcttgccgtcgatgatgggtttgcgctgcatggcggagaacagggcgccgtcctcaccggacagtcccacggcgaacggcccatgcgcgttgatcagtccgaccagttccctggacaccttgccggtgagcaccatgcgcaccacgtccatggcctccggagtggtgacgcgcaagccgcccttgaactccgacttgatgcccaatgccttgagcatgtgcgagatctgcgggccgccgccatggacgacgaccggatgcaggcccacctgccgcagaaacaccatgtcttcggcgaagcaacgcttgagatgctcgtcgaccatggcgttgccgccgtatttcaccacgatgcgctgcccggcgaactcctccagccacggcagcgcatcgatcagcacctccgctttctggtcggcgcgcaggtcggtgtgcacgtcgaaatggaaccctggtcccttcagttcagtagccatattctcctctatcgcatcccgcttctccggccggcatgtgccggggaggaaccgggagactagctttcgtaatcggcattgatatgaacgtactcgtgggtgaggtcatcggtccacaccgtggcctgttcgtcaccggcgttgagatcgatgtcgatgtgcacctcgcggggggtcatgtcgacttcggagcggtcgcgtcccgcgcccccattctcgcagatcctcacgccgttgacgtccacggtgaccttctgcgaatcgtagggcgcctcttcgacgggcacggtgcccagcgaggatacgatgcgtccccagttcgggtcgttgcccgcaatggcgcatttgagcaggttcgaggccgcgaccgcgcgggcgcaggccagggcggcgctctccgtggtggcgccggtgacggtgatgcgcacgtcgtggctcgctccctcgccgtcgccgatgatctgccgggccagcgatgcgcatgccttggcgaccagggcgttgaactcgtccggatcgggctcgacgccggacgcgccggatgcgagcagcagcaccgtgtccgacgccgacgccaacaaggccaaggccgtgcgccaggccgtcgccaacctcatcgaccgcgatgagctgagcaagaaggtctacaagggcacctacaccccgatgtactccttcatccccgacggactgtccggccatgacgacacgctgaaggccgcctatggcgacggtgagggcaagcccgacgccgccaaggccaagaaggtgctggaggacgccggcgtttcgaccccggtcgacctcaagctccagtacaacggcgaccactacggctcctcatccgccgacgagtacgccgccatcaagtcccagctggaggccgacggcctgttcaaggtcgacctgcagcagaccgaatggacgcagtacaacaaggaacgcgtcgtcaccgaagactccgacggctcgtacccggtctaccagctcggctggttcccggactactccgatccggacaactacctgtccccgttcttccgcgacggcaacttcgtcaacaacggctactccaacaaggaagtcaacgatctgatcgtcaagcaggcaggcgagaaggacgccaccaagcgtgaggagatcctcaagcaggtccaggccctggagaccgaggacctgtccaccatcccgctgctgcagggtgcccaggtggccgtcaccggaacgaacatcaagggtgtcgtgctcgacgcctcgttccgcttccgctacgcatcagtgaccaagtcctgatccagtcccggctcccgccgacgcggggcgacgcccgtgaagccggtcatggatggtgcagttgacgccaagccatccatgaccgccgcgggcgatcccacacgccgcgggagcatcatccgtattcgatcgtttttccccagaaggagcatcgcgtgtccgaaagcgccacggcgtcggcacctgcgaagacgcagccgaaagccaagaaaaaccgtttgtccagtgggtttttccgtttcgtattgaccagattcctgctgatcatccccactgtattcattctcgtcaccatcgtgtttttcgtgatgcgtgccaccggcgacccgatttccgccgccatgggcggacgcctgactcccgaagagctgcaacgccgtatccacgccgccggctatgaccgtccgctggtcgtgcagtacctcgactatcttggcggactgctgcgcggcgatctgggcaccacgctcaccgacaaccagccggtcaccaccatcctgacccgctacggggcggccacgttcgagctcgcgttcctgagcctgatcgtcgctctgatcgtcggcatcggactgggccgtctcgccgccaggcgccgcgaccacgccgccgatgcgggcatccgcgtgttcgccatcctgtgctatgcgacgccggtgttcttcctgggactgatgctcaagctcgtcttcgcggtgtggctcaacgtgctgcccccatccggtcgttccagcttcgccagcgacatgcaattccagaggctggtgtcgcccacgggcttctacatcatcgacgccttccagctgggtgacatgagcgtgctggtcgatgtgctgcgtcacgcggtgctacccgccctcgcgctgggtctgctgaccgcaggcgtgttcatccgtctggtgcgcaccaacgtcatctccacgtacacgtccggctacgtcgaggcggcgcgctcccgcggcgtgtcggagggccgtctgctgtccaagcacgcctggcgccccgcaatgatcccgatcatcacggtcatgggcatgcagatcgcgctgatgctcgccggcgcggtgctgaccgagaccaccttcgagtggaagggcctgggattcatgctgtcccagtacctcaagcagcgtgacttcgtcgccgtgcagggcatcgtgatcctaatcgccatcatcgtcgccgtggtcaacttcatcgttgacgtgatcagcgcgctcatcgatccgagagtgaggtactgacatgaccgaaagcactgcaaccaaagtcggcgtgcccggcgataagcggctcggcgacctcaaggtcaacaagccggtgccatggtacggcaagctgccggtggtgcgcgacctgaagatcgcggtcggctggcagaaagccatgctggtcacgggccttgtcatcaccggcgtgttcctgctcgtggcggtcttcgccccgctgattgcgccttacggatactcgcagatcaaggacgcggacggcgtgtcgttcccgacgcaggccgccccctcgtccaagcacatctggggcaccaccgtcggcggattcgacgtgttcagccgcacggtgtggggagcgaggaccgcggtcatcgccatcatcgtcgccgtgctgctgtcgatcttcgccggcgtgctgctcggcctcatctccggatatttcggcggatgggtcgaccgcgtgctggtcgtgatcgccgacgccatctactcgttcccgtcgctgctgctcgccatcctgatggccatcatgatctccggcggccagtccggcctgtggagcggcatcctggcatcaggcatctccatcaccgtggtgtacatcccgcagtacttccgcaccatccgcgccgaagtggtgcgcatcaaagggtcggcctacgtcgagtcggcgaaggtcgtgggcgcctccacatggcgcatcatgaccaagcacctgctgaagaactcgacgcgcacgctgcccgtcatccttacgctcaactcgtccgaggcgattctgacgctcgccggactgggcttcctcggcttcggcatcgagccgacggccgcggccgaatgggggtatgacctgaaccgttccgtcgccgacgttacggccggcatctggtggacggccgtgttccccggcatcgccatcgtgctgatcgtgctgggcatcacattggtgggcgaatcgctcaacgatctggcggatccgcgtcttcgtgcccgcaagtccgccggcgaggtcatcggatccatcgaagacacgtccgtcgaccccagtgagaagccgagcgccgacaacgaggtgatcgcggagctcaaatccgaaggcaagccccaggtcagtgtggagaaccctgccatcgcgcaggtgatggaaaaggagaccgaccatgagtgactcgaccaacgtcaaggacacgtccggcaatctagccgaaatcgagaacctcagcgtctcgttcatgaccgatgcgggctccatcaaggccatcgacaaggtgaacttcaccatcccgcgcaagaccgtggtcggcgtggtcggcgaatccggctccggcaagtcggtgaccgcccgttcgatcatcaagctgctgcccgagaccgccaccacgtccggtgcgatctacttgtcgaaccgtgccgactccgaacgtcttgacgtgctgagcctgtccggtgaggatctgcgccgcatgcgcggctccgaagcggccatggtgttccaggagcccaactcggtgctcaacccggtgtacaccatcggctggcagatcgaggagggcctgcgtgcccacggcatgaaagacaagaaggagcgccgggcgaaggccatcgacatcctcaagaaggtcggcatccccgaggccgagacccgcatcgactactatccccaccagttctccggcggccagaagcagcgcatcgtcatcgcgatggcgctggtgctcaaccccgggctgatcctcgccgacgagccgaccaccgcgctcgacgtgaccgtgcaggccgaaatcctcgacctgctgcgtctcgcccgcgacgagttcgacgcctccgtgctgatcatcacgcacaacatgggcgtcatcgccgacatcgccgaccaggtggtcgtgatgtaccgcggccatgtcgtcgagcagggcgatgtggaaagcatcttctaccatcccagccatccctacacccagcgcctgctggcggcggtgccgcgcatcggccagaagctggtcgtgcgcgatgtcggcggcaagccgatcgaccgcacgtcggattggcatgacgagccactggccgtcgaggcgaagggactgacgatcacgtaccccgggcacctgatgcagcccgacttcgtggccgtagacggcatcgacttcgcgatccaccgttccgaagtgctcggtctggtgggggagtccggttccgggaaatccaccaccggccgcgcgatagccggcctgcagaaagtgagcggaggctcgctcaatgtgctcggcgtcgagatgaacggcgtcagggagcgtgatttcaagcccaagcgtgccgacatcggattcgtgttccaggatccgggcagctcgttcaacccgctgatgaccatcgcggagaacgtcgccgaaccgctcatcgtgcaccgcaagtactcgtcggtcgctgacgcgaaggagtacgtgggcgacctgctggagatggtgcagctgccgagggcgtacatgagccgattcccgcacgagctgtcgggtggccagcggcaacgcgcctcgctggcacgcgcgctggcgctcaagccgtcgctgctgatcgccgacgagccgacgagcgcgctcgacgtgtcggtgcaggccaaggtccttgaactgttcaagaagctgcaggttgagatcggattcgcctgcctgttcatcacccacgatctggccgtggtggacatgctcgccgaccgtatcatggtcatgcacaagggacgcatcgtcgagcacggcgacgccgacgacatcatgcagcggccgagcaaccagtacacgaagaaactgctcgcctcgctgccggttcccgacccgcgcgaacagcagaagcaccgcgcccacctgcacgagctcctggccgccgaaaacgcggcctagccgctagccccagcaggattaccggttccgccccgctggcgggaggacacatatcgactccacgcgaacgtcgtatgggcgggcgtggtgcgactagtatagggaaggaattgtcagtcggttttcgaacggcacaggttttcgaacagtacgaaggagcgtcacacgatgagcgaagtcatcaccgagaaggacaaggaatacgaggcccgcgaggaggcgaacgcccccggcgcggatcaggcgatgagcgaccgtgtgaacaaccgttcgctgcgtcccaattccagcgccttcattgatttcatgaagaccggttgggacgccagcgaaccggagatcgagccgctcgaatcctcgaagttcacgccggcgcgactcgccgcactgggcaaggcgttccccggcgagcgtctggtgattccggcaggcagtcccaaggtgcgcaacaacgactgcgattacatgttccgcccggacaccaccttcgcgtactacaccggcctcggccaggattacgaggcgggtgccgtgctggtgctcaaccctctcgacccggattcgcccgaggcgaaggccggcaagacgcatgaggccgagctgttcgtcgccccgcgcgccgacaccgccacgcaggacttcttcatgaacgcccattacggcgaatactgggtgggccctcgcgccggtctcaaggaaatgaccgcgatgaccggcatcgagacgcacgacatcgcccagctggctgacgcgctgtccaaggacgtcggggccgaggccggtgcggtgcgcgtgcgcgtgatcagcgacgccgacccgcaggtcacgtcactggtcgaatcgatccgtgaggccaacggctataccgacccggacaagaacaacgcagccgacgacaagctgcacgagttcgccgccgaagcccgcatggtcaaggacgagtacgagatcggagagatgcgcaaggctgtccaggccaccaagcacggcttcgaccacatccttgcgaagcttcccgaagcgctcgacaagccgcgctccgagcgcatcctcgaaggcgcgttcaacgcggtggcccgcgaggagggcaacgcgctgggctacgatacgatcatcgcctccggcgagcacgcgccgattctgcactggatgcgcaacacgggcgtcgtgcgcaagggcgacatgctgctcatcgatgccggtgtggaggtcaacagcctgtacacggccgacatcacccgcacgttcccgaccaacggcaagttcaccgatttccagcgccggctctaccaggcggtgctggactcccagcaggccggcttcgaggccgccaagccgggcgccacgtactccgacatccatcacgcctgcatgcgcgtgatcgtgcagcgcctgcacgactgggggctgctgccggtggacgtcgaggaatcgctgtcgcccgaaggccagcagcaccgccgttggctcgcctgcggcgtggcgcaccacctcgggcttgatgtgcacgattgcgcacaggcccgctacgagtcgtaccaaggcgcgaagattcgggaacattttttcaagcatcgattttttgaacacgacgagcttgtcatacttacgctgatgaagggtgatgaggtcgtcgagagatcgcaatgtcatcccgatttgctgctgttccgtttttgaaggaagcatcaattgataatctgcgtattcctgcgcattgacaccaggctgcccggaccgctgcgaggttatggcaacatacttcttgtatgcatcggtcaaggttgcctgataggcgaattcggggtcagcgccttcgccgattcgggcacggataaggaatccagcaaagtagaccattccatcgaattgcctgtacagatatgtttttcctacactcgcgcctgtgcgagcaaagagcagatcgccctctttcagtaaataatctgcactcattgcaaggtcagctaacggcgtcgtaagatcgcttttcgagaactcatgggtttcgtcatcaatgtcggtgatacgcagatatttattttggccatcgtattctgttgcagcagcgttcaagccgtaatcaaatgaagacgcaacgtctcccaacttacgctgttcccaagggtcagtaaaaccagcgaaacgaatcgcaggaactttcgcctgttcagtcatcattcacctcccaacagggtcttcagctcggcaataccggccatgtcgaactcattgccggttagttgaccaagcatattgccaagttctgcctcagcctgttcgatctgttcgcacacatcggagtatgtggtcgaatacttgtcgttcagcgcattcaccgctgcaatcaactcatcaacagccgtctgagggagctcctcaagcttgcgctgcaatggttccacccacttggcagcaagcaagtcatcagcatgttcatcgctcagtccttcaataacggtccgggtcttttcatcaagcgctgaacggagattcttaacgttctttttgacttcacgctcttcatcaaacaaccgctgtgcactcacaagagcacggtcaaagtcagtctcgggattcttcccaatcgatttcactgctttcttcaattcagcggcaacgaaagaatctccatcctcgctgacggcatcagtcgaactcttgtcatcctcatccagattttcaagaatgtcagcgatttcgccgccaatcttactcagccgagattcaaatgtggcaatttccgcaagatcagaggtaagatatttcccctgtacgagatcgaacggcagaatatgcccgacccagccgtccggcacttcgacatccttaccgcctttcttcttgacgaccatattggcatcgactttgcgaacggcgtcatgcccctcggcctgtatggtttcaaggtcgatggagatagtcttttgccaactatcgtcaagcacctgatacgccgcataggcgtctacgagagggataccagccaaacgacgcagcagatcatttgccagagtctcctcttcggcggcaatgctcacattggcggcattacccaccaattcaccgcgtatataagccggataatcgatgaacgcctcacgataacgctggatatatgccttcacatctgagtcggcattcaccgcctcacgaacgtcttgcacggcgagcttggccgaatggccgttctcctccgcgaaaaggcaccggcgtagtccggggaacacgttccaatatttgctgagtgcatcgatgtcccgcttaggaatgccgccgaacatagtggaatacacatcccagctctcggcattgtcggaggaatccacgtagcgaggaatattgaggttatagtcgttctgccgaatctcatcgatacccaccaagcggctgaacttatcgacgtcacgattccctgtcaccgcatccacgatgcgtttgatatcgctcgcacgcagcttgttgttcttgccttccttggtgaagtatttggaagcgtccacgacgagcacatgatcgtcgtcgcgatgtttgcgcagcaccatcacgatggtggggatgccggtgccgaagaagatgttcgcgggcaagccgatgatggcctgaatgtggtggttctccaccagattccggcgaatagtgccttcctcaccaccacggaacagcacgccatggggcaatacgatggtcatgatgccgtcgtcgcgcagatggtagaggtcatgcagcaggaaggcgtagtccgccttggacttgggcgcgatgccgtattcgaagcggatatcctcgccggcctccggcggttcccaattctgggagtagggaggattcgagaccacagcgtccacgaacaacggctcataggtctcatccttggtctcgtcggtgtcgaaccacggccagtcgcttttcagtgtgtctccgttgcgggccacgatgttgtccggcaggatgccgcgcatgacaaggttcatgcgcgtgaggttgtaggtgttctccttgagttcctgcgcgtaatacctgatgtcattcgggttgccgttgcgacgggccaccgcctggccgatgtggatgagcaacgagcccgaaccgcttgtggggtcatagatgttgatttcctcacggccggcgagatgccaggccacgatttcgctcatgagctgtgagacctcgctcggcgtgtagaactcgccggccttcttgcccgcgttggaggcgaaattgctgatcaggtattcatagatgaagccgagggtgtcgtagtcctgccggctgtccatcggaatgtccttgatgaggtagatgaggtcacgtgcggccttgctgcggcttttctcatcggtgccgagtttggacaggccggtctgcaaggtgtcgaagatgcccgcgaacacgcgcttgcgggcagggtcgatgttgcggtcgaacgcagaaagcgcgtcgcgcacattggcgatggcgaaatcccccttcttcgccacccatgtggagaacaggttatcgtaggagatgaagtagccgcacagatcgcgcacatactgcgcggtctcggtatcatcctcccgcaattcttcgaggtcttcgtcccccatgccatcagcatgcagacgagtgacttcagtctcggaaaggaacttgtagaagatgaagccgaggatgtaatccttgtattcgttggcttcgatcttcgagcgcattttgttggccgactcccagatcttggcggcgagctgctgcttattcattcatatgctccttgcttctgtacacataatcaagggtctgcccctgctcattgacccattcgatccacccgttttggctgccgccgagaacgaatacagcggcggaggagggactggacagctcgacatcgtccgcaagaatcactttgcctgtctgcgcggcgaaaagctgccgtcgagctgccacggctccttgatttttgatcaccgcatgaccaaggtccacctcggagcccgaaagaaccgtgaaacggccggtatcccggttgtatcgtccagtcgcacgcacgccattcttcttggtgtggaacacggtattcactgcaaccggcgttgtctccttgcggtcgagatcatatccgagcacgcgcatgcggaaaagaatgctgccgtgcaggtcctccacccgctgctctttgtatgggttcatgcgaggagcgggagtattcccgttatcggtctcatatgagccgtgttcacgcacgtaatcgatggccttcgcctcaagcgaatccagaacatcacggtcgatattgacatcgttatcgaggaacatgatggctttgttccagaactcctttttggtcttgtgcgcatcaagtctgacaagtcccctcgtggtttgccccgcgtacacacgactcagcacaccatgatcctcatcaagcaggtaatacacaccgcggtctggcagatcgggaagacacttcgcctcgcccaacatgtctctgggcaccacgacagtgacaagcgattccccgtccacccggcaaatacggataccatccggattgttgtcaattatttgtatggtcatggcggtgagcgcaatcaattacttgccgcccttcgccaactcattgatcatgcatgtccttacgaacgccgagaagctcattcctctcagagacgcggcttctttggcggaatcccgcaggttagcgggaatgcgcatggtaactggcaccacgtcaccgtctactagatatgagcgtatctctgtttcaccagcctcatgttcaatcaaatcggagtacgtcatcgcatcccacgctttcaaaccgcagtataaatgcattaattatacacccgcttgggaacagcgtaagttctcggatatcgttgatgtttgcagcggtaaggattacaagcacctcgaagaaggccccattcccgtctatgggaccggcggttttatgacgagcgttgacgaggctttgtcttacgaccgcgatgctgttggtatcggcaggaagggaacgatcgacaaaccgtatttgctaaaggctccattttggacggttgacacgctgttttatgcgattccaaaatcggacatggaccttgaattcgttcattgctcgtttttgaatgttgattggaaatccaaggatgaatcgactgggttgcccagtttatctaaagaagcaattaacgaaaccatcgcacttgttccaagttttaatgagcagagccggcttggcgagttttttagcgacctcgattccctcatcacccttcatcagcgtaagcggcagtggttgaaatggttagatgagggtggagagggcacgcatcacgatatcgacatccttgttttcaagttcgcggatgacatgaagataagtgtcctgtgtggtgttcatgcttgcatgaccaagtcgcttggacacactggcaatcgatacgccggcaaacaacaacagcgaggcatgggtgtgccttaacccatgaatcgaaatcacgggaacgttggcccgttcgcaatgcctggcgaggatgttattcgcggtggagttatacaccttgccattcacgaaaatggggtcgcccgcaggcaaatctttcaggagcgttgagagctgcatgataagctgccaatcgagctgcacctttcgtacggaggatgcgttcttggtggggacgaatcctccgccgttcttgtaatcccacgttttactgaccgaaagggtctgatgcacgaaatcaaagtcgtcgggtgtgagtcccaaagcttccgagaaccgtaacccggttttcgccaccaacagtatcagccaatcccagcttggtcccttgccgagttcgagatccgcaaggaccgcatgaagctcgaactgattgagatacttcgttttctttgagcatggcggcttgcccttgatgattgccttacgagtcgggtcgcgctgaatcagcccttcgtcgaccgcgtcaagaatggctcctttcaattgatgatggaaatccatcgtcgtctggcgctcgtgatgttcggcgtagccgttgatgagcttctgatagttcacgcgatccatgtcggcgagtttgagatcgggaatgagccgacccaaccatgcctgcgtgagccggtatttcttcatggtcacttcacgaattgcaccttccttgtatacgctgatccattgctcgtagtaatcgcagaacaacgtttcggcgttggtgttgccttcggtcatacggtcttctctttctggttgatatgcgcttacgccgatgccggatatatcaccagctaaccatatgaatgagcgcacgcggatgatgcggctttcgcgcttacgctgatgaagggtgatgaggtcgtcgagcttagcaaagaattggccaatttctttttgctctctaccgtctgggatagtgacttctgcgctcagtaagtccttgttgtaaagtcgcttaatcgtgctgccctctaagccccattcaattttggagtataaaggcttgagaaacgcatcgttcaatctatgctcatgttcgagccaaacaatgtttgagtcttgaaaatatgccttctcaccttggtactcaacaatccgcccgatacttcctgcagccgatatcaataacgtacccggggttggatacggataggtacgcttgtagtcttcaaatagctcattggagatgaaggcatctggatccgcaccaaaagttccaatcttaaagaacggaacatcgccctgctccgaggtttgctctttgtagatgcgcttgcacatggcaacagaaccaaattcccccaacttacgctgttcccaagggtcagtaaaaccagcgaaacgaatctcgggtacggactcgccatccttcgggaacattttttcaagcatcgattttttgaacacgacgagcttgtcatacttacgctgatgaagggtgatgagcaacgcgggacggttcatgtttttcatgcaggcggaggtcatcgccatcgccacggatctggccgaggtgatcggcggcgctatcgcccttaatctgctgtttggcttgccgctgttcgttggcggcctggtgatcggcgcggcctccacggtgatgctgtggttccagggcggcaggacgcagaccacgttcgaacggatcatcatcgtgatgctgctggtcatcaccttcgggttcatcgcgggcctgttcgtggccccgccggatcccgcagcggtggttcggggcctgatcccgcgcttccaaggcaccgattcggtgctgatggccgcctcgattctgggagccaccgtgatgccgcatgccatctacctgcattccacgttggtcaacgaccattactacacgcacagcgataagccgtcgatcgccatgcagctcaaaggttcgaagatcgatgtgacgtgggcgctgctgctggccggcacggtgaatctggcgatgctggtgcttgccgcgaactcgttgcacggcatgtccggcacggattccatcgacggcgcgcaacgggcgatcacgcaggtgcttggcccggtgatcggcacgatattctccatcggcctgctggcctcgtcgttgagttccacgtcggtcggcacgtatgccggttccgagatcatgcgtggtcttctgcatgtcaacgtcccgatgtgggcgtgccgcgtggtcacgctggtgcccgcgctaatcgtgctgtggttcgccaaagaccccactcaggcgctggtcatcggccaggtggtgctgtccatcggcattccgttcgccgtgattccgctgatgcgttatacgcacaccaaggagcttatgggcgaatgggtcgacgggacggtcaaacacgtgatcttcatgatcgtggtggcgttgatcgtggcgctgaacgtgctgctgatcgtgcttacgattttcgggcgtgcgtgacgtggacgactgacgccgagactcgccgatttcccgcggattccgctccgagatgcgggattagggatggcatatgacgaaagcgttcctaagtgcgcgccgaaacgacgaccgtgcgcacttagcgacgcaaaccgggccatttgcgtccctaagtgcgcggacttgtcatttcggcgcgcacttagagacgctttcgcgctctgatggctctggatcgttcggagccgtgatgtctggcaattggattccggttaccggtgacgttcctacgcaaattggcgactattgtcatcgtccggtgacaatagtcgccaatttgctgcgattaccggtgcgagaccgtgcggattctcgcgatggcccgctgcgccacgtcccgcgaggatccggcaccggctcctttgacgccgaacagcacgatgagcacctgtatgaacacgatgaacgcgctgactcgcagcgtccactgcgtgccgaagatgctcgcggcgattgcgtcgcctccatgcagttgaatcagcgtctccatcaggatgaccagcacgggggctccgatcgcacccgcgatctgccggaccgtgttggtgaccgccgacccggctgacacctccgtcgggtcgaggcagttgagcgaccaagtggtgatgggcatgatgatgaaacccatgccgatctggcgcacgaactgccatatcgatacccaccagatccacgtgttgctgtcgatcagactcatcatgatggtgccgaacagcagaaccagcgtgccactgagcgccaccggcctcgccccgagccggtcgagcagcttgccgccgaagaactgcgagatgcacatgccgaatgcgccgggcatcatgaccagtccgctgatagtcgccgaatagccgcggtcgttctggatatacagcggcatgatcaccatgatcgaactgaatgcgaagaagctgagcgcggcgcagatcgtcccgacggtgaaactgcggttgcgcagcacgccaaggtcgagcagcggcggttcgggagtggtgcgttgcgcggtgtccgactcgtccacggattgccggacggccaccgtatacgccttcgcgcggcgcacctgccgcaccacgaaccacacgatgccgcacagtccgacaagcatcgcgccccacaccatcggattcgacggcgcgtacgattcgatgtttgtgaacccgaacatcaggccgccgaagccgagcaccgacatggccacagagaagaaatcggccttggcatggtcgtcggtcgtcccgaagttacgcagcccgaagatggccagcagcaggcagaacacaccgatcatcgtgagcgtgaagaaaatcgaacgccagccgaaactgtcggtctggaagccgccgaaagtcggccccagcgcgggggccacgctcatggccatgccgaccgcgcccatggccatgccacggcgggataacgggtagatcgagaagacggtgatctgcagcaccggccacatcacgcccgtgccgacggcctcaagcagtcggccggccagcaccaccagaaacgtcgggccgacccatgccagcagcgatcccacagcgaacacggtcatcgagacgatgacgatttgccgggtggtgaagcggcgcgtcaggaacgcggtgagcggcaccatcacgcccatgaccagctggaaaatcgacgtgagccattgcccggtggtcacggagatgccgaattccgatacgatggtcggcagcgcggcggacagctgcagctgcgtgaagttgccgacgaacgtgatgaacgtcaagatggcaagcgaagcgagggccacgcgcgaaagatggccgttcacatagctttcgtcgctggagagcggcgtggacagcgtggatacgcgtttaccgccggctgtgccgccgcgctttgcgagggttttcttcgggttcttgccgttcgtgctggtttccgtgctgctgtcgttattgtcgctgcgattggtcattgtgccgtattctcctccgttccgcctcatgcgcctgtgtatgcgtcatccctgtttcgctgcgtagggattgttgtatatgcatcatttctgccgaccaatacactactcctacaggtgggcaacccgggtggaagcgtggggagaaggttgggggagaagggcgcggaggaaaaatgtagggaaggccacggaggggtggaatggaagaacacagagaggagggcgcaaggaatcggaagttgagtagggggagacgaaaatatgagcactcagatattggcggcgcggagatgcgacggtgcggaagtcgcgccgccgcatctccgtcagtacgagccggtgccgcgcacgacggccaccacggtcttgagcaggatcgcgatgtcgccggtcagcgaccagttctggatgtacgacacgtcgacgaattcggactgctcctgcgtcaggttgctgcgtccggacacctgccacggaccggtgatgccgggcttcaccagcaatctggccgaatacagcgtgccgtagcgcgccacttcctccggcagcggcggacgcgggccgacgaggctcatgtcgcctttgagcacattgaagaactgcggaatctcatctatcgaggtcttgcggatgaaatggccgattcgcgtgactcgcgggtcgttcttgagcttgaagacgaaccggtcctccataccgtattcctcggcgagctgcttcttgatggcttcggcgttgacgttcatggaacggaacttgtacatcgtaaacggcttgccgtagatgcctatgcgctgctgccggaagaagacggggccgccatcttcgtgcttgatcagcagcgcgacgaccagcatgatcggcgaactgatgatgatcgcgatgagagagaagaagatgtcgctcaggcgcttgaatattctcgtgatggtggagtactgcgtgagctgcgcggtgagcaccggcatcaggggattgctgcggaagtggagctgcgcggcgctcaggtcggccagcgacgcgggctgcgcgagctcgatgcccatggattccatggcgagcgatagggcacgcatggtttccgaatcgcgggtgagtacgtcggcgatgagcacggtttgcgctttcaggtatttcgcggtgatcggcagatgggagtccagcggcagcgcgatcagttcggcctcgtcgctgtcgtctgcggtgaaggggaccgagaggagtcgtcttggtgcgtttggcgtgttgcctgcgctcgccttgacggggcagaccgcgatggggatgtatccgagcgacttgctgttgcgcagctgcacgatggtgtcgtgaatgctctcaggcgagccgatgatgatcgtcggatatccgaagcccttgccttcacgccggtggcggtgcaggaaccggcgtgcgagccaccgttcgatgatggtgagcatcatcgttggtgtcatgacaatcgtgcaacagctgattacacgcagaggtgaatgatgaatacaagacgtgtcaccgtgggagtggtcgttcagtacatagtgttgacgctcgtgttcattctgctggcgggcccgctggtatgggaattgtcgctggcgatcaaggggccgaacgacaacgtgtactccctgccgccatacctgtttccgaaggatttcacgctgaacaatttcgtcgaggtgttcaggcgtctgccattgctccggtatttcggcaatacgctgattgtcgtggcaggtaatgttctgggcaacgtcgtcggatgtacgctggccgggtacgccttcgggtgcctgagattcagatggcgcaacatcggctacatgctgtttgtcctggccatcatcatgccgacggagggcattctgatctcgacgttcctgctggtcaagtccatgggattgacgaatagtctgctgggcttgattttgcctggcctgatcggccccctgaacgtgctcctgatgacgaacgcattccgttccgtgccgcaggagttgatcgaggcggccaaggttgatggcgccaacatgtggcagaggttcttccacatagctgctccgcaggtaaagggcacgatgaccgtgatcggcatcctctcgttcgtggggagctacaatgacttcctctggccgctggtcgtgctcagcgacgacaggaagtacacgctcacactcggtctgaaccggcttcagggaacgttctacacggatccgcgactggtggctgctggtgcgatcatctcgctcgtgcccatagtcatattcttcgcgctgttccagaagaatctgttcctcggattgcaggaaggcggtctcaagggatgattttgtttgcgtcacgtttgatgttgatgcgggggtagtgacatgcgcatactgtacatgccattggacgagaggccctgcaacaggaagtttcccatgatgctggcctccggctgcggcgtcgaactgatcacgccgccacagtcgctgttgccggacaagaaaaggccgggtgattgcgctgcgttgcatgagttcctgttggaccaggccaagctgtgcaacgcggccgtcatagcgatcgacctgctggtgtacggaggcttgataccgtcacggttgcaccacttgggtgccgatgaggttctggagcgtctggatgtgattcgtgagctacgtctgcgtaatccgaccctccgcatctatgtcgcctccactatcatgcgtgcaccctcgtatgattccagcgaggaggagcctgattactatgcgcggtacggacgaatgctgtttcgccgggcatggttgacggatcggaagcagcgtgagggactcgacgagtcggagcaggatgagcttgcgaacattgctgttccgcaatccgtgattgacgactacgagcatcgtcggagcgtgaatctagccgttaaccaggcttgtcttcgtctggttgaacagggggcggtcgattatctgatccttccccaggacgattcgagcccgtacgggtacaccgcgcgtgcccagcgttcgttgcagcggagcatatgcgcgcagcatctgatgcgcaaggtcgcaatgtatccgggttcggatgaggtcgggcagacactcgtgtcgcgtgccatctgcgatgtcatggaacggcatcctgtgattcgagcacgatactcgggggaatacggtgccggaatcgtaccctcgtacgaggatcgtcccctgcgagagaccgtgctgagacacattcgggctgccggtgctagggtgtgggacggctgttctggagcagacatcgaattgctggtcaatgtgccgggcagacgcatgcaggaagcgtctcaggcaatcgacggtcgtgacgtcacgtatgactcctacaggaatctgccggcgttcatcgacagcggcctcgtcgtcgttagtcagcgatcgggcggtcatcagcgacgacagctgctcggccttgaagcacagccgcggcaccgacaggcgctcgcacagttcgttgacatagaacatcaccggcaccgcgcgcgacggcttgcgcagatcgatcaggcgcagcaacccgtcggccgccaccgtcaccgtggcgaatcgctgcgcgatggcttcgacatcggcactgggcgcagcattcgcaggcgcggcggcaccggcggcggcaccaccggcggcaccatcgcccacgccgatggcctgttcgattgcctccaacgcttcggcgatggcgtgcacggtgtcatcatcccaatcgacgcccaactggccggcgcctctcatgatcagcctcgtgtcgccggtttcggagtagtcgcccatctcgtcgtaagcgtcattcgcggcgagcaacgcatcgacgattcgctgcggacgaccgggaatctcatccgcaccctcatacacgaactccgcatcggggaccgtcacgtcgtcgccggtcatgacccgtgcggccatgcgggtcatccgcacctgcaggttctcaccgtatttcgtgtcattgtccatctgcttggcgtcggtcagcggccacagttcgatcagtccggcgccgacggccgccgcatcgcgtaccgcgggattcatcgacacatgggcgatcgccgtcgcgtcaagttggaatgccatatcgctccttcgctttcattgtccgccgacgcgcggaaccttccgccgtgccgggtgccaggtgccggtcgccggcaccgcgggccaccgcgtcacagcaccgccggccactcgccgcctgccgttacgcggcgtcgtcacaagtgaccgctacgcggccgccgtcagtcccggcccgcgccgcatgcgcaccttttcgcgggcgagcccgcagccgtcctctctgtgtattgtacggccggcgcacgccgcactcactcgacttgcgccgcagggtcggcatatgtgatggacatcaccttgcccgtatcgctgtcgtaggtgatcgaggtgatcgacgcgagcgcggtcttgcgtaggaacatccaatgctcggggtggccggtctccagcaggtgccggtagctccagatcggtgactcgtggctgacgacgatgatttgccgtccggcatactcgcggatcttctcgttcgcgaacgcgcccacgcgttcggcgatgtgccggtacgactcgccccagctcggcttccacaggttgagcacgagcttccagttgccgtcgcgccacagcgcgcccttgccatgtccgatgcgcttgccgcgaaactcgttgcccgcttcgatcacacgcgggtcggtgatgagttccagcggctcctccccacgcccggcgcgtaccgggttgagtgcgtcgagaatggcaccggcggtttcgcaggtgcgttccagaggggacgaatacaccgcggcgaccgtgttgagcttggggtcggctgcgatgtatgcgcccgtcgcctgcgccatgcgcatgccgcggtcggacaggtggaatccgggcagccgctcgtacaacagatggtcgggattgtataccttgccatggcggatgaaatgtatggtggttgtcggcatatgcggccttcctgcgggactcgtgatgtctgtctttcattgtcccacattcgccggccggccggcgatgccgcgtccgcggcggcgtttgcccgacgaacatcgccccgccccggcacggcccagccccacccgtaccgtcctgactccacccgcccgactccggctcgtcaccccatctgatacaccgatatatcaccgtcgtttatgaacgttatgaaaattgatgcgttcgtgatatcaacaccgcgtgtcgcgccccgacgcgcgattaaagttgccgtgacgcaaacatgcaaagcatcctttgcgcgaccaacaggacaacacatcaatacgatgagggctccgccggcaacgccacgccgacgggggacatccaatcgggagcggaaaggagatgctgtcatgtccaataacgccaatgtcgcggctgcaatcaaggaagtcgcccataaggtattcggcggatacgcggaactgctgcgtatgccgcacaccgcaaggttctccatcggctcggtgatcgcctgcatgccgttccccatggtcggcatgaccatcaccatctccgtacagcattactacggcaactactcgctggccggcgtgctcaccgccatccaggcgatcgcgctggcggtctccagcccgctgctcggcaagctggtcgacaagttcggccagcggcaggtgtcgattccgacgatcctggtctggatcgtcgccgccatcgccctgaccaccagcatcaccaaccgcgccccggtatgggtgctgtactgcctgacgccgttcctcgccgcgattccgccgtggggcgcgatgagccgcgcccgctggacgaccatgctcaagggagaccgggagcgcaccgaccgcgcgctctcactgtccggtgtgttcgatgaatgcatgtggatcatcggcaatccgctggcttctacgctggcggtgatttctggcctgctggcgttctcgttcaccggcgtgtgcgtcgtcatcggcgcgctgatgttcctgaccgagctgacgaccgagccgaaatcacagacccagctggcccgagaggccggtctgacccgcgaggagtaccgcaagcgtgaggccgccaaggcgcagaggatgcgcgagagggacgccgccgaccgcgcccgccgagaggccgaggcccgcggcgacgatgagcaggccgtgcaggccgccgtcgaccgagccatcgccgattcccgcgccggcaagaaggagtcgatctgggggccgggcctgatcgccgtgtgcgtgacctggttcagtcttggcgcattccagtcggcgtcgaacatctcgatcatcgcgttcgccaccgaagcgaacatgaagcaatacaccggtttcgtgttcgcatgcttctcgttcagctcgctatgcggcgcactggtgtacggcgcgaagaactggatcatcccgctgtggaagcgcttctacttctgcctcatcgtggtgaatttcggcgtgggcacgttcatgttcgccaagcatctgtgggtgatcatgatcatctacctgctgatcggcgtctgccaggcacccacgtggatcaacggcaatcagctgatgctgcatctggtgcctcccacgcgattcaccgaaggcgtggcgtggatgggcgcgatgaactcgatcggctcgtcagccggctcagccatcgcgggtgtcttcatcgatcacatgggctcgcatggaggcttcctgatggcgaccgtgctggcgatcacctcgcttgccatcgccttcgtcggcttccggcagatcaaatccagcaccgaaaccccgactctgaccgaagtcagcgtgtgatacgccggatgccgctctcaaaactcgcggatacaaggcatttttgaaggaaaacacactctatctgcgagttttgagagcgcataccgcgctacttcggccagccctccggcgtatgcgcgagcgaccacaggccaagccgatgcgagaagctgttctcccacttcgcttcgagctcttcctgactcaaacggttctcggacttcctcaaacggttcatcgcattggtatgcgtatcgtcaagcagccacttgcggatcacgaagttccagatcatcaccactaccgtggctaccagcttgccgacattcgtccacagcacgtacttcgtgtgcatggaatacatggaatcatgcggcatccacgacgtgctggtccacacgatcgcctcgttcatgaaccagccgataagcgccgccacgaagaaaatcgcgatctccatccagcgcgccatgtccggccggtgcttgaacacgaatttcatgctcgccaggtaattgaatatcagcgagacgaagaacgagattgacgtggccagcacgttatgcatatgcgtcatcagcagaatgttcatcagaccccagtcgatgatgaacgcgaccacaccgacaataccgaacttcatcagctgttcaatcaatttcctcacattgattgtctaatacatatcactgacttcacaccgcggttttcctgaaccgccactgatttcacacatggccgcacagcccgcgcccgccgcggaaccgattaggatagggaacgaacccaatcaaggaggaatcatgcccgttatccacactcacgtatccgtcaagaccactcccgagcagcgcgaggcgctgaaggccgcctacggcaaggcgatcacggccgtccccggcaagtccgagggctggctgatgtgcccattcgaggatgatatgccgatctacttcggcggcagcgacgatgccccggccgcatacgtcgaggtcaatgtgttcggccgttccgtgcccggttctgcgtgggagaagctgaccaagtcgatcatggccgcgctcaacagcgagctcggcatccccgaggaccgcacctacatccgctacaccgccaccaccgactggggctggaacggcggtaacttctgagctcaggtgtgatggtatccgccgctatattgtcgcgcatggcgtcactgtgtgcgaccaccgtcacgctgcgagccctcacacagtgacgtaaatcgcaaaacccttattttgcaagggttgcgggggtgcgtcacggagtgtgaggacgcacacagtgacgtaaccctcacacagtgacgccttttctgcggcacacaggttgccgatatataaatgaaagagccccttgcggccagtcggcccgtatgatcggccgacaatccgaaaggggttgtgatgatgcagtcacggtgtgcggtcagcgcgagtgcggcatgattccgcatgccacgccgccgcacactctcacagcacgcgtgccccggcaccccggcggtacgcctctgccgcaatcagacgatcttgggcatcggggtggtcagggacgtggtgaggttcacgtgaaccagcccggcgcctgcgtgcacttcgaccttcttcagggtgaccgtacgctcgtcttccggagcgcggtcgttgtcggtcatcgtggccggggacttgacggcgaccagcgccagatcgtccagcgacatgccggcggccttgcacagatcatccgcagcacccagggaatccaggaaaccgtccttgagcagcacacggctggccggcacgccgtaggcgttctcggccacccacttcacgttctccagcagggccatgcccttgtggctgtcatgcttggacggcatcgacgtgttggacagcacatcgacgaatgcgtcgatctggtcgctcagaccctcgccgccgtcgcgatacaggttgccgatgatggggtcgcgcagctccagacgggccgcggtctcgcgcagttcgggaatctgatcgtcctcgccgtcccacaggttcaccagcgggaacgccggaatgtcgagcttctccaagcggtccacgtggaacgggtagcgccacgccagctccgggtcatcacgccacgtcgaggcgcgggtcacgacgaccgccgcggacggccactgcgcgccatactcgcggcaggcgatgtcgagccacttctgcgctccggcgtcggtgccgtaaccggcctcgacgatgaccacatcgtgcagggcgcacgccatctccacggagaccagcgtcgggatgccgatcgacacgttggcgaacgggccgccatgcacatacaccggcgagccgttcaccgtctcggtgagcgccggcttgaccgcatcggcgagcatatcggtgatgcgccacaggtcgatgaagtcgccgaacttgactggttcgccgtccttcgtgccggcgatcatcgcggccacgcgctcgccgatctcatccatcgaacgggacagcacgacgatctgcatcagctcggacgtcggggtgagcacgaccttctcggcgacgttgttcttgcccgcgtccacggtgatggaacgcagcgagcgggacggcacttcggagacgcgcggcacgaggatcgtgtcgatacgtccctcgtccacagccttctcggcgaaggagacgagcaggttctgcgcggcggcgatggcggccatctcaccgcacaggccccagtcgatgagctcggggtgggtcagcgaagccttgccgccgcccgaggcaccgcctttggaaccggcggcggtgatgcccatgctcggctggcgcagcacggcggtcgcgtcgatgccgcgagcccgcagcgcatcgatcatatggcgatgatgcgcgcgggaccgtgctgcgacagcggtttcggcgcggggaacgtctcgtattctcgtccaagcagatcagtaggcataccgttcaccttatcatcaccagtgtgcgcggggccgccggacgtgccgaccatcaccgtttccgccgaagacccgtcgtctccccgtggcgcggcggcgtaggtgccgcggatcggcagcgtcccctgcctgtttcccgcgtcgtcgccgtcgaagcgggaatatgccgcctgctgcatgtcgagctgcctccttcgcgtgtcgcatccatgctatcgcgcccgggcaaccgctccgcgttcaccgcgcgcgcggatgcgaggtgaggtacgcctcaatcaaggtctccgggctgacgtgcgtgtatatctgcgtggtggtgaccgaggcatggccgagcagttcctgcacggtgcgcacgtcggcgccgccctggatcaggtgcgtggcgaaagagtgccggagcgtgtgcgggtgaagcggacgatcgatgccggcccgctcccccgccagtttgatgacctcccataccgactggcgagacagccggcgtccccgtttgttgaggaataccgcgcggcgttccggcgtgcccttggcgcggccctccagcgtgccgcgcccctcggcgaggtatcggcgcagcgcgcgacatgcgtattcgccgagcgggacgagtcgctgcttggatcctttgcccgtcagccgcgccacatgcgcgtcgtcgatgtcgatgtcgtccagattcattccgaccgcttcggagacgcggcatccggtggcgtacatgaattcgagcagcgccctgtcacgcagcagcacggcgtccggcaacgctccggtgccagctctcccccgcgccgcgccggtgccgtgcgggtcgggaatcgcgtcgagcaggcgggagacctcgtcgatcgtcagcacatccggcagcatctgcgcgctcttgggtgccttgaccgtggcggacacgtcgtcgctcacggcgtgctgagcgagggcgaaccggtggaactcgtggatgctggcaagcctcctcgccttgctgcgcgcgctgtcgccgtccgaatccagctgcgccacgtactcctcgatgtcggctttgccgatggcatcgggatcggtgatgccgcgcgtgtgcgcgagccacgagagatagcggcgaagatcggattcatatgcccgcacggtcgccctggccagtccgcgttcgacggagatatgcgcgatgaactggtcaagaagccgggtggatccgttgtacatggtgccccatcatatgcgagaaccctgtatgcgtgcggaaggcttgcatatctgcacgttcccgcatgatatgcgagaaccccgcacagggcggggttctcatgcggttgccgatgcgcgcgaaggcgcatccgccgaggttcgcggctcaggcctcgaccggagcgttgacgtcctcgggcagagcggccttggcctgctcgacgatggccttgaaggtctcgggatcggagacggccagctcggcgagggcgcggcggtccagctcgatgccggccaggtgcagaccctggatgaagcggttgtaggtgatgccttcggcgcggacggcggcgttgatgcgctggatccacagcttgcggaagtcacccttgcgagccttgcggtcgcggaagttgtaggtaaaggagtgcagcagctgctccttggccttgcggtacagacgggagcgctgtccacggtagccggaggccctttcgagaacgacgcgacgcttcttgtgggcgttcactgcgcgcttgacacgtgccatagttattcctcagctttcttttgacgtatctattcggctggcgcggttcagcggcccagcagcttcttcatgttcttggactgggccgtggccagcacgccgtcggccttcagcgcacgacgcttgcgagcggacttgtgctcaagattgtggcgcatggcgctgcctgcatgcatcagcttgcccgagccggtgacacggacgcgcttggacgcggcggaattggttttcatcttcggcattgctgccctccttgttggttacttcgtttcggaagtcttgtcttggtcgtcgatcgcggctgcggacgccgccgctgcctggctctgcgcctcctgcttggcggcgaggcgggcggcctgacgggcctggcgctcggcgcgcgactggtcgccgcggcggcgctgctcggactgggtgtgcaccttcttgcccttgggcgcaagcgtcatgatgatgttgcggccttcctgcttcggccgggactcgacggtgccgtactcctcgacgtctgcggccagacgctgcagcagttcgacgccgccgatggggcgggactgctcgcggccgcgcagcatgatggtcaccttgaccttgtcgccgccgttgaggaacctgaccacatggcccttcttgacctcgaaatcgtggtcatcgatcttcaggcggaagcggatctccttgatttcggcggtgctctggttacggcgggcctcacgggccttgatcttctcgttgtacttgaacttgccgtaatcgataagcttggcgacgggaggcttggcgttgggcgccacctcgacgagatcgaggttcgcttccttcgccaggttgagcgcgaccgaggtcgcgatgactcccacctgctcgccgttcgggccgatcaggcgtacctgcgagacgcgaatctcgtcattgatacgtggttcgtcgctaatgatgactccaatcctcatgttctccgaagcggaccttcgccggataccgggcatgacggacgaatccatggctcaccgaaccgtgcgcactgcagcgccggccatcatacatattcgcatgatcgcatgcctcatgaggcatgctcacgaccgcgcattccacgcgaccggataggctattgccttggacccgaggccatgacaggcttccaggtggggttgccccgctttcttgatttctcaagccttgtagatactaccacacccccagaccgggcgtgtcgccacaagttccggtccaggcgcaggcaagccatcgaccggcgccttgtcgtcggtcaggatcgtggcgcccggcttgccgtccgggtcggcgatggtctcgaaccggcccgccacctcgcccatcgccgatgccagaagcggtccggagaagatcgggaacgtcacgaacgtgcccaccgcggggatcgtcacgaaggtcggcaggaaggtgccgagaatcgagccgaccgtattgcaggcggacagtcgtccgacgacggaggcgttgttccccagcgagtcggccgcgaacttgttgaggcccggcgtgaccgtgccgagcaggaatagcggcggcacgaagatcggcatgcagctaacgcggcgatgaccgggaagttcgtcgacacggtgacgatcagcaggcgcgacgcgcagtgccgtgcacacgatacagtggcagcatggcatatgaacgttgcgtgattttcggcgccggcgagtattacgaggggcccgcgcccgctatcgagaaggggatgctggcgatcgccgcggacggcgggctcgaccatatgcgggcgatggggctgtcgccggatttcgtcatcggcgatttcgattcgctgtccggcgacgtgccggacggcgaccgcagcgtccgcctgccgccgcagaaggacgatccggatctgctgagcgcgctgaaggtcggatggagccgcggcgcacgcgagttccatatatatggagcgctgggcggtcgcatcgaccacacgatcgccaacatgcagctgatggcgctactggcctcgcatggcggcatcggatatctgtacggcgacggcagcatcgttaccgcgatcgcggacggggcgctggagttcccggccaatcatgtcgccccgcgccgcatgatctcggtgttctcgcacagcgacgtctgccatggcgtcaccatcgccgggctgaaatacgtgctggagggcgccgcgctcgccaacaccgtcgtgcagggggtgagcaacgagttcgtggacggttccgcggcgacggtctcggtggagtcgggcacgctgatcgtcacgttcccgatcgaggtgccgctgcctgcggtgagactgcggcatccgttcggcggggatctgggcacgctcgacacggcggtgtcctcggcgctggcggtgcggtgaggccgcggtgcggaatgcctcgcatcgaatcgccgcaggctgcacagacatatttgttagcgttaacggaatatggccgttttatgctcaaagcaagcgcgacaccgttgctctagtacagacggcgcattacagtagacactgttggtaaacaaaggccgtagcgcatccatgcgcaaacggcctaccctacaaagggagaacacatgacagttaagattggtatcaacggctttggtcgtatcggtcgtctcgccttccgccgcatcttcgagctgcaggctcgcggtggccaggccggtgacatcgaggtcgctgcaatcaacgatctgaccacgccgtccatgctcgcctacctgctgaagtacgacagcacccacggcaccttccgtcacgacgacggcaccccggtcgacgtgacctccaccgacgacgccatcgtggtcgacggcaaggaatacaaggtctacgccgagaaggatgccaacaacatcccgtgggtcaagaacgacggtgtcgagttcgtgcttgagtgcaccggcttctacacctccgccgagaagtcccaggcccacctgaacgccggcgccaagaaggtcctgatctccgccccggccaaggacgagaccaccccgaccgtcgtgttcggcgttaaccacgagatcctgaaggcttccgacaacatcgtgtccgccggttcctgcaccaccaactcgatggccgccatggtcaagctgctgaacgacaagttcggcatcaagctcggcttcatgaccaccatccacgcctacaccggcacccagatgatcctcgacggcccgcgcttcccgaaggctcgcaacaaccgcgccgccgcgatcaacaccatccctcactccaccggtgccgccaaggccatcggcaaggtcgtgcccgaggtcaacggcaagctgcagggccacgcccagcgcatccaggtcccggacggctccatcaccgagctgaccaccgtcctgaacaaggaagtcaccgctgacgagatcaacgccgcgttcaaggaagccttctccaacaccgagtactacggctacaacgaggacggcatcgtctcctccgacatcatcggcgacacccacggtggcgtgttcgacccgacgcagaccgacgtgaacaccgttgacggcaccacgatggcccgcaccgtgtccttctacgacaacgagtacggcttcacctgcaacatgatccgtaccctgctgtacttcgccgagatctccgagtgaatccccgcggtctaggccgctagattccacaaagggtttatggtttgggttcccacagtgcttcgctgtgggagcccaaaccataaaccctttgtttttaccggctcggcacttgccggcgggctgagccggactccgtcaccacgtaccgatgggcgcagcgaccgcgttcaacaccttgagcagatcatgcggattgacgccgaccgaaaacccgcgcttgccgccggacagcaggatctcgtcgaattgcagagcgctctcgtcaagcacggtcttgtgatgcgtgcgctgcccgagcggcgagatcatcggcaggaacaggtcggtttcctcgatctcctcgcgcgtgacgcgatgggcgaaatgatgcgtggggatctcatacccgtcggctcgcagcacgcgcacggcgcgcgggtcgataggatggccgtactcctcgtcgctcacgccgctggacaggacgcgcacgcggtcctcccctatcccacgcgactcgaattcggcgcgaaggatgatctccgccatgggcgaacggcagatgttgcccgtgcacacggtcatcacggtgtatgggtgctgctgtgtcatgatggctcctgatggtttccgatgggcgcctgtgcgtaaggcacccggtgaacttgcgcgcgcggcgattcagccgatcttgcgataggtgacgaagcggtaccgcttgattccgctgtcgtccttctgcgttctcttccaatggccggggtcggcgacctcccacaggccggcgtcgaccagagcgtccatatcgggcgcatacgtgtctgcgtccactgaggtctggatcttcgtcacgaacgccttgctggcgaaaggcagcgcctcctggaagacctgcgctccaccgatcacccagatctcgctgcggtcaagcccgtcgtcgggaatggcctcctgccgcgcgatgtcgagcgccgcatccagatcggtgacgaccgtggcgcccagcgccagatactggggattgtgcgataccacgatgttgtcacgattgggcagcggacggtacttcacgttcagtgactcccatgtcctgcgtcccatgatcaccgggtgagagacggtgagctccttgaaacgtttcatatcctccggcagatgccaaggcatgccgccgtcgaacccgatggcaccgggacggccgtctttgtcgtcagcttcggcccaaatcaggttcactgaaaacgtcttgggaaagtcatcaccccaatcatcggctttctcctgcccggcgaacccgggctccggttcgtgatagccgttgcggctactatcatgctccatttcattcactccttgaatcggactgggacaatagtgtaacggtcggttcagaccgcgaccggcgccttgatggtgggatggtgccggtagtcgacgatcgtaaaatcctcgtactggtagtcgaacagcgaatcggccttgcggatctcgatcttcggatacgggtacggctcgcgcgacagctgctccagcacctggtcgacgtggttgtcgtagacgtggcagtcgccgccggtccagacgaattcgcccggttccaagccggtctgctgcgcgatcatcatcgtcagcagcgaatacgaagcgatgttgaacggcaccccgatgaacatgtcgcacgaacgctggtacagctggcagctgagccgcccgtcggccacgtagaactggaacagggcgtggcagggcggcagcgccatgttctcgacctcggccgggttccatgcgctgaccaccatgcgacgggagtcggggtggttgcggatcaggtcgagaacattgccgatctggtcgatggtgcgattcgggtcttcgggggtcggcgcgggccagctgcgccactgcacaccgtacacgggaccgaggtcgccattctcgtccgcccagtcatcccagatgtgcacgttgtgctcctgcagccagcgcacgttgctgctgcccttgaggaaccacagcagctcgtatgccagtcccttgaagaacacggtcttggtggtgagcagcgggaatccttctgacaggtcgaaacgcatctgctgcccgaacagggatatcgttcccgtgccggtgcgatcggacttgagcgtgccttcgagcatgatccggcgcaccaaatcctcgtacggcgtggggacgtcactgtgaggacgggcggggatacgggtgcggatatctgcgagttgttccggtgtcaaagccatgccacccagtgtaacgacagcggctaacagcccgaggcgagtggcggagacgacggacggcagcgtgcgatggatgcggtagcgtcacgctgtgcgggtaccgtcactgtgtgcgccctcgcacacagtgacggtaccacaaaccccagtgtttccagcggtttccaagaaaccgtcacgccacgaacccgcacagcgtgacggtacccgcacagcgtgacgccgaaacatggcatgcacaggcgatttcggagatgaaacgccggacgagacgggggtagacaccccaaaccagacccagatcagaccaaagtacccatcgagcagacgtgctcgggccggaggggcgtccagccgaacgcgtatcacgacccatggcgaacgattgtggtctacattagaggtatgtgtgacgcggcaggcgcgtcatgacgactacacgaggagatacgcatgggcaagcgactttgggtcgagcgcaacaaggatggttcatgggatgcgttcagcgatgacggcgctcacatcaagttcggcaagggccgcggagtgttcacccccggagacctgatgaagatcgcgctggcgggctgtgccgcgctgtccagccagttcgccatcgagcacacactcggtgacggcaagggcgcgaagatcgtcgtggacggcacatatgacgccgacagcgatgcctacatcaacttcaacgagcaggtcgtagtggatgccactgacgcgaagctgagcgaagaggatgcgaacaagctcaaggagcgtgtcacgcgccacatcgaaaagggctgcaccgtcaagcacacctatgtgcaggagacgccggtgcgcatggacgtgacggttcgccactgaggcatcgcggggctcctcccctgtcatataacggcacggaggagttcatgctgccgcgtccgcggcacgagcgccggcacaacaacatcgtggccccgccgggcatcgagtccggcggggccactgcatgcatcagagccgaatcaggccttgtgctcggggtcgatggccgaatcgatctgctcgacgacctccggctgcgcggccggcaccggcagctcctcaacaccgccgatggactccaagggcttcggctcgacatcggccggcgagctcggaaccgtgtcaagacgggattccgcggcttcgacgtacttgcggggtacgacatacaccgggccgacggcgtgctggatcagtccctggctggtggagcccagcagcaggccggtgaacccgccgcggccgcgggagccgacgacgaccacgtcatggtcatagctggctttggtcagcgcctgcacggcgttgcccggcaccacggtgcgggtgatcttcagatcggggtaggactcctcgatcggcttgatacgcacctcaagatcctccatgaaggattccatcacggccttgtcgccgtccgatccctgcaccttcggcgcggcggagatcacgtcgagttcggcaccccacatgttggcgaacgaggcggcgatgtccagcgccttcagaccccacttcgactcgtcggagccgaccgccaccttggtgatcgtgttgttcaggtgcatcaggttgccgtcgtcgtcggtatagggcacgacgacgatcgggcagtacgcgtacgcgggcagcgacgagctggtggtgccgagcaggcgctcggccagtccgcccttgccgcgattgccgatgacgatgagattgtagttgcgcgacagctcgacgaacacggacgctgggtcaccggtgacgatcagcgtcgccgcctcgacgccctgctcgtcggcgatggccttggccttggaaagaatctcctgtgcgtcgctgtgcgccgcgttgtcatcacccatcgcggtgtacgtggcgtcgaacgacactgcggcgtagctgggcaacgaatacgcgcatacgatctgcagcgtcaatcccgcatgcttggcaaaattggcggcccaccacgtggccttgtaactggcatgagaaccgtccaccccaaccagaatcgccttttcgttgatcatggcaacctccttaaggtaacaccgatgcagcggcgcatcgggtcatagttcctagaataccgcgtacgcgtcaggatgcgggatgaacatcagtcattttgccgattgagaacaatgccacattcctggcgtcggtgtgtcataacgcgcggcagcgcagcggaagcgggcacggcatcgtcgccgcatcacctgtcgaaaaagcacgacagcgccccaatggaggcgctgtgcagtgcgaaatatcgttcgaagactcttcgaccggaagcaaccggcttagatgattcggtagtactcgaaggaagcgtatacgggcacgatggacacgctcttgccggggcgcggcgcgtgaatcatcagaccgttgccgacgtagatgcccacatggccggatctccacatcaggtcgcccggctggggatcgttgaccttcgtgccgtgggcctgagcccacacacgctgctgatagtcgatacgcggcaggctgatgccgaacttggcgtacacatactgcgtgaagcccgagcagtcgaatcccgacggcgtggtgccgccgtacacatagggcacgccctggaactgggaggcgtaggcgaccacgccggcgccattggcgctgaccggggcatcgaccgcaccgtcattggagacggacgacgagctggtgctgctggtcgcggccgatgcgcgggaacggctgacctccgccgcctgcaggcgggcggcttcggcggcggccttctcggcggccttgcgctcctcttcggccttcttggcctcttcctcggcctttttctcggccgtggacttggtctcgggcacgttcagggattccacaccgccccagctttcgctgtcatcggagctgaccgatacggtctccttgagcaggtccttacgcgcggtgttcatcttcgggaacgagcgagaagaggtaatcgccttcctgctcgcattatcggaaccggccaaggcgacaggcaccgataccgtgaacaaccccaccgcagctgctgcggcggtgatagtcgaaataatcttcttgcaaatcatcatcgaggcatgattgtagcacacaggcatgcatcttcgcctgaaaacactcacgctaggaaatcacgccatatcggcaacatcacgggaaaaccggcaatcttcacacgaccggcgcgacactcccgggagaataatagagatgaatctcactggcggggaccgaagacccgccgaaaatcagtagtggatgtactggaagtcgttcacgttggaaagggtgcgggatgccggcttgccgttcagcgaagcaccgcactccgagacggtgaccgtgccgtcagcgttgatgctctccacgatggcgacatggccatacacggaactcgcgccttcctgacccgcgcggaacaccatgacgtcgcccttgtggcgaggcgtgttgtccacccagtagccgtgcgcacgagcggagttcgcccagtcctgaccattgccgaaatatgatccgacgggcaggccgagctgatggcgacgcaggtatgcccaccacgtgcactggctgaacgcataggcgagaccgctgtcgcccgtggcatggttcgggttgaatccttcgggcagcttgccggcatcctggtcgaccagcaccgctgtacggcacgaagccggacaccacgaagccgccgccaagctgcgggccactggtcacgctgccgccgatcgcgccgattcgctcgcgcatgccgatcagtccgtaaccgggcttgtggccgtccaacgacgatgacgcgccgcggccattgtcggcaacggtgacgtgcagtccgtcagccccccagatctcgctgatctgcacggtgacgttcgggccgccgtatttgcgcacgttcgtcagcgcctcctgcaccatgcggtacattgcggtgctcgcctgtgcgccgagcgcggcgacccgcggctggccggacacggtcttgcgaatcgtgcaccccatgccggccgccgccctcgcctggtcgatcagcgcgtccacatccgcgtaatcggcatggtccgaccctccgaacacgcccagcagacgtttcatgtcgtgcagcgcgcgctccgattcatgacggatcgtctccatggtctgccgggccagcgccggattgttggcgcccgcgtaccggcccccatcggattggatgatgatgatcgacagtgtgtgcgccaccacgtcatgcatgtcacgcgcgatgcgggcgcgttcggcgagcgccgcgatatggcgttcctcatcctcttttgcctgcaaggcgtcgttgcgctcatgcatcatgctgacggtgatgcgccgggcccgctgccagtacgcgacgatgatcgccgcgaacagatacacggcgatgaagatgaatatggccactgagcttgtcgtcatggtggtggcgcaatcaccgctcagaccatagatgtatgtccccgaacatgtctccagggggctgagtccatcgaagggcacgccctgattgaggatgggacctgcatcggcggaccagatgatgacgggcgacgccaaggccccgatggcgacggcgagtacgatgaacgccttcgaattgcgcggatccgcatatacgatggccgaatacagcatccatggcgccatcaggtcggcatataccatcgacggcccgaacgccagttggacgaccaccagaccggcgaacagcaatgtagccatctgcggcttccaccggcgcatcgcgacgggaaccatcagaacgaagctccagaaggccattaccgtatggtcgaaataggcgatgatgccgggattgctgtcattggtaccggccatgagcgtgaaaaagatggagatgatcaccgcatacagggcatctgcgagcagcacatgcttcctgttccacgtggtgattcgttccatgattcccatacggttcagcgtatcgcgtgcggtgacccgacccacatcggtcggccggatgattcattgcgatgcggcgtgtcgggcggggtgcgttccgttggtgggaatcccctcgggtttccgccgccggtcggctacagtggaaccgagaatggtacggcatcgtgggatgccggggtgcatcaatgaaagggaatgtatgacgctgcttgccgaatattacgtgccggggctgcatatcgaggatcggtcggtcaaggtcccgcttgattgggccggtcatgagccggggcgcggctttgacggggaatcgatcagcctgttctaccgcgtggtgaccgcccccgagcacgtgcatgacgatctgcctctgctggtgttcctgcagggtggtccgggaggggccggacccaggctgctgaacccgtcgagcgacggatggattgcggaggcggtcaagcatttccgtgtggtgctgccggatcagcgcggcacgggccgctcgtcgcgcgtcgactcgcatgccatggcgaggctcgccgccgggggagcgcgtgcgcaagcggattacctcaagcggttcctcgcggattcgatcgtgcgggacttcgaacatctgcgccgcaccgagttcggcggctcgccgtgggtgacgcttggccagagctatggcggatttctgacgctgacctacctgtcgctgttccccgaaggagtggccgcgagcttcacctgcggcggcatcccgcatgtcccggcgaacgcgaccgaggtctatgagcacacgttcccgcgcatggcccgcaagaccgcgcagttttacgagcgctacggcgtcgatgccgatcgtgtcgccgctgtcgcggatcagctgccgaccgtggctgagatcgcggaagccggcggcatcggtggcgattccggctcgctgcccgagggaaccccgctgctgccgaacggcgacccgctgaccgtggagcgcctgcaatgcctcggctccgacttcggcatgaagccaagcttcgagcgcgtgcactggattttcgacgatgcgttcgtcgacggcgacggttcggtctcagccggggcggcgttgtccgacgagttcttggcgaaggtcatgaacgcgacctcctcgcgtcccctgtactggccgctgcaggagttcatctacgcgaacggtgaactggacgagccgattcgctgggcggcacagcgcgtgcgcgacaccatgccccggttctcgaccggcgaacgcccgctggccttcaccggcgaggcgatgttcccgtggatgttcgagcaggagtccgcgctgcggccgttcaagccggcgatggacctgctgatggaggatacgagattcggtgtgatctatgacgccgaccagctggcccgcaacgaggttccgctgcaatcggccgtgtatttcgacgacatgtacgtggattccggcatgcagctcgacacgctgagccgtgtcggcaactcgcattactgggtcaccaacgagttcgagcatgacgggctgcacggcgatctcgtgttccgccatctctacgacgaggccctcaaccgcggcgacctggaatcgctgttctagcgtgcgggcgtacgcttcgcggccgtgcgcggcggggcatgacgaactgcatctttcgtatgaacaacacaacaaggagcatcatggcgcagaacatcaccataggattcatcggctatggcaacatggcgcaggccatcgcgcagggtctcgtcgatgcgggcgtcgtcaacggcggcgacatcgtcgcctgcgcggcgcattacgacaagctggaagccagcactgcgaagctcggggtgcgtccactgcacaacgtgcgtgaggtcgccgccgcggccgacgtggtgatcatcgccatcaagccgtatcagatcgaatccgtcatcaagcccatcgcagacgagttcgccaagaacggacggttcgtggtgtcgatcgccgccggctgggatctggcgaagtaccagaagctgttcggcgatctggctcagagcatacatatccagtgcacgattccgaacacgccggtggccgtcggcaagggcgtgctcgtcaccgagatcgacaacacgctcaccgacatgcagacggaggtcttcgaatcgctgttcggcccgatttcgctgatcgagcgcgtcgacgccgcacacatgaccatcgccatggtggtggccggctgcgcacccgccttcaccgacatgtacattgaggcgctgggtgacgccggcgtgcagtacggactgcagcgggccaccgcataccggctcgccgcgaagatggtcgagggcgtgggagcgctgtacatggccaccgggacccatcccggagcgatgaaggatgccgtctgctcgcccggcggcaccacgatccgcggcgtcgccaagctggagaaggacggcttccgcggagccgtcatcgacgccgtcgacgccatcgtaggctgaccctgcaaaagggtccatcggacggtcgtcatccggtcgtcttccagtcgtcatccgcggtgtagctccggatatcatccggtgccctatcccgcgaaagtcccatatcgcacgccgcaaatgggactttcgcgggatggacggaaagctgtcgtcggatggcgcaggccgtctgttgttattcggcgccgtgaacgacgcggacgccgtcggcggtgacgtatccgtagttcatcgtctcgctgttgtaggcgatgacgccgtcgccgctggccggcatgacgatgacgccgccgtcgccgcgacgggccgccacgtcatccagtgcggcctgagcggcctcctgcactgactggccggcgaaccgcacacgatccgcgatttgatgcgctgcgacagacctcacgaacgcctcgccgatacccgtgcatgacacggcgacgctgtcatcggccgcgtacgtgccgcatccgggcagtggcgaatccccgacgcgccccggcatctggttcgtgatgccgcccgtggacgtccccgccgccacatgtccggcggcatccctcgccaccgcgccgatcgtgccgtgcttctcccaggcgtcgccctcggattgggcgcgtgccagcgaacgccggcgttcctcggtcatgaaatacgacggatcgcgcaattcgatgccccacgagcgcagcaggtcctcgcccggcagcgcgaacatcgtgtgcttggcgcgctccttgaccgcccgggccacatcgatcggatgccgggccgtggtcagcccggcggcggagccgacctcgccgtcgccggtcatcaggcaggcgtccatcgacacctttccctcgctggtcagcgccgcgccccgaccggcgttgaactccggcgcatcctccatcacatgaatcgcggcgcataccgcatcctcggcgggcgcgccctgttcgagcagcgcgtagccggcgtccagcgcccgacgcagatcgcgctcggcctgcgcagtcttctgcgctctgccatccttgctccggtcgccggctcccgcgtggatcgccagcagaatgccgttgacaggactgccggacgccgttgatgcgccggatacggtggtgatgatcatgttccctcccttgcacggtttcgccgtgactgatgttttccgcgtgtattatgccaccgtctccgggaccggtccattcgaggcgattcggttacggcgcggtttttgccggcgaatccgacgagatgacggctttatgtctcaatatgtgagactggtggtggcctccgcgccgcccgggcgcgcattcgccggccgtgcggcatacgcgcatgatagcggcatatagatttcggcgatagccctgttcgacgcaatcgcaagaaccgcgtgaaaacgcgcattacgctgaacattgttcgcgaaaacggccggcatcccgccggaacgcagcgggcgcacaagatcaatgtgcacgatcagcaatcttagcatccaaacacacggcacaaaccaaacacgataccagggggaacgaagagacatgaagatcaggagaatcgctgcggcggtattggcggtcacatcgcttgtcggcggtctgacggcgtgcgggaacagcagctcggcagactccggcaccaccgtcaaggtcggcgtggtccagcgagaacgtcgtcaccaaggtgatcttggtgtgcaggctccaacggcgtgggggagtgcggtggcgggcgcagcgcatgaggttgagcagcacgggaaatcccagcgtgccgcagaacgcgctggccatgatcggcatgccgaccgcccagttgttgacgtgcaggccggcgccgtccggcgtgaagccggcgttgttgtacgacatgaccgcgaagaacagcgcctcccgggcggtatggcggacattgcccctgttgatgccgtacaggccggggaacagggcgaggaacgtgacggactcgatgatgaacgtggtggtgatgaccacggtgagcacgccgcggatctcgttgagtttcgtggtgccgagctcgttggcggtgagcagcctctgcgtggctttcatgtgatggttggcggccagggcgatcagcgatgcgaacgtcatgacgcccaagccgcccatctgcaccgacaccagcagcaccacctggccgaacgcggtccagtgcgtggtcgcgttcacgatggagatgccgcatgtcgacagtgcggacacggcggtgaagaacgcggtggagaagctggtcggctcctcttcgtgtgaggagaccggcagcagcaacagactggtggacagagccaccagcagcaggaagtagatgatggtcagacggccgggatgcgaggtgagatggtgaatgaagctgcgtttcctgcgggtgcgctcctcggcggcggccttctcgaacgtgtcgccggagaaccaccacgcgtagccgtgcgatgcctcgcggttcgctgaggactcgtcaaaaacgagatttgacatggtccccgctccttcgtatgcgtcggcgcgcgtcaagcgcggcaacagactggttgcactcgccattttagtattctttggcgctgatgccgccgtcgtccgcatcgcgggcgcgggcccgcccggccccggatcggtcttcatggacgcgccgccggcggcgcttgcgtttcgttttcggcggataaacggttcgtggcgccttatgggatattgtggatgacagtacgtggtcgtttcggatgatgatgaggtgtgcgatggtctgcgctcggcatgcagtggtggtgacgcattcgcgtctgcgtgaaagcggcacggtggtgtctgaggcggtcgaccggctgcgcaacgtcgggttcgaggtgtcgatcatcgacaacgtcgaggcgccgcagttcggcggcgtgacccacaaggtcgacgaggacaccgagatcgtcgtggtgcttggcggcgatggcacgatactgcgggccgctgaactggtgcattgcacgcaggtgccgattctcggcgtgaacatgggccatgtcggttttctggccgaattcgagagtttccagatgagcgaggcgatccggcgcgtcgccgaccatgactattcgattgacgagcgcatgatcgcccatgtagatgtgtggctgccgggtgcacatgaaccgctgcaggactgggcgctgaacgacatcaccttggagcgcgccgaccgtggcaagatggtcgagctgtcggtccgggtggacgatgtggagatgagttcgttcggctgtgacggcgtcatcgtgtcgacgccgaccggatccaccgcatacgcgttctccgcgggagggccgatcatgtggccgaacgtcaaggcgctgcagttggtgccgctggcggcgcatgctctgttcgcccgcccgctgatcatcggcgccggctcgacgttcactctggacatcctcgacgattcgtcatccgaaggctggatctgttgtgacggacgacggcagtgcgccctgccgaagggaacccgcgtcgaggtgcgcgagtcgaagagcacgttgcggctggcccggctgtccggtgtgccgttcacaaaccgtctggtcaccaaattcgatctgccggtggtcggatggcgcgagcacgcgaggaacggtggttcctcggcgcagcgcacgcgtgcaaggggtgcggcggacacggccgcggtgccttcttccggcgagcagggggtcgaccatgcttgaggaactggaaattcatgacctcggcccgattcatcgtgccctgctcacgccggccgggggaatgaccgcgatcaccggcgagaccggagcgggcaagtccatgctgttgagcgccatccggctgatttccggcggaccggccagcagcgggcgcgtgtccccgggcgcttcggaggcatgggcgcaaggcgtgttcgccgtggatgaccgcggcggcgtggcgcaggaggcccgcgatgccggggccgtgctggaggacggggagttgtacttgtcgcgcacggtgccggtgtcgggccggtcccgtgccgtgctgaacggcaagagcgccccccgctcggtcttggaatcactggcgtcgcagttggtgacgattcacgggcaggccgaccagttgcgcatcgccgccgcatccaggcagcgggagttccttgacatggtcgccggcgatgatgatctgttggcgcggtaccgtcattcatgggatgctctgcgcgatcttgatgaccgtctggaacggctgcgccatcaggagtcgtccgccagacagcgtgcggactatctgcgcgaatccatccagcgcatcaaccgcgccgacccccagcccggcgaggacgaggagctcaaaggccgtcgcgcccgcatcgagaacgccgccgatatcgcgcagggtgtcagccgggcgcttgcggcgcttgacgcctcccaggtggatgtcgacgccgattcatcgagcgcgtctgatctgctgaatcaggcgatctcctcattgcgcgacatccatgtcgacggtgatttcggcgaattggctgaccgtctggaatccctgaacgcggatctgtcggatatcgtgttctcgctgtcgcgtgagcttgacggcgaggagagcgtcgaggacctggatgccatcaacgcgcgcatccacgagctgggcgagctgacccggcgctgggggccgacgctgcaggacgtgattgcatggcgcgacaaggcgacgttcgaggtcgaggatctggacgcgtctcctgagaaggtcgcccagctgcaggacgagcgcgaagccgcattcgaccgggccctgcaggatgccggggcgctgagcgaggcgcgacgggccgcggcgcagtcgctggccgccaccgtcaccgacgagctgtcgtcgctggccatggccggggcgcggctcgatatccgcgtcacggatcgcggggaagaggcgatacccgtatccgattccgccggcgaggcctcgacatggccgctgaacgcgaacggccgcgatgacatcgaattcctgttcacgccgttccctggatccccgcagctgccgatgggcaaaagcgcttccggcggtgagctgagccgcctgatgctcgcattggagctcgccgccgcggatcggcgttcgagtgcggctcccgcgggcgagggcgggccgatgacgttcatcttcgacgaggtcgacgccggtgtcggcggcaaggccgcagtggagctgggacggcgtctcgcccgtctcgcgcggacctcgcaggtcatcgttgtcacgcacctggctcaggtggcctcatgggcggacgcgcagttcgtcgtgaccaagggcgcctcggacggcgggcagtccgcggtgacgaccacggtcgccgaggtatgcggcgacgcgcgcgcccatgagatcgcccggatgctgtccggcagcgaatccgaggcgtcgctcgaccacgcgcgcgagctgttggcatcatcgtcgctgacatagccgggacggccagcgcgcacgtacggaccggataaccggcaatagcggaaggaacatcatggacgacaaccacggcaaggcggcaatcttcgatcttgacggaacgttgctggattccatgggcgtatgggatcaggtcgacatcgatttcctcgccaaacggggcatcgaggtccctgccgactacatgggcaaggtggcggcgatgcagttccggcagatcgccgaatacacgatcgcccggttcggcctgcccgacacgcccgaggcgctgatgcaggagtgggatgacatggcgcgcgtcgcctattcgacggtggtggaggccaagccgcatgcggtcgaatacctgtcgtatctcaagcggtcgggtgcgaagctggccgtcgccacgtccctgccgccggcgttgcgcgagccggcgatgaagcacgtcggcattttcgactatttcgaccagattgtcagcgtcgacgatgcgaacgatgtcggcaaggaccgtcccgacgtgttccttctggccgccggccgtctgggcgtggtgccggagcagtgcacggtgttcgaggatctgctggtggcgatgcggtccgccaagtccgtcggcatgcgggtatgggcgatccatgatgattcttctgacggggactggccggatatctgcggtctcgccgacggcgtgctgtttgatttcagcgaggcgccgcgcagtctgtgaaccgacgcgcaactgttatgctctcgaccttgacagttgtccataagtgttctactgttatatgtaacagtagaacagtaatccggctgtgatactggagacacatggaaaggggcatagatgaaactgatcatctcatccgtgtccggagaacccatctacgagcaaatcaagaaccagattcgcagcgccgtgatgagcggcgagcttgaggtaggggaggccttgccctcgctgcgcaaactcgccaaggaactgcgcgtctccgtgctcaccgtcaccagggcgtacaacgaactggccgatgagggcgtggtgcagaacctccagggcaaaggcaccttcgtgatggacaagggcaacgagctgatgcgacgtcagctcgaaacccaggtccgcgaaaacctggccgaggcgatacgcgcggccaaagccgccgacatcgcgctgagtgaactgggccgcatgctcgaagacgagtaccgcaagcagtgagtgccggcattggccggcaacctgcgaacaccgtggcgtcgctgtgatacgcgaggccacgggacgagagagtttcccaaaaaaggaccatagccatgaccaccatatccgaacccgacacgatggcgaacgcctcggcgagcgacgcccgtccctcgcgcagcgacttgacctcggtcccggtcagcaccagtcccgcctcgtacttgtcctcgatcaggtaatcatgccgggccttgcggttctgtgcgatgagcacagtgccctgttcctttgccatggccttcctcttcaatcactcacatcaacacagacatcatgagaccagacccgcttgcacgggccgtgaccggacgaatcggaaaacaccacccggaactcagtaatgcacgtattggaaattaccagcattgtaaatcgtgcgccattgcgccacgccctgaaggctggcgccgcactcggagatcagcacggatccgtcgctgttcacacgctcgacgaccgccacatggccgtaacggctgttggcgccgagctggcctgcacggaacaccatcgcggcgccgacgtgcggcgtgcggttgaccagatagccgaggctgcggccggtgttcgcccaatcctgcccattgcccatgtatgagccggtgggcagatggtagtagtacacgcggcgacggtacgcataccacgtgcactggctccacgggtaggcgctgccgcccaccgtgttgccggtcctgtgcccgtagcacaccggcatgccctcatagcagttgccgggcaccgtgtagttcatgccgttggcctgtcccgatccgccgggctgggatccgcccgaaccggaaccattgccggaaccggaaccggagccgctgcccgacccgctgccggcgccgggcttgatctgctgctgtccgccggtgccggcattcgccgaaccggtgttgttctgcacgctccacgaatcgatctcggccttcatcgacaccagttcggcggcctcctgtgcttccttggtgctcaggctcttcttctgcgcttccagctgggcgcgttcctcgtcgctcttcttgcgcaaggcctccagctcactctgcttggacgccgcatcctcagcggcctgctgcgcgctggccgcctggctgtccgcctggcccttgagctgggtgatctcgtcctcgatggccgtgagacgttccttgcggttcatcgacgtgctgaggctggtggccgcggcgtcggcggcattcgcctcactgcgtgtgacagcggcatccgactgcatcttgttgacgaagtcctcggtcgtggtggcattggtcaccacgtccatcagggtggaggcgtccgagccgtggaagctttcgcgcgcgagctgagcgaccgcatccttggcgtcatcgtaatcctcaccggtctgcttgatcttctcctcaagcgaggtccggtcgttcttcgccgcctcaagccgcgccgtagtcgcctctgcgaggctcttcgcctgttcggccttctgctgggcctcctgtacggccttctgcgcggcgggaatctggttctcggtcaggtcattcaacgagatgatgagatcggcaagtttggaatcgacgccggtcagctgcttcttgaggctgttgtggttcgataccttctgctggtattcatactccgtaaccgcagcggcctgctcgggcggggcgaccacggccaccgatcccgcccccagagccattgcggcggcaagcgccaaagcggtgaacgtacccccacgtttcgccatcttcaccattgttgtcgcccttccattaatgccgtatttgaacgtattgtaacgaattaaactggataaatgcgccgcgtgtcatccggcagcgaaatgattcatctcatacttcgcgcatcccggacgacacgcggcggcaagtcacaccttgagatagcgtcgcagcgataccgcggacgcaaccgccgacagcagcatggcccccaccaccagcacgggggcggtcagccacaccgtcgtctgcgtgatgaacggcatccactgcacgctggtcgccaaccaatcggtgacgaacaccttgacgatgccgctcagcgcgccgaccgccagcagcgatcccagcagggacgccaccacgccctccaggatgaacggcaatcgaatcgtccagttcgaagcacccaccagacgcatgatctctgtctcgttcttccgggaggcggcgctcatgcgaatcgtcgtcgcggtcagcatgatggcgacgaccaccatgacaccggccagcacgacggtgaccacggtggcccggttcaacaccgagaacaccgggtcgaagatctgccgctggtcgacaaccgcctccacgcccgtgcgcccggtcagcacctccgacaccacctggtatttggtcgggtccttgagcttgagacgcagcgaatcctgcatatcggaggcggtgagggtacgtccctcgtacacgccgttcgggtactgcttgaggaacgtgttcttgaagaactcctcgcggctcatatacgtgatctttgacacgtcactgccgagctcgttgttgatcacgtcctcaagatccacgatctcctgctgggtcggcgccttgccggtcgagcaggacgccgactggctggtgccgtccgggcacagccacaccacgacctcgaccttgttgtaccagtcgcccttcgccttggtgatctgcgcctgtatcagcacggacgcgccgatgaacacgaaggagatgaacgtgacgagcatgaccgagatgatcatggacacgttgcgccgcaggctggtccaggtttcagacaggataaaacgcattctcatcgattgtcctcctcgttgcgagcaccgtcggcatcatcagcgctaccggcctttccggcatgcctgtcgcgatgccccggttgggccggcggcgccggcggcagcttgtgcgcgcgcctcggcttcgtctcgccctcctcatcggacgaggagcccggctccgccgccgaaccggcctgttcgctttgggatgtggattcatcctgaggatgcttcgtctccggctgaccatgcggtgcggcatcatccgccgaatgcggcggttccggcggctcgtgccgttccggctgggcggcgtcctccggctgcgcggaccgggcatcaccccgagccgtcgcccggtcgctcgactgagccgcggcatcggagtgttcatccccgccctgctcggcgcgggccttctgctcctcctgcgcggcaatctgctcaagcgacaggcctttgccccaggtcagcgtgtcctccaccgactggaacgcctcaccgtagcggccggtacgccccgaatgcacggagctcgccaaccgggcgatgccttcgttccggatattgccgctgaccgccttggcgaccacttcgataccctcgactgcaccctcctcgccacgggcctcgatagtggtgacctgtgcgtcgaacgagccggaatcagggcggaaacgcgaatcatccgactgcccgctgatcgcctcatgcgccttggacgcgacatcgctgtcggggaagaactcggcggaatcatacgagccctgggcctcgtcgcgcacgatcttgccggtatgcagctcgatgacgcgcttgcgcatcgagttgacgatctcctcgttgtgcgtggccatcacgatcgtcgtgccggtgcggttgatggcgtccagcacctccatgatgcccagcgacgtcgtcggatcgaggtttccggtgggctcatcggccagcaggatctgcggatggttcacatacgcgcgggcgatggccacacgctgctgctcaccgccggacagctcatgcgggtaattgttctccttaccggtcaatcccacggtctgcagcacctgcggcaccagcgacttgatggcggaccggcgcgtgccgatcacctcaagcgcgaacgccacattctgccacacggtcttgttcgccagcagcttgtaatcctggaacacgaatccgatggaacgacgatactgcggcacctgacggttcgtcagacggcgaagatcattgccggccactcgaatctcgccgtccgtggcctcctcctcgcgcagcagcaggctcagcagcgtcgtcttgccagaaccggaagcaccgaccagaaacacgaaatcgccacgttcgatgtcgaggttgacatcatccaacgccggcctcgtacccttgggatacaccttgctcacatgatccaatgcgatgagtgccatatcgtctcctcactcgcccccggagccgggagccaagtcacggtttactcttcctcttcggccgcctggcgacgctgctcgtgacgccagcggataccggcttcgatgaacgcatcgatatcgccgtcgaacacggcctgggtctggctggtctcgcaaccggtgcgcagatccttgaccatctggtacgggtgaagcacgtacgaacgcatctggtcaccccagctggccttgatgtcgcccgcgagctccttcttcttcttcgcttcctcctcgtggcgcagcaccagcagtcgggactgcagcacggccatggcggcggcacggttctggatctgcgagcgctcgtcctgcatcgtcaccacgatgccggtgggaaggtgggtgatgcgcaccgcggaatacgtggtgttcacgccctggccgccggggccggacgagcagtacgtatccacgcggatatcggtgtccggaatgtcgatgtgatcggtcgcctcgacgagcggcaccacctcgacggcggcgaaactcgtctgtcgacggccctggttgtcgaacgggctgatgcgcaccagacggtgcgtgccgccctccacgctcaggcggccatacgcatacggcgcatccacctggaacgtggccgacttgatgcccgcttcctcggcgtacgacgtatccatcaccttggccttgaacccgttgcgctcgcagtagcgcaggtacatgcgcaacagcatctgggcgaaatcggcggcgtccacgccacccgcgccggagcggatcgtcacgaccgcggaacgctcgtcatattcgccgtccagcagcgtctggatctccatgtcatccagctcctgggcgatggagccgatctcggactgagcctcgctcagagaatcggcgtggcatcgccggccacggcgccgacacgggccgcgccgccggcctggtcatggccgcgttcgccacgctcggcttccctctgaccggggtggaggtgttccgcacggaccggggcggcgggttcgacaacgcgaggatcgacgagctgctcgacgtgttcgacatcggaagatcgccgtcagggaagggcgacccgtacgacaacgccgtggtcgaatccaccgacaggctcctgaagaaggagctcatataccggaaccactacaccagcctggaacaactacgctccgaccccgacgactatgtgtggcggtccgacaaccaaagactccactccaccctcgcataccggagccccaacgaattcacacaacaaggactcgtcccctaaggaattgtccaacacgccgttgccaatccagcctttcgtctcgagctgcctgatactttgccggacacgcaccggcgtcgtcattcctttcctcccgaggaccatgtgctggtttctggcactcgggaatccatcaggaaccatacggcaccggcgcttttcttccgccgatgccgtttccagccgccgtccgcgtccaatatgaacgcttacgccgttcagatttggtggtgacgccgtacacgttatttgaccataaacacattggctccggctccgtggcctcgccgctcctttccctcctcatcctccaatgattggggatgacggacgacacagggtcggggtgatcggtgagcatgcagatcgctcattcgcagcatcgtttcatgtgctcttcggataggctcctgtgttggtcagtcgagcatgcgtttgaccgcggtgtcggcccctccctccagctggttcgtagtcgatggcagctggccgtccttcgcgtgggccgggtcgcagaaggcggtatctgtgcttcgtgaggttgattcggcgggttccagacatctatctgcgtttcaaggggctggtggcaaagtagccggggcatgagaaccgcatgattccaatggccatcgggtcgtcatacttcgaatatcgcgtttcggcaccccctcgaaacgcagatagatgtccggtgacgcaaaaatcaacccctcgaaatgcagatagcggtttcgaggggctgatttcttcggggggggggcgtcactcgttgccgatgacactgtttgagttcagcgacttgttcaccagctccttgtagtccttcggtgactcggcgttggacgcggcacccagtttcttgttggatgcctgcggctcgggaatgtcgatggtgctcttcggcccgaggccggcatccgtgcggcgcatcatgtcctgccactcctcgtattccacgccgacgtagctcacgccgtcctgctcgaatgcgtacgaggggcagccggcggtgttcagcgtcacgctcttgccatagaacttctgcccgatggacaggaagtccgtcacggacatatcggtcgacaggcccttcgagaactgacgtaccaaatcaggccacttggtgaccggctgatccaggattttgttgatgatggccgtcagcacgatgcgctgcgcctgggctctcgagaaatcgccgccctggaccttgtggcgttcacgcgtgaagacgagtgtctgctcgccgttcagcgtctgcgtaccggccttcagggacccgccgccgttgccgccggagaacgattccggcacgttcaccgtgatgccgcccaactcgtccaccagtgccaccatctgactgaaatcgacctccatgtagtgcgtgatcggcactcccgcaaacttagataccgcgcggatggcgccagccgcgccgtcatatgagtatgcggcgttgatcttgctgacaccaccgccgatgttgaccatcatgtctcgcggaatagagatgacatcggcctgcgcacgtttcgggtcgacgcggaccagcatgatgctgtcgctgcggccgttctccttgttgctgcgcctgtcggagcccatgagcagcgcgtagaacgcgctgcccgagttcggctcgggcccggacagtgccgcttcggcctccgcgttgcgcatcgcgatgttctcgtcgaccatgtgcgcgtaccaccagattgcgatcacggggaagacgaccaggaccagcaccagggcgaggacgaccagaagcactgccaggcgacggcgcttcttctttcggctgccgctgcgcgaaccgcgcgaatgggaacgggaggatccaccgctgtggccactgccgccgctgcgatgcgcttcgccgccctcgtggccttcctgacccagaatcggaccggccgcgggggccggatccgccacgttcgcgagcatatccgcgtcattgtccgtggactccccggcagtgtcgccgtcggccgattccccggcttccgcctcttcctcggccatcttgcggaaaaatgctgaagatcgtcggtcatcttgtcaacaggtgtatttggcctgtttgcagtcatctgctcttccatctaggccctcgccgcgcaagtctgcgcccgcggcggaacacgtttgttccaactcgcgggaagactgaataccatcccccgcgaatctcctccaccatcataaacttacgcaatgattggacagtttatgcaggttgcgcggctctcgccagcgaccgtgcgttttgtggcccttccatggcgacaacgcggttgtgatggtgacgcggtgacgatgctcatggcctgtggaagcgatgacatgctacctgggcgtatcggcgcatgacatggtcaggacggtaccgtatataatggcgtgaacgttgaatatgccggtgaaacggccataatagggaacagaaggccgggcgaatcccggaaagcggacatgaatcgggggcggatgatgaacgagcatgaagcgcatgagcgtgatatgcaatgggacgatgccggcgacggcgcgggactgcccgaaacaggggagcgtgacgctgtgcagggcattgaaccgggcgccgagcggcatgcggccgaatataaggccgtagcgctgggcgatgccgtgatcggttctgccgccggtgccagtggcgatgttcccggcactgacgttgctgacgatgccgtggctgctgatgccgccggcgctgccggacagcaggccgcagatgatgagggcatgcagttcctcgacaatcccgcgtgggacatccccgacgtgatgttcccctcgatgggcggtgtcaaggacgcttcatcggggagcggcccatcgtatggtgctcccagtccctacgttcccctgcctgaaccggaggacaccgtgcggccggtgcatggctctgcctccgatccgctggggctggaggacgtgtccgatatccccgccgtgccggaggaggaagagccgcaaggcaacaacgacgtcactatggtgatacagccgttgagtgctttccctacgcccacgcagagcgtgccacctacagccggaatgacgccgcagaccgtgccactgccgcctgaggcgggcgcggcggtgcctcctcatgggagcggagagccgggcggcaaggcggacggcagttctcgaaagcaacatggccaccgccgcgctatcatcatcgccgtcgtcgcggtcgtcgtcgtggcgctcgccgctacgggcggattcctgtggtggcgccacatgcagaaccagaacgagctcgatcaggcggctagcctgtgcaagacctcgaagaccaaggccgacaaggcgttttccgaattgcagtccgcgctcagcgaagccaagcctgcgcagcagattccgcaaggcgatgtgtccgatccgaccgtcctggagacgctgaacagcgcggtcacaaaggcgtcctcggccagcgagccggtctcgtgcgacgtggcgttgggcaccgagacgctgaacgccaatgccagcaagaacaagcagatcgcgcgcgccagcaccaaggcgaagacgaacgtcgccaaggccaccaaggctgtgaacgacggaaaggcggagaaggtcgagtttatcaagcatgaactgcagacggccgtcaccggcgcgcagaagatttacgacgacagcaagggcgttgtgctggacgactcgaccaggaccacgctgcagtccgccatcgatcaggcgaacgcgttgctgcagcaggatgacgccgatctgaacgagatgcagcagtctatcaccgatgtgaaggacgccggagacgcggtgaccgtgtcgatgaacgagtacaccgcccagcagaagtatctggagcagcagcgccagcaggagcagcagcgccagcaacagcaacaacagcaacaacaggacgaccagaacgacaatggcaacgacctgaacggcagcacggattcgcagatcggtgattcgcggggtcacgagacccagccgacccacccgcaaggtagcgacgactgatagatggtgattggcggtcggccatcctgtttgaccacccccagtcgcttctcgacagcccccgccagcggggggctgtcgagaagcgactgggggtggttcatatagactgcccactcttgtcggctctgccgtgaacggcaggtttttgcgtcgttatgtgcgcgtacgggggtgcggatgtttttttggacggttagacggccagtccaaggtgtttgcggtattgcacggggctcagccagcccctcggcggccgcgactcgaagctcgtgcacgatctggccgcgctcggcgtcaccccggacgacatcgccgtggtctccaagcacgacacgtccaccaacgcgaacgacccgaacgagtccgagctgcacaacacgctggcgcacgccatcggccgcacgaacggcaacccgctgttcgtgatctcccagaagacgctcaccggccacgcgaagggcggcgcctgcatcttccaggtcaacggcctgacgcagctgttcaagtccggcgtgatcccggccaacgtctcgctcgactgcgtggacccgaagctggagcgcgacgaccacatggtgtggctcaccaagccgctgcacgtcggccgcgtcaaggccggcctcgccacctcgctcggcttcggccacgtgagcggtttcgccgcgatcgtgaacccgggcgccttcgaggcggccgtggcacacaccgcgggtgaggacgcactgaacgcctggcgcgagcgtgcgaacgcccgtctggctgccggccagcgtcaccttgaggaaggcatgatgggtcgcgcggcgctctacgagccgatcgacaaccgtcgcttccgcgaggacggcaccaagctcgccgacggcaatcgttacaacggccacgaagtcgaaaaggccatgctgttgaatcctgacgcccgcctcggtcagtccggcttcttcgaagcctgatctgccgagtcgttcgtcaggattccctcgcgggcgcaggtagcgcgcccgctcgcttcgcctacggggagttcactggactccccgtttgatggctcagcctgacgcccgcctcggtcagtccggcttcttcgaagcctgatctgccgagtcacgtctgactgctgaatgatgggcccgcacgtttccgcgtgtgggcccattttgcgttcgtaagtgcgcgccgaaacgacgtgtccgcgcacatagcgacgcaaaccagcccatttgcgtccttaagtgcgcacacttgtcgtttcggcgcgcacttaaggacgcaaagcggcccggacccgtcatacactggaacaggtctctcggaaaggtggcgcggtatgtcggttctcggtctcgggcacgatgtcgtcgatgtctcggcgttcgccgaacagcttgcggaaccgggttcgcgcatgcgagggctgttctctgtgcgcgaggtgaggcaggccggcgagcgggccagacgcaagaacgatgacgagtccacccacttggcggcgaagtgggccggcaaggaagcggtgctgaaagcctggtgcgacgcgctcggcgacatgccgaacccgtataccatcgagaatttcccgtggaacggcattgaaatcgtggatgattcgcgcggccgaccgtgcgttgcgttgcggccggacgtcgagcggaagctgcgtgcgtcgctgccccccgcagcctccagaaactccgatgaaatgtcgggcgcgcccgggttggtcaggatggggcctgcggtcatgcgggtgccgatcgtgactccggtgagcacgggttccgagccggctgcggcgtcgagcgcatcggtttccttggtttttcggtggcatgtctcgctgagccatgatggcggtatcgcctcggccgtcgccatgttgaccgtgtgacggcggttttcggcagtcatgacgccgctatacggacagttctcagactctttgaagacgacgctcgaaataagcgtgcgtcataggtatgtatgcaggcggatattcgttggggcgtccgcaggcatcggctggcgagtgtacgccatccatgtcggggcagaatccgacatcgggctcgtcggctgtttacggcccgctggtgcgaggctcgggcaagactcccgggagacgcaccagcgggtcgtatcgtatgcggccgacgcttgtgtgacgatacatccgttttgacgctgccatatcttccggcgtacagtatcatcatgattgccttacacaaagtcgcagcgccgcgacttgaccggactgcgaaagcggcggacgaggtggccgcctatgaacgcatcgattccacccatgcgaaggcacgccgactcatcgagcgggggaggttcgcgcgcaacgatgacggcggcatcgccatcaccgtggtcgccgccggtgccatggacgacgcccgaggacggctcggccggccgtgggcatgcgttcccgggcactcgttcgccatatcgttcatcgtgaccatccccgaatcggtggcgaccgatgacgcagtcaacggctggatgtcgatgattgccggcctggccactctggacgccatcgaaggaaccctggacgagtgcggcgcggtcccgttcgaccccgaatgcgggttccatctcaaatggccgaacgacatttactgccatggactcaagcttggcagcacgttcacccaggtcgcctcgccgcccgaccggcacggtgacgtcgccgtgatcttcagcgtaggcgtcaacctgtcggtgcccgcggatcgtttgccgacgccggaatccacgtcgctgcggatgcacgtcgcaccgctgccgccgaccgcggaactgattgacatgatcgcggcgcgcctggtcgcttcactgcgcacccgtctggaggcgttcgtgcagatgccgctcatccagagttcccggttgcgctccgagatgcaccacgtctgctggatgatggggcggcagatcgacgcgcagctcatcgacggccggacgatcgccggcaaggtggtatcgctcaacgatgacgcttcgatcagcgtgcgcacggcatcaggggagacggagaggctgagcaccggcgatatcggtctcatggtgtgacgcctgttccgacggtcctgttttgacggtcccgttccgcatggacacgggagttgccaaagtgtcggcgatgtgtataatagctcaagtcgccaaaagcgacattttcgcggatgtagctcaatggtagagcctcagtcttccaaactgattacgcgggttcgattcccgtcatccgctccactgccacttcaccggcaaatccggccgtccaatcgcgtttgacgtgattcgatagtaagactagcatgactaatcggaacggttgagagaacgcgtcgtcgatgacgactgccacgagaagctgaaatatggatcgcggcatctggcgaaaacccgcgggaacgcaatcgtttcgccgcacgccagatataccgcagcgacgaggacaggcccaccgggatgtgggcttggtcatgtgatgaggcatatgcgcgggcggtgcacagtatcacaagaacagctaaggaaacaaatgcgagcgaacggtaattccacgcatgagattctaggcaaaatcgtgacggccatcgcgtcgatcgccatgaccgcggcgttcgcggttccggccatggcggccagcgacagcgacacggcggccgactccggcacgacccaacagtcgggccagtacaagatctacccccagccgcagaacaccgagtatggcgacggcagtctgattctgcgcgacaaggcgaacaccgtcgtggaaccgggaatcgattccgccaccaaggcccgtctgaacgaggccctgaagctcaagggcatcgagaccaccgcggccgacgccgtgcccgaaaccgcgtaccagctcaacgtgctggtcggcatcaacggatccaacggcgtggtcgacaagtacgccaagcagctgatcgccgacggcaccctgaaggtggacgacagcacgttctccaagaacgactcctatgtgcttgccgtccgtcagggcaacgcgaagacgcccgacacgatcctcgtgctcggccgcgacaccgattccgcgttctacggcctgactaccctgtaccagatcttccagcagctgccgggccgcgccgtcagcaacctgaccttcagcgactgggccgacgtcaagtcccgcggcttcatcgagggctattacggcagcccgtggagcaccaaggaccgcgtgaacctgatgacctggggcggctactacaagatgaacacctacgtgtacgcccccaaggacgatccgctgcaccgcaacaactggcgcggcctgtacaccgaagaccagatcgagaacgagatcaagccgcaggccgaggccggcaacaagtcgaaggtgcgtttcgtttacgcgctcgcgccgttccataacgacggcgaggctaggggcaagcacttccgcttcgacaccgaggagcactaccaggaggacctcaaggaactcaaggccaagtacatgcagaccattgacgccggcgtacgccagatcgcactgctcgccgacgactccaccgactggggtgcgcagtacggcaacgacaacacctacgtgcgcgtgctgaaggacctgaccgactggatccacgagctgcagcaggagaagaacgacgacggcaccgcgaagtacgagggcctcaaggacacgatcctctactgcccggccctgtacagctacaccggagccggtgacgcctggtacaaggacatcccatccaacgtgcagatcgtcatgaccggcggccgcaccttcggcgtggccagcaaggacttcgccgacacgttcaccaagaacaccggtcgcgccccgttcatgtggatcaactggccgtgctcgagaccgctgtcgcccgtggcatggttcgggttgaatccttcgggcagcttgccggcatcctggtcgaccagcaccgcgacctgcgggttgttcgccagggagcgggacagctggctcacgtcgatggcggagttcttgtcgttcagctcccagttgccgttattggtggtctgcacggatttggcgtcggcgatcgtgttgctcgtcttcgcgtcggccgcgccgctcgtggccgcggctgcggtctggtcggaggcgatggggccgagctcggtacgggattcggaacgcgagaccgtcgaaccggtcacgcgggccagctgagtggtcgtcgtggcgggatcgtcggccagcagacgagagttggacgactgctggatattggaaaaggccaaggcggtggccgcagtgccgaccagagccgcaagggatgcggatgacatcatgtacgacttgcgctgcgcggccttcgcggtctcgcggatggcccggcgggtcatcggggcgacctcgttcagcttggctgcaagaacggggtcgatggcgagcgccacggcatcgccgttggccgcctgcacggcacgcacggccctggccgtgtgggaaccccgggaggagcggaataacgccgaagggctggtgcgctgaacggaatccttattggccttatgcgcagcatgcctcatactttttgctcctttaataccatcgcgatgcggccttccgaagacgccgcacgttcatcacggttgaccagcttaccgcggggtgcggccatcggcaacccgaccgcatccgacacatgaacgccgacccccatcaatccgcatcattggctagtgttgaacatatggacaatatcgtgaacatcccgtcctcaatgaagcccgaagacggacgattcggctccggccccagcaagatccgccccgagcaggtggacgcgctcgaacgcggcggcaagacgctcctcggcacctcacaccggcagacgccggtgaaatccctggtcgcctccatccgtgaaggactcggctcgttcttctccctgcccgacggatatgagatcgcgctcggcaacggcggcgcaagcgccttctgggacatcgcctgcgcgtcgctcatcgtcggcaaggccgcattcggcacatacggctcattcagcacgaagttcgccaagtcggcgcagagcgcgcccttcctcgacgaccccgtcatcttcgcgggagagccgggcacctatcggctccccgagcgcaccgacggcgtggacacctacgcgtgggcgcacaacgagacctccaccggcgtgtcggcaccggtgcggcgcgtggaaggcagcgacgagcagaacgcgatcgtcgtggtcgatggcaccagcgctgccggcgcgttgccggtggatgtcagccagaccgacgcgtactacttctccccgcagaaggcgttcggctccgacggcggcctgtggatcgcggtgctgtcgccgcgcgccatcgcacgtgcgcagcaggtcgagggcgaagccaagctcgaaggctcccgccgttgggttccgccgttcctctcgctgacctccgcgctcgacaacgcacgcaaggatcagaccctgaacacgccgtcggtcgccacgctaatcatgctggagaatcaggtgcgctggctcaacgagaatggcggcatggcctggtccacggcacgttgcgcgcagtccgccgcgctgctgtacgagtgggcggagcgcagcgaatacgcccggccgttcgtcgccgacccgggctcgcgctccaatgcggtcgtcaccgtcgacctggatgacgcggtcagcgccaaacaggtcatcgccgcgctgcgcgagaacggcatcgtagacacgtccggataccgcaagctcgggcgcaaccagctgcgcatcggcgtgttcccctcggtggagccgtcggacgtggccgcgctcaccgcgtgcatcgattacgtcgtcgagcacctgtgacggacgcggcagcaagagccgcccgatcatcaaggactgaacgctcgggcgggtgccggtgtatgtaccgccacccgcccgattcatcccatgcgctaaggtatataggtatgaaattcgcagccatcatcaatcctgaagtacgcaagccagcaccgaaaccggtgcgtgtcgacctgcgcaagacgttcctcatcggctgcgtgctgtggtcggtcgcgctgatcgtcagcgcgatactgctcgcgtgcgggctggatgtgctgcaattgctcatcatgtgcgcggccggactggtcatcggcgtcatgatgctggtatgggagcatttcgaccgctgggattaccggcgtctcggcaactgagccgtatcagtcccccaccggcagcgacagcgtgaacgtgctgccctgcccgggagcgctccacaccgtcacatcgccgtgatgggcgagcgccgcatgcttgacgatcgccaatcccagaccgatgccgtcggtcgtgcgctcgttctggttggaaccgcggtagaaccgttcgaagatacggggcagatcggccttcggcacgccctcgccatgatcgatgacacgcaccacggcgttcttcccgtccgaagacagggcgacggagacgccgaccgccccgcctgggtgtgaatacacgatcgcattctccaccatcttgcgcacggccatgcgaatctgatcggcctccccgtgaatcatcacggggctcttgccgccgacccgcacctgcaccccggcatcccgcgcagcgccggcaagatcatccacggccccggaaacctgcgagaacaggtcgcaacggttcgcctccgaagccgtcaccggctcctgagccttaatcagcatcagcaggtcagagatcatgcggtcgagccgcacacaggaatgccgcacctgccgcgcgtggttcgacagctgctcgtagctcacgtccgcgctctccaacgaatcggccagccgctccagcgcgcgggtcggttgcagcagctgttcggagacgttcgatatgaacgagtctcgaatctgagcgaaccggatcgactcgctgacatcgttgatcagcacgagcaccagatggtcgccgatgcgtcccaccgtcaccttcagccagttcggccgagacgaggcctctgcggtcaggccgtcatcggcagccgcggcgccgaatccgttcatcgtcatgaactgctccggcgtctgagtctccaggtcgaacgagcaccgggaaccgtccttcatcaccttgtgcaccgcgtcaagcaacgtaggttcgatcagcgtgtcatcacgcaccaagccgagtctataggccgcaggattggcacggaccacctcgtcctgatcgtctaccacgaccgacgccagcgagagcatcgacagcaccagctgggtggagtcatccagatcatcggccggctcgtcatcctcctgacggcggcgcgcgccgcgacgccgagactgcaacgacggcaagcggtcattgctgcgcagcgcgttcatgatgacgggctgcagccggtccgcgatgaaaaagccgattcccgccaatgcggccagcgccaatagcgcgaaaactacaaaaatccataccgacggctgaaactgaggcatggttccattgtctcacaccgagaggcgacatgcggcgaacgtgaattccgggtgaactagccaatgaattttgagacaatttcaagaacctgaccgccacgcactaggcaaacacagcttatgcggcttacacttgatagaggttccatcaagagcaactacatagcatgaaaggctacaacaatgcgcgttatttttgacgaggagctcaaggccgttgccgatgacctcgatcgcatggtgcaagacgtgcgcaaggccatcaacggggccggagacgccttgctgaagcaggatgtcgaagccgcccagagcgtcatcgacggcgacatcgagatcgatgccctcgaatccagcgtcatcgaccagtgcatccgtctgctcgccaagcagaacccggtggcgaccgacctgcgagtcgttgtatcgacgctgcggctcgccgcgaccttcgagcgcatgggcgatttggcgaagcacatcgccgaagctgcacgccgcatctaccccgaaccggcgctgccggccgaggccacggagctgttcaccgagatgcagcagttcctgtcgatgaccgccgaccgcatcgtcgtcatgctgcaggaccgcgacgccaaaaccgccgaggagatcatcctcgacgacgacaagctcgacgcgctgcaccacaagaccttcgacctggctctgtccgacaagtggaccggcagccgtcagcagctgatcgacgtcgtgctgctcggccgcttcatggagcgtctcggcgaccacgccgtgtcggcctcccgccgcgtcgtgtacatcgtgtccggcttcgatccgagcaaggagccgtcgcgcgacgaggacggcgccgtcgagtgacgacgaccgcggcgatgccgtcaccggcattccgccagtgtatccgcgctcgatctcgccgaccggatcgggcagcgaggccacgtggcgaacgccttcggcgctggcggcgatgcgcggctcgtcgaaccggagacggtcgagcttcccggcgtccatgccgcgagcggctgcggcctgcatgtcctgcccgttggcggcggcgatggtcgaggcgtcggcgtccagcgcatcggcgatcgcgtgcagcagggcgtttttcacctgggtgtcggcctgcgccagatcagattgggcgcgtgcggcggcgtcggctttcgcgcagacgccggagaacacctcgccgttcaattcatctttcgtcataaagcccagaataacgcagattgcgagctttgcggggcattcgtgtcatcatgtcaatatgggggcacgtgtcctgcggccgcgacgcacgccagggtccatgccagtatgcggtacccgccgccgccatgcccacgcctgacggtagacttgagccgaacttcatcccattcagcagcaacgcaaggattaccagtgaccacgttccacagcacgcgcagcaccaccgactcacttacctccaagcaggccatccgcaagggcatcgccgacgacggcggcctgttcgtgaccgattccctgggcgagacgaaggtggacatcgcttccctgacaggcaagccgtatcagcagatcgccgccgaggtgctcggtgcgctgctgccggacttcaccgaggccgagctcgcgcagtgcatcgccgacgcttacggcgagcagtggtccgacaggcgcatcacgcccctgaagccgctcggcgacgactacatcctcgaactgttcaacggcccgacctccgcgttcaaggacgttgcgctgcagatcctcccccgtttcatggcgcacacgacgccggcggacggcgacaccgacgagaagatcatgatcctgaccgccacatccggcgacaccggcaaggccgcgctggccggattcgcagacgcgcccggcaccgcgatcaccgtcttctacccgcagggcaaggtgagccaggttcaggagctgcagatgagcacgcaggccggcgcgaacgtgaacgtgtgcgcggtcgagggcaacttcgacgacgcgcagtccgccgtcaagcgcatcttcggcgacaaggagctcgccgcgaagctcgccgccgactcgcacatcgtgctctcctccgcgaactccatcaatgtgggccgtctcgtaccgcaggtcgtctactacttctccgcttacgcgcagcttctggagaaccaagtcatcaacgtgggcgacgaggtcgagttcgtcgttccgaccggcaacttcggcgacatcctcgccggctactacgcgaagatgctcggtctgccggtcaagcacctcgtggtcgcctccgacaagaacaacgtgctgttcgacttcctgaccaccggcacgtacaatcgtcagcgtccgttcttccagacgatcagcccgtcgatggacatcctcatctcctcgaacctggagcgcatgctatactacatgtccgagggcgacacccgtctgatctccatgctgatgaatgacctcagccagtggggcacgtacgaggttccggagccgctgctcgcgaagatccgccagctgttcggctgcggctgggccgacgaggaccaggtgcgtgagatgatcgccgactgctggaagaagaaccgctacgtgatcgacccgcacacggcgtgcgcgtacttcgtggctcagcaaatgccgcgcgacccgttgaccccgcgcgtgatcctgtcgactgcgagcccctacaagttcccgcgcgtggtcaacgaggcactgggcctggatgccgacggcaccgatttcgaatgcatggatgtgctgtctcgcgagaccggcaccaccgctccagccgccctgcgtggacttgagaccgccgatgtacgtttcaaggacgtcgtgcccatcgacggcatggaggattacgtcgaaaaggccgcccaggcgctgtaacagctcagcccgccagcaggggcataaaggggcttacagctctttggcgcggtagaagcggatggccagagcggcggagatgcagtagacgcccacgcacagcacgacggcaatcagagcggcacgccaccatacgctcatgaaatccgcgacgccttgcagcaagccctgccaatcaaacggcaatctggacagcaacgcgacgagtgcatacagcccgactatgaccacaacgaatatccgcatcatcgcccggaacgtgaaccggtacgaaaacgccatcagaatcgatccgacgatcagggagaacgcgaagatgacggcgctcggtatcatggcaccggcccagccggaatccatcatgtcgccgaaggcgaagaagacgctgcatgccatcacgtccacggtccacatcgcgcaggtcaccagcagaaacaggaaccgtccggccacctgcgacgtacgggcgatgggaatcatcccgttcatggcccgatgaccgccgctctcctccgcaacattcacgctcaaggcggacatccacgacatcaccgcagccatgccgcatacgccaccgtagacgctgacggcgacctgtccgggtgcgccggtcacggtcagcaccagcgcggccacgcaggacagcacgggaaacagcaacatgaacaacatgttggacaacccgaacaaatccactcgcacgcaatcgaacctgcactgcctcactacggaactccagcgcatctcaccactcctttgccttgtacacgcgcacggcgatcgcatacgagaccgcatacgccgcggcggagaccgcgaccagcatcgcggacagccagaaacgatgcgagacgacggcgtccaccacgcccatcaccttggcgatcatcgatacggggaggactgacgggatgaacgccccgatcaacgtgacgacatagaacacccacaccgtgatctgcagtccgatgatcttgtcccacaaacaggaaacgggcatgatcaccgcaataatcagcacgatggccagaccgcccacgccggccacccacagattgcccgtgaatgaccaatcacggcggacaagcggctgcaccccatcgatcaatgcaatcaccacggccccgtacacggccagagccagtcccatcaagtaccgcgaggccatctggttccgccgcgatgcgggcgccaacccgcgcagccgatacccgctctgcatgtcgatgagcggcacggtcagcaccatcatggcgggcgagaacaccgccatgacgacgcccaaccggaaaccgaagccgtcgacgaacgccccgccgttgaacatgatcgaaaacaccggtgcgagcagcaccgaggcgaatgattgcatggcgccgtcgcccagcagatacgccaggtccagatgcaatgcggtcgccagcccacgatttccccgccgtgcccgtacggcacggaatggcacggtctcagtcaacgttcccatggccgacctccttgagtgcagacgcggcctcgggcgaagacgcgacggaatcacggacgttggtcaggcggatgatatcgtcgatggaggccggctcgacgacgatatcggcgacggctgcgctgacggtgccgaggctgtcggagcgcaccagtgcatcgaaaccggtctggtatgtgtgcgagccaagcaccacgccggcaggcagctgggccaactcgcccggcccgcccttgactatacggaacgattcctcgaattcgtccttcggcccggtgtagtagagccttccaccagtgatgtaggtgatgaagtcggccgcacgttcgaggtcgacggtgatatgggtgctgaacagcaccgaatgctcgccgtcctcgatgtaggcatgcagcatgtccatgagttcgtcgcgggcgagcacgtcgagtccgctggtcggctcgtcgaggatgagcagtttggcgtcatggctcaacgcgatggcgagcatcagcttcatctgcatgcccctcgaaaggtccttgatcttcttcttgccgttctgagctcccccgagaccgaaatcgtccaggtaccgccgataccgctccccgttccatgacgggtagagcggggcgacgatgcgctcgaccttcgagaccttccactgttcgtacaggtagctggagtcgaacacgacgcccagccgttccttgacggcctcctcgtcaatgatgttgtcgaggccgagcacctggatgctgccgtggtcccgtcggatcatgttgaggatcagcttgatcagcgtggattttccggcgccgttcgggccgatcagccccatgatgtagcccttgggcaggtcgaaggtcacgtcgtccagcacgaagccggagtcgtagtgcttggtgacgccggtgaccgcaagggccatcgtgtcgggttcggatatggtggtcatggctatggtccttttttgggaaactctctcgtcccgtggcctcgctcaggcatgacctacgacggattctcggaacatgtgcgcaccacctggcgcaacgccgccgcctacgactggtcgaagctcatggccgaaccacgctccacgggcgaatggtcgtccgacgcgaaccggctcgccgtattgggcgtgatgatgcagttcgcgcccgaatcaacatgcatgatgatcgccagcgacatactggccgagaacgctcccctatcccttccggcattgcgcgaacgcatcaatacgccggacggcatggtgaacaccgacctgctgttttcccggctgatcgacaacggcaccacgcccgatccggcgcgcatcgacatggcgatggggatcctcggcccgttggaggccaacgcgccgacggacgcctgctaccggatcatcggcctgaaggccatgctcagcctcgccatgggcgacggtgagaaggcgcgggaactcgccgaacaggccatcggctacgacgcctcggaccggttcgcgtcaagcgtgctcgaccgtctgccggaaaccgatcccgccatggaggtgacgaacgtgtgggagaacggcgggcatttggggcgctgacgtagacgccgtaccccgcgatgccaccggtccggccggatgatgggagtcgccgccgccattgaaggcgctggtattccccgaatgaaaggaccatcatcatgccacagtcaatgcaagtggttcgcggtctcctcgccgcgaaccccgattactggccggcgaaaaccaacgcggacggcaccacgagctcggcgtacctgcgcgccaccgtgtatgaggaccgcccgcgagtccgtcagaaggacggcagctatacggacaatccgctcggcccggtgagaaccaccgtgaaattctggggccaggctgccgagctcctgcacggcatggatttccgccagggtgacgccgtggtggcgaccggccgcatgggcgatcccgacgccttcatcagccagaaggacggtaaggcatacgcacgcccggtcgtgatcggcgattccatgcagatcgattccatcgtgtcccagcgcatccagctcgcccgcgaacgcaaacgccagaacaaggaacaggccggtgccgtggccgatgccgggcgaacggatccatggacggaccaggttgacgcctcgcgcggcgaatacgttggcgacggcgttccccgcactttcaacggcgagcccttcgaaccgctgtcgggctatccgacaccgggcgcggctcccgctccggcggaccctgcggcaccggatttcctttccaccccatccgatttcacgacgggcaacgcccgctagccatgacgcaagccctggcgcatcgacggcgggaccgcttccatcggttccgccgtcatgcttgaaaggagaaatgaatcttggccgacgtcgatccgaaactgcaatcgaaccgagtgaaggatctgggcggcacggtccgtcccagccgcaagatcgaactggcgatcatcgtcgcggtgtccctgatcctcacgacgttcgccctcgtgtgctcccatgcggggcatcccttccagatcttcgcgctcatgtacctggtctccggccaatggtcgctgaccgcaggccagtgggcgctggccgtggccgtgctcgtcgtactggccgtggcgtgcggcgtgggcgcgtggctgatcgccagcaaggccgtgccgtgggcaaccggcgccaaggcacgcacccgcgtggacgtgtacgcgcctgccatgggccatggcgaggccgtggagaaggtgacgcgccagcgcgccgaggccatggcgtcaaggctcatagaagcggaccgctaccgcaagggcatgtcgccgggatatccgctggggctcaacatcgtggacaacacgtcgatgtacaccagctgggaggacatggctatcgttctggcgggcccgcgttccggcaaatccctgtgctacgcgatcccggccgtgctctcggcaccgggcccgtgcctggcgacctcgaacaagggcgatatcctcgacgtgaccgccccgatccgcaggctcgaccatccgaacggcgaaatatggacgttcgaccccgaacgcatcgcggacccgaaccggaagagcgcgccgtgggtgtgggacctgatcgcctcggtgcagtccatcgccgacgcgaaacgcatcgccgactgctggcgttacgcctcgggccagccgcagaccggcggcgacgacttcttccccggcaccgccgcccagcagctcgccgactacctgttcgccgcgcatctgggaggccgttccgtgtccgacgtgttcaggtggtgctccaacgagcgcgacacgtcgccggccgacatcctgagcgaatacccgcgctacgcgggcatcgcctcgcgcgtgtccagcgtgatcgcgctgacgccggaaacccgaagcggcgtgttcggcagccttcagaccatggtcgcgttcctcgcggaccccgagatcatcgactggatcgacccgcaccgggatacgaatgggaacatcgacgagcggcgcggcctgttcgacccctacgagttcgccacgagcgaggacaccctgtacctgctttccgcacagggccgtccctccaccgcgttgaccgccagcctgacggcggtggtggcgttcaccgcgttccaacgcgcccaatccgagttcaccggcaacaaccgccgtctgccggtcccgttgtgctgcgtgctggacgaggccgcgaacatctgccgctggcccgaactggccgacgtgtactcgtatttcggttcggcgggcatcccgatcatgacgatctggcagaaccccgaccagggcagggccgcgttcggcgagacgaacttcggctcgctgttcaacaacgcgaacatcaccgtctacctgggcggcatcaaggacgcgaagttcctcggcgagatcagccagctggtgggccagagggagatcgtgcgaggcagcgtcaacatcgacggcaccggccggcgcagcgtgaacaactcgatccagaaggagaacatcctcgacgtttccgacctgaccgaatggcccgtcggccgcgcgctgctgctcgcatcccaatcccgggcgcagatcgtcaagaccctgccatggacgggcaacaggcaatgggccgacgccctggcgcaagccaaggcgaaagcccgagaagagcagagaaaggccgcataatgagcgaacacacctcgaacaccacgtccggccctgatggggaggaatgggagcgcgcggtcggtgccgccaggaccctgctgtcatcggactgcggatggctggaactgttcacccgcgccatcctggaggagaagggcgtgccttacggcaagggactgcccaaccccgaagcgccgcacatccccgaggacaaggagatcgaagaggaaaccatgccgggccaaggcgagccgacgccgaccgcacccgaggtgccggcaggccggcacgcggcggaacccatccgatccgggattccggccgatgccggggaaaccggcaacggctacgagaacccgccggaagacgcaacggaccgtgacgacacccctccaaaggccggtgcggaggaatccgacacccgtatactgcccgcgccggaggggaagacggatctcggccgagacgaatccggcgacctcgatcccgcgcgggcaagggacgtgtccggccagttcggcgcgcgaatgcggcgcagcgagacctactatccgaacctcgccgcgttcgtggaaaggttcgtggccaacgtgttctgctaccaccagagcgcatccgtgaacatgcaatgggtgagcgactggtggcgctatccggcgctcgtgttcccgctcgacgccatgtggcgcgcctacgagaacgcgcgcaaggcacccggccagatgatgatcttctacatccaggcggcgtcgatgctcgaccgcgttttcgacaaggaccgtggcatcgtcgccagcctcgactgcaagcagaatctcaccaggaagggcgaaccgctgccctgcgaacgcccgaaccgggcatggcgcgaaccgatcctggaaacgttgtcggtccccgccgcaggcggcaaggaaaacaaggaaaccaccatcacgccaacaaggaggagaaacaatggctcaaactgatcccgaggacggcttcgaccagatcatggtccagagctggaacagcgtcgcccagcagctgcgcaccctgcacaacgagctgagcggcgaccgcgcgcgccgcagggaacgcgccgaacgcgccgtccagaacgaacgctacgagcagaccatacactcgacacccgattgccaaccgggccgagcggacctttgagcgcctccgttactctttgggaggcaaccgccccagttgaactacccgccaggcactgtccctgaacaggatgactgttcgaggttagacatcaaacgagaacagagcggtatttcaccttgcggctccgcggatgctggcgcacccgcctcgaagcctcccgcctatgctacacaatccgcgcctaatgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcgcagaagctgacggatcctcttaaccttccggcaccgggcaggcgtcagagcgtatacagcggcttgcgccttcgcacgctcctgtgtttttggtaaacagtcgctaccccctggcctgtgccaccccccgccgctcatcaccgcagggggtctcccttatgccgaaggcacgggagcaatttgccgagttccttgaccaggattcgctcgatcgctttggtattctctacctgaccaccagtgtcggtttggggtacgggcggcaacgcgcctgacgccgaagcttttctcggcaccacggatcaccggattcgggccgtaaggcccccatcatcacgcctcgccccgacgccccgcggatttgcctgcgggacgggctcgaacgcttgaccacggaaaaccacctccgcggccggctgccctgatgcgtcactcctgcgctgacctactacgaggggggatcccaacgcgcccgcgccgcgaccccccgaaaggggagacggcacggacccggaggttagcgccccaggcctcggttgtttcggttcgctgccggtacgggaatatcagcccgttcatccattcgactacgcctgtcggcctcgccttaggacccgactcacccggggacgacgaacgtggccccggaacccttggtcatccagcgggcgggattcgcacccgcctctcgctactcatgtctgcattctcactccccaacggtccacggcaggcttgcgccgccgcttcgccccgatggggacgctctcctacccagcatccaaacggacgctgccgcgtcttcggtggcgtgcttgagccccgctacattgtcggcgcggaaccactagaccagtgagctgttacgcactctttcaagggtggctgcttctgagccaacctcctggctgtctatgcgactccacatcctttcccacttagcacgcgcttggggaccttagacgacgatctgggctgtctccctttcgacgacggagcttatcccccgccgactcactgccgggatacgcgtcacgggtattcggagtttggctgctgtcggtacccgatacgggccctcaagcatccagtagctctaccccccggacgtaatccccgacgctgcacctaaatgcatttcggagagaaccagctatcacggaatttgattggcctttcacccctaaccccaagtcatccccccggttttcaacccaggtgggttcggtcctccacgcggtcttacccgcgcttcaacctgctcagggctagatcatcccgcttcgggtccaggacacgcgactcaaacgccttttgagactcgccttcgctacgcgtaccccacacgggttacgctcgccacgtgccactgactcgcagactcatttttcgataggcacgccgtcaccccgaaaggctccgacggtttgtaagcgcacggtttcagagactgtttcactcccctcccggggtgcttttcacctttccctcacggtactagttcgctatcggtcagacaggtatatctaggcttaccccacggtcggggcggattcacacgggattccacgagtcccgcgctacttgggagacacgatccggagacgacgcgcgttcggctacggggccatcaccctctgcggcccggcattcaatccggttcgcctcacacgccgttttatcactccggccgggcccgccaggacccggacacacgctccctcaacaccacgcgcgcaacggctggcgcctgtcacacgcgcgcggtttggcctgatccgctttcgctcgccactactcacggaacatcctttcctgcaggtactgagatgtttcacttccctgcgtaccccccgcgcgaacgcggtgccggcccatgacggccggcgggttcccccattcggaaatcctcggatcaaagccctgctggcggctccccgaggcatatcgcagcctcaaacgtccttcatcggtactgtctgccaaggcatccaccatacgcccttgcaagcaacccgcacgacccatccgggaacggcgggaaaccgcaagcccacggcaaaaactccgctggcaacacaaatcatcacacaaatgatcacacacaaaacgatcaaacaccagactccgaagagtccggcgaaatcaacagcagaagacacccccgaaaagggcgtcccctgctcgcgtccactatccagttctcaaaccaccacgcacccgcacgcgagcccacccaccccaccaggggacgggcgaccggcacggggcacggaacaccagccacgccaaacggcgcggggtggcggtccgggaacccaaaagcatgcccgcaccactcctggacgcaccgcacgaccggcacgcccgaaggccgactccactcttccacaccagcaacccccgcgcacccggcacatccggggcaagggggcacacaccggccaccagacagtggcctgaaatctccgtagaaaggaggtgatccagccgcaccttccggtacggctaccttgttacgacttagtcccaatcacgagcctcaccttagacggctccatcccacaaggggttaggccaccggcttcgggtgctgcccactttcatgacttgacgggcggtgtgtacaaggcccgggaacgcattcaccgcggcgttgctgatccgcgattactagcgactccgccttcacggagccgggttgcaggctccgatccgaactgagaccggttttcagggatccgctccatgtcgccatgtcgcatcccgctgtaccggccattgtagcatgcgtgaagccctggacgtaaggggcatgatgatctgacgtcatccccaccttcctccgagttaaccccggcggtcccccgtgagttcccaccataacgtgctggcaacacggggcgagggttgcgctcgttgcgggacttaacccaacatctcacgacacgagctgacgacgaccatgcaccacctgtgaacccgccccgaagggaaacgccatctctggcgtcgtcgggaacatgtcaagcccaggtaaggttcttcgcgttgcatcgaattaatccgcatgctccgccgcttgtgcgggcccccgtcaatttctttgagttttagccttgcggccgtactccccaggcgggacgcttaacgcgttagctccgacacggaacacgtggaacgtgccccacatccagcgtccaccgtttacggcgtggactaccagggtatctaatcctgttcgctccccacgctttcgctcctcagcgtcagtgacggcccagagacctgccttcgccatcggtgttcttcccgatatctacacattccaccgttacaccgggaattccagtctcccctaccgcactccagcccgcccgtacccggcgcagatccaccgttaagcgatggactttcacaccggacgcgacgagccgcctacgagccctttacgcccaataaatccggataacgcttgcgccctacgtattaccgcggctgctggcacgtagttagccggcgcttattcgaaaggtacactcacccgaaggcttgctcccaaacaaaagaggtttacaacccgaaggcctccatccctcacgcggcgtcgctgcatcaggcttgcgcccattgtgcaatattccccactgctgcctcccgtaggagtctgggccgtatctcagtcccaatgtggccggtcgccctctcaggccggctacccgtcgaagccttggtgagccgttacctcaccaacaagctgataggacgcgaccccatcccacgccgatagaatctttcccacaatcacatgcgatcatgtggaacatccggcattaccacccgtttccaggagctatggccgtcgagtgcccgctggaagaggtcccgctggccaccaagcgcatcatcgagctggctcgtcagtacgccaagcccgtcatcgtcgccaccgaggtcctgggctccatggtccactccccggttccgtcccgtgcagaggcttccgactgcgccaacgccgtgcttgacggtgccgacgccacgatgacctccaacgagaccgccgtcggcgagtacccgaccgagaccgtcgccacgatgagccgcatctccggcttcgccaccgagcacggcttcgaccgcatccccgagctgaagaacctcgacatgtcctccaccggcgccgtttcctccgccgccgtcgacctggccgagaagctcaacgccaaggccatcgtcgcttacacccagaccggcaacaccgtgcaccgtgtgtcccgcgagcgtccggccgccccgatctacggcctgaccaccaacgagcacacctaccactggctggccctctcctggggcaccgaggccttcctgctcgatgaggactaccacgacaagacccgcaaggatctcatggccttcaccgacaaggtcctcaagaacgccggcaaggtctccgacggcgacaagatcgtcgtgctgagctccgctcagggcgagcacgccgctggcagcaccgacaccatctacgtgcacaccgtcggtgccaacgactgatttcagccgatagcagattcggcttccgctgcgtgacgacggaagccgaatactcatgcgtgagcccccgctccgaaacgagcgggggctcacgcgctttcgccagggaaccgcatcggctcaaggacgatgcggaaggtcgtcgcgcggatgcggggcagatgcgcgactgtctcgtgcggaaggcgaaccgcacaatctcacatgctcacatgccgatgtgctccagcagtccctcatgcaggcgaaggatcgcgataatcgtcttcgcatcaatgatggtgccgttggtcaccatctccatggcctcctgttgcgtgtacaggcgtaccgcgggacgtggcgtctccgggccgatcgcggaacggtccacctccttgagtcccgtcgccagatacagcgcggtgtactgcgaggagaagctgggcgtgttgatgaagcgcgtgaactgggtgagctttgaagcctcgtagccggcctcctcgcgcagctttcggcttgcaacgtccagatactgctcgcttggcgcgttggcatggcctgccggaatctccaacgtccagcgatgggtcgggatgcggtactgctcgacgaacggaatcttcccgtcagcggtcaccgcaaggacgccgacggtgtccccgttgttctcatgcaggatgaaccgttcgaactggccgacctgcgccgaactgaacgcgaccctgtccacgttgaaataatgggtctcgacgatttgcttgcgggactcctccttgaccggtgtcggacgccacggatcgaagggtctgtaagtgtcactgtccatgctcataagcctcacctttgatagttctcttatgtgtttccattgtaggtccgcgctggtgagttgcggggatattcggcgcggcgttgatgctaccggcgtaaatcgcgtgccggggcgtatggcgtccacggaaccggcgtgactcgctggaatgatgcgcggcacgcctgcaatggacgaatgacgtagcgatatgctaaactatcgcgagtgccagaaacgccctcgtatcccaattggtagaggaagcagcctcaaaatctgcgcagtgtgggttcgagtcccaccgagggcacgttgcattatcgggtgagccacagtgccgcatcgccgaatctctatgttatcgttatacatgaagttctgtcgatgaatcactgtgtcgtggaaaagaggttgtgagcatggtggcaagaaagaagacctcaacgcaagagcaagagggtcaggtagaggaggtgctttccgccgacgagctgaaggcagtctccgaaggcgagcccgtcgagagcgccgtgcacaagaagcgcacggtcgttgtcgccgaggacgagtcggtgaaccgcatggatctggtggccatgctggaggataacgggtatgaggtcgtcggcgaggcggccaatggtgaggaggccgtcgatttgacgcgcaagttccgcccggatatcgtgtgcatggacgtgaagatgccccgtatggacggcatcgccgccgccggcgtcatctgcgacgagaacatcgctcccgtggtgatgctcaccgcgttctcgcagcccgacctggtccgtcaggcgaccggtgcaggtgccatggcctacgtcaccaagccgtatgaggaatccaagctgctgcccgccctggaagtcgcgatgggccgtttctccgagatcaacgacctgctcgacaacgtcgagaccagcgagaacaagctcaaggagaccgaagagcagctcaagaaggccgaggagaaactcaagaaggccgaagacacgctggaggagcgcaagctcgtcgaccgcgccaagggcctgctcatggacaaggcggacttctccgagcagggagccttccgctggatccagaagacctcgatggatcagcgcatcccgaagaagcgtctggccatggcgatcatcgccaagtatggcgatcccaagccgtcggaagtaggggaatgagcgaatcgcgcgacgacgcccagacgaaaacgcgtggaacgttgctggtggtcgatggccactcgcttgcgttccgcgcgtttttcgctttaccggcggaaaatttcagtactcaggccggacaggccacgaacgcggtatggggtttcgccacgatgctgtcccaggtgctggacagcgagaagcccgaccatctcgcggtcgcgttcgacatgaagggcggcaccttccgcaacgagatgctgccgcaatacaagggcacccgcgaagcggcgccggaggacctgctcacccagctgccgctcatccagaagatgctcacggcgctgggcgtcacctacgtcgaaaagcaggggtatgagggcgacgacatcatcgccacgctcgccgcgatgggggagcggtccggatacgacacgctggtgctgtccggcgaccgcgacgccttccagctgatcgacgagtgcgtcaccgtgctgtatcccgggcatcacttcaaggacctcaagcacatgacgccgcaggcggtggaggacaagtaccatgtcggccccgcgcaatacccggatcttgcggcgttgcgcggcgagactgccgacaacatccccggcgtgcccggcgtcggcgacgggttcgcggcgaagtggatcaaccagtacggcggacttgagggtatcatcgagcacgccgacgagataggcggcaagaagggcgagtcgctgcgcgagaacatcgagcaggtcaagctcaaccgcaaggtcaacgctctgcggcgcgacgtcgacctcggtatcggcatcgaggacctgacattcggcgaggtggacgccgacgcgctttcggaactgttcaccagcctcgaattcggcccgcgcacccgcagcaaggtgctcaagtcgttcaacgccggcaagcaggccggcgacgcagctgacaagcacgcagacgacgaggacacctcctccgacgacctgaggattcccgaggccgtgaccatcgcggatgaggcggcgttggcggcatggatcgactccgcacgagacggtctcggctcgcctgccgacaattctgatgatgagccgcgcaaccgggcgcactgcgccgacgtcatggcatcgacctgcgcgctgtatgccgaaggctcatccaaacccgggaacccgggatgcagcgtgctgatgctggaggtcggcggcaaggcggccgtgctggaagccggcgtgatcgccggcgtccgtcccgcgttgcagcggttccttgacgggcacgccgaccggatagtcgtgcacgggtacaaggagcagtcgcacatcctcgcgtcgctcggactggacctcgccgagccgtggttcgatacgaaactcgccggatacctggtccagccggactatcatgccgattcgctggaacaggcggcatcccatttcctgcagctgcaattggacaatgccgatgacgtcgcgcaggggcagctggacttgagcggcgacgtcgatccggccgaccagctgggcgaacgtgtcggagatggacacggagttggacatgctggtcaggcccatcgggatgccgatgatcgcggtgatgacgatggtcagcagcatgccgcccttgagcttgagcacggtgaacacgatggcgaacagcaggccgatcaggaacagccacagggtcggggtgttcagcgtggccagaccaggcgtggcgccggtggccaggcccttgccggcggccttggtgtccttcggggtgaaggtgacgaggttgacgttgagcatgccgacgtaggcgacgaatatgccgatgccgccaccgatggcgttctgcagcatgggcgggatcgcctcgatgatcatcttgcggatcttggtgacggtgatgatgatgttgatgaggccgcacaggaacaccatgcacagtgtctcctgccacgtgaacttcagaccgaagcacaccgtgtaggtgaagaacgcgttgagacccatgccggccgcctgcgcgtacggcacattggcgaacaggcccatgacgagcgtgccgatgatggccgcgatgatcgttgccaggaacacgccgccccacggcatgccggtctggtgcaggatctgcggattgacgacgatgatgtagctcatcgcgaagaacgtggtgaggccggccacgatctccgtggacacggtcgtgccgttctccttcaaatggaagaacttctccatactttctctgcttccttgaatgtgcgaggccatccggcctcggcgagacaaactgctattcgcccggtttcccgaacacgcccaccataacatcttcataagtcatggatgttatggtgtcggacggcctgtggatatatgtggataacccgttctccatccacatatccacagaaatcccgccgtcggtggcgcgcgggcccccgacccgctagcgttgcgcccatgaacgattacgaaccgataccgggcgagccgacagccaccatgttccagtcattggaacagattaggcggcagactctgcaacgctgcaccgccacggtagggcagtccgaccgccagctgctcttcggcatgaccaccgctctggaactgcaaggcgtgccggtgccctcccactgcaatctcgacacggccgcgctgcatgtcacggtgcggacgcgctccggcaggcctcatattcgaccgttgaaatccgtcccggtcattgtccacatctggagccattgcactccgcaatcactcatccacatatcgaatggcgtgcacgcattgcacgtgtttcatgtgtgggcgcagctgtccccatatctttcgacagaggatctggttgtgctcggagattccattctcgcgatgctggtacgcaatggcgcgccggacgcggacaaattgtatctggagttgcagcgtttcataaaagagatgccgccgttccgaggaaaaagcatttgcaggcaagccatgacactggtacgccccaatgtatggtctcccgccgaaagctcgctacggctgggtgttcaacgccacggaataccggatggacgatgcaatgtcgtggttcctggaatcacctttcgttcaggagcagccatttcgctggacatcgcatgggtcgagttcaaggtcggagtggaatatgacggcgatcatcatcgaacggataaggtccaatggcgccgagacaacgaaaaaaagggaacggctgcgggcccacggctggatattaatcatcgtgaccgctcaaaatctgattgacgagatgtcgattgcggaactggccctgcgtatagcaagacgactcgccgagcgcggagcgacgatagaattcgaggtcatcgcaatcagcctagaggaactggcgaggaagcacgggtatcggtatgaccgaagacgataggcgtcgaatcatgctatgaccgggaacaacgcgaacgttctcgggtggagcggagcgtgacagtcaagaatgtcgttgtacaacatctgcaaaatcgcacaacgcggcagttgtccagcatcgccgtcgcttcttctattccggagctccccctcacaaacgcgaagaccccgcgcggaggcggggtcttgtggcgatggacgcgcgggcggacgcagcgcatgcgatccgccagcgcgccgccgatcagccgaaacgaccggagatgtagcgctcggcttcggcgttctgggggttgttgaacatcgtggtggtgtccgcgaagtactccaggtggccgggctcgccgacggccttcaggttgaagaaggcggtgtaatcggcgatacgggcggcctgctgcatgttgtgggtcacgatcacgatcgtgtagtcgcccttgagctcgttgatcaggtcctcgacggccaacgtcgagatcgggtcgagcgcggagcacggctcgtccatcagcagcacctgcgggtgcacggccacggcgcgggcgatgcacagacgctgctgctgaccgccggacaggccgatgcccgggttgtcgagacggtccttgacctcttcccacaggttggcgcccttgagcgcccactcgaccaggtcgtcggcgtcggacttggagatgcggcggttgttcaggcgcacgccggcgagcacgttctcacgaatcgtcatcgtggggaacgggttcgggcgctggaacaccatgccgacatcgcggcgcacggcgacagggtccacgtccttggcatacaggttcttgccttcgagctcgacctcacccttgacgtgggcgccggggatgatctcgtgcatgcggtcgagggtgcgcagcaccgtggacttgccgcagccggacggtccgatgaacgcggtgaccttgttgggttcgatgttgatgttgacatcctccacggccaggaagtcgccatagtagatgttcagatgtttgacgtcaatgcgttgtcccatatgaattcctttattgatgtatatacagtgtacggcggcttaccgttcggacttcacggcgaagacgcgagccacgacacggccgatgaggttgaggatcagcacgatgatgatcagcaccagggcggcggcccaggagcgttccatcggtatcgtggtgacgcaggaggagccggcgttgggcgggcagttggcacgcagcttgctgtattcctggtagacgaacacgggaagcgtggtcatctcgccgttgaacaggttcacgttggtgaacgtcgcgtagcctgcggtcatcagcagcggcgcggtctcgccgatcactcgcgcgatggccaggatgacgccggagacgatgccgggcagggcggtgcgcagcacgatcttgcagatggtgcgctgcttggaaacgcccagcgcgtacgaggcctcacgcaggtcgccgggcacgaccttcagcatctcctcgctggtcttgacgacggtcgggatcatcagcagcgaaagcgcgacggagccttcgaagccgctgatggtgccggggccgccgatgagcgagaacatcgagtaggcgaacagaccggcgacgatggacgggatgccgctcatcacgtcgaccagcaggccgatggacttggcgagcttgttgccgcgggccgcgtactcgatcaggtagaccgcgcacatcaggccgaccggcacggagatgaccatggcgcccaaggtgatctccaacgtgccgatgatggcgtgcagcacgccgccgtatccgccggagggcgtctggctgccgccgacgacgccggacatgttgtacgaaaggaagttgaggttcagtcgcttgatgccgttggcgacggtcgtccacagcactgagatcagcgggatgcacgcgatgatgaaggcgaggcagatcaggctcttcatgaagacgtccttgcgcttgcgggacgcggcgaaggaacggctggtcttgaaccggtcgaagtcgatgtcgggcagttgcttgtcgttgcgtgcggcgggcgtcttcttcacggcgttcgcgtcgacgctgatggtgctctttacagttgcttcactcatcatgcgctcgctttctcggtgatcttacgggcgacgaagttcacgaggaacgtgataacgaacagcacgaggccggtgccgatcagcacgggcacgccgatgttcgggtcggcttccgggtattgcgccgcgatgttcgccgcgatgtggttgtcgtcgccgtctcccgcgcccaacttgtcgaaggtcgagtagacattcggcgtgctcagttgcgcacggtacgctcccaccagcaattggccggcgaatccgcggtctcgcagcgtctgaacgcatgatgaatcatcctccagcgggatgatccgctcgccgaaaccggtgccatgcgcatatccgccctccaggcagaagggcatatcggcgccgagcgtggcggcgatgtcacgcagccgctcaatcggccagtgcagtccccacagggtgttcacggcgagcaatgtcgccgccgcgtcggcggatccgccgcccaatccggcaccgacgggaatgtgcttgtccacatgcagcgccacgtccggctcccgcctcgcggccctggcgatcgcgaacaacgcaagcaccgcatggttgcggcgcatgtcgctgccgctcgatgccagatcacccagatgctcgccgctcagttcgagcgagaacccgctgccgggggtcttggcggtcgccgtcaccacgtcgttgacgccgatggcgcaatatatcgtgtccagcgcgtgccggccgccccattcctcatgggcgggccctacgtgcaacgtcagattggttttcgcgggaaccgtgacctccaccgagtgcagcggcccggccggtgtcgtttccgcggctgctacatgacggcggatgggccaatgcgcggggacgcttggcgaacgccgcacctgacccggtgtcgctgaccgtacattgtccattgctgtggcgctcatgatgatgcctgcccctgttcatgctgcgattgcctcagcgccgtcgccagagcggcgaattcgtcgatggtcagcgtctcgccgcggcgtgtcgggtcgatgcccgccgtgtggaacacttcatcgggcaccatgcgcttgagtgcggcatgcagcgttttgcgacgctggctgaaggccgcgtcgaccaactggaacgtcagctggcgcaactgggggtcgcgcgggcccgcatgcgactggacacgggtgaacccggccagggccgaatccacgttcggcgctggccagaatacgtgacgcccgatgttgcccacgcgttccgccgagccgtaccacgccagcttcacgctgggcgcgccgtaaatcttcgagccgggagtggcggtcagacggtccgcgacttctttctgcaccatcaccacgaaggacgtcagcatgtcgaagcgttccagcagcgtcaggatgatcggcgtggccacattgtacggaaggttcgccaccagggtgaacggttcgtcgccgctgaactcggggaggtccgccgacgtgagggccagcgcgtccttgttgatgaccgtgaggcggttcctcgcatccggcatgtatgtgtcgatggtatgcggcagccgttgcgcgaccggcgggtcgatctcgaccgcggtcatcgtggcgccggtttccaggatggccagtgtcagcgaccccaatccagggccgacttccagcacccgcgtatcggcggtgaccgcggcctcgcgcacgatgcggcgcactgttccgggatcgatgacgaagttttggccgaatttcttggtcgggctgatgccggcttcggctgctatgtgacggatgtcggccgcgccgagcagtcgcccggcggctgcggatgctccggaaggtgcaggggatggattcatgtcagtcataacgctcgctatcagtaccagccgatttgttcggagcgttcccatgccttggatgggctgccataccgttgggcgatatacgccagcccccagtcgatctgcacagcgccgtcgtcacggtaatttgcgccgaactcggccattttgctcgcaggcagcgactgcgggattccgtaggcgccggtcttcgcgttctcggcgtaccacagccatctggattcgcgggtccacagcttgtcgaggcatgtccagtcgtagctggtccagccgcgctgtgcggccgcgccggatgcgtaggctttggcctgcgcggcggtcgggtgccataggcgtccctgcgagctgctgccggagttgccggagttgccgttgccgccgttgccgccgttgccgccgttgtttccggagtttcccgagtttcccgagttgccggagtttcccgagttgccgctattgcctgagttccctgagttcccggaattgccgttgttgcccgaattcccgttgttcttgtcgttgtttttgtcattgttcgacgtatcatccgacttgtttgcgccggacgtgctgccattcgaggagttgccatccgacttgccggtattcgacttgttgcctgacttgccggcgttgtcactgcctttatcggcttgccccttgctggtgtcggaaggttcggcggccttctccgggcctacggcgacgatggtgtcgagggagattttggtggtcgtctccgaaatcagcgttcgcgtctctgcgatgccatcgacatacgtgacgttatagacctgcttcttctcgccgtcttccccctgttggcggaccacggatgttcctggcttcaacgacttatcaacaatcgtctgcgaaccatggggaatggcgacggtcgtcgtctcctgcccgtgggtgacgcgctgaacgcgcagcacggtcttgtctccgtccttctcgacactgacgcggtcttccttgttgaggctgatgcctttggaatcgagaatcgacgcggcgggaagcttgccattcggcgcgaccgacgttttgccgtcggcgatgaccgtcaccgggccggactcgttgatgacgaggccgccggtgagctggctgtagatgttgtcgatgtccacggtgactttcgcggcctcgttctcgttctgctggaaaaacccgagcagctgggaggcgctggtcgccacggtccagaacggcacgcgctgtccgtcgatgctgatggtcgtctgatatgcgctgcggaccgtgaccacgtcatgattgctgaggatgtcgccgctggtggattgcaccagatcatgggatttgacgtcgacgccccgctcttcaagcaggcgcgtcacgctcatggcatacgtggtgacggtctgggtgtcgccgttgatgctgagtgcgatggtcttgcgtgcggcgacgccgaatgcgaccgttgaggcaagagccacggcgacggcgcagatcgccacccgaatgcgacgcaatcgaacaaaacgtcgtggtgtccaccgcctggccatatgtcatccttccatgagctacggctagcattgtaaccaatcacgatgatgcttcgctgggcatcgcacgaccgtcacccatactcccacatttggtacttttttgccctgcccgaagggctgtcgcggagctactggggtggtcacatatatcaagataaagaagaagggggcgggagagaaggggattgtcccgcccccctgtgggcagagctaattgggggacgctctgccttccagaagccataagttgggggaaggcttctggcacttacacaaggtaagactatatgtaaacacagcttactacatgtcgaccgtgcatcgcacatgacacgcggtatgctgtgccgcgagcctcctgtcgggatcgaaccgacgacctgccgcttacaaggcggccgctctggccatctgagctaaggaggcggaccccattcgcacaatgcggacaggtgtcatcgaacgattgaccagcttaccagtttcaccgcgctggtcaattcagaatgtcgcaaacccgtgttgcggttccttcggccggggtcgaagatcgcagcgcgacacgggtctacgtgggtgtcatcgttcatttgcggggcatgacgggtcattcgtcattcgccggtcgtcagcgagatcggcttgcccgattcgccgatcgacggcatcgtgcccttctggccgacttcgtcttccttcaggcccagcgacgcgatgatgccggtcttgttgttcatgccggcgagtgacagctggttgcgatcccagtaattgccgttgatggtgatggtcgtcggcgacttgtgtcttcaattggaatcacagttctcagaaagtccctggataccgccgttcccagaattacgtaacattcttggcattattatcacagggtgcagggccgccggcaagaccgcccccagcctcgctacgctcggcagctcctgacagcgggagcacaccatccgcgccatcggtcggccaagtcgtcagcgcagccggtcgcgtaccacaccagcgcaaaatcacatcaaaatcgcattgtgtggccagccagtctgcctcacaatgaaatgtgaaccctcacatcacgtggtgtggtacaacatgcaccgcaaaaccgccatttttcaacggcccaaaacgactcctccgatgcccgcgtaccacaccagcccaaaaaccatcgaaaaacgcattgtgtggcagaccgagagggtgatacgcgccggacgcccctctgctctcgtcacaatcatgttctatggcagcacaccggccatctgccgcaccagcgcatccgctctcaacaatccttctcccgtttgcgtcgctatgtgcgcgccggaacgacgaccgtgcgcacatagggactcgaaccacagtccccgaacccgtcgcgcaccatatataggaaattctccgcccatcactcgcctacatagcaaacagcccggcgagcccacgcacggcgcactgccatgcgtaagttcaccgggctgtcagcctcatcaatccagcgagcgcaacgggcgctccatcaatcggtgagtgtgaattggctgttgtagaggtcggcgtaaaaccctcccgccgcgagcagttcctcgtgggtaccgcgctcgatcacgtcgccgtggttcatgacgagaatcatgtcggcgtcgcggatggtggagaggcggtgcgcgatgacgaagctcgtgcgccccacggtcaacgcatccatggccttttggatgagttcttcggtgcgggtgtcgacggaggaggtggcttcgtcaaggatgaggatcggagcgtcctgcaccatggcgcgggcgatggtgagcagctggcgctgtccttgggagagcgaggtgttgtcgtcgagcacggtgtcgtagccctgcggcagagagcgcacgaagtggtcgagtccgacggccttgcatgcggagacgatctgctcgtcggtgacgccgggcttggagtaggcgatgttttcgcgcacggtgccacggaacacccatgtatcctgcaggaccatggagaactggtcgtgtacgttccagcgcggcacggaagtggtgtcgatgccgtcgatggagatggagccgccggagatctcgtagaagcgcatcagcaggttgaccatggtggttttgccggcgccggtcggaccgacgatggcgactttctggccggcggagacgcttgccgagaagtcgtggatgatcggcttgccgggctcatagccgaatcgcacgtgactgaattcgacgtcgccgcgcacggtccgggggttgccggccgcatcgtagccgagcagctgcgaacgctgcgaagccgtcataccggcggtggcattcgcgcgagtgccgcgatgcgccagcttgccgctgtccgtccgtgccgtgctcgcagcggcatcagccacgccgagttcggccttggtcggttccgcatccatctccggctcttcgaggaagccgaacacgcgctcggcggcggccgcgcatcgctgcaggttctggaacgcctgcgcgaactggctcaacggctgggtgaacaggcggatgtacatcatgaacgcgacgatcacgccgaattcgatctgtccgtccatggcgagcgccgcaccgaccacgcacacgatcacgtagccgaagttgccgacgaagttcatcagcggcatcatcaggcctgacaggaactgcgatttccagccggattcgtacaggtcggcgttgtacttctcgaagcggcggattgagtcggcctcgccgttgtacgccttgacgatgaggtgaccggcgtacatctcctcgatgtggccgttgacgtcgccgagcgccatctgctggcgggcgaagtatttctgcgaggatttcatgatgaccatcatgatgatgagtcccagtatgctcgcgccgatcgcgcacagggtcatgatgacgttgttgtagaacatcatgacgagcgcgccaacgaacagcgtcgccgaggtgatgagcgagccgagggactggccgagcgtctggccgatggcgtcgacgtcgttggtgatgcgggagagtacgtcgccgtagctgaccttgtcgaagtatttgagcggcagcttgttgattttgaccgagatcgattcgcgcaggcgctgggcggtgcgctgggtgacgttcgccatcatccagctttgcacgtagctgagcaccgcgtagccgacgtacagtgcgacgagcagccaggcgatgcggccgacggcgttgaaatcgaccgagttcatcaccggcttgccgttcacgatggccggcagtcccttgacgatctcgttggtcatgtccttgagtttgtccggtccgatgatctggcatatcgtgccgaccgcgcccagcacgagcgcaatgatgatgacgggcaggtagttgcggcagtagtggacgagcttgcccatcacgttgccgaaattggcaggcttttcgaccgtgcggccgccgcccattggtcctcttggtcctggcatttgttactccttaaaagtccgtattgatctcacgcggtcagttccgactgactgagctgggattcggcgatctgacggtagacatcgcaggcgtcgagcagttcctgatgggtgccttggccgacgaccttgccatcatcgagcacgatgatgcggtcggcgttcatgatcgtgccgatgcgctgggcgacgatgagcttggtggatcccttggcttctttggcgagtgcgtcgcgaacttcgcggtcggtcttgaagtcgagcgcggagaacgagtcgtcgaagatcaggatttcggggtggcggtagacggcgcgcgcgattgacaggcgctgcttctggccgccggagacgttggacccgccttgtgcgatcggggcggtgtatgtgccgtccatgcgctcgacgaactcggtggcctgagcgacgccggccgccgccttgacccggttcatctgttcagccggcattgcggcgccttccgctctcttgcccgcggcgatgagttcggcttcgcgtttgcggccggccggagtggaggtgtcggccatttcgacgtccgcggagcttgccccgttcacgtcgtcgccgtagctcacgttggatgcgaccgtgcccttgaacagcacggactgctgcggcacgtatccgatcttgtcgcgaagggctttcagatcgtattcgcgcacgtccacaccgtcgacgagcacctgcccggccgacacgtcatagaagcgcggcacgaggttgatgaggctggacttgccggagccggtggagccgatgaacgcgacggtctggcccttttcggcggtgaagtcgatgccttcgagcgtcgcctcgcgtgagccggggtaggtgaagctcacgttgcggaactcgacggtgccggttttcccgccgcccagacgcgccacgtcggcggcggtcttggtgccggttttgacgatcggatcggtgtcgagcacttcgagcacgcgctgcgcggacacgtcggcgcgcggccagagcacgaataccatgctcatcagcaggaagctcatgatgacctgcacggagtagttggagaagacgaccatgttggagaacacgttgagcttgtccgtcaggccggcggcgtcgatcagacctgcgccgatcctccatcgaaaacatgcgaactccaatccggacaccaaagcgtccaacttttcatccgcacccccctaccaaagctccagcccggattctctgttttttctgccttcatctgttatttgatttctgaacggttgtcatgtcgttctgctcaacgcgatcaaatataggtcttactttctattacctttttccaacctattaaaaggcatacacacggaaataatcaaaagtactggtgccgaaaaaactagaggaagagcatatcttgcactctcattcacgggagacaacaggcatacgcagaaaatcagaacacaaggaaccattgcaattaatagcatataattacgcttaaagcaagccaaacatgcagcaagacatccaatccaaaaatatgttcctggttttacaatcagacttacaactggaattttatacagattctcaaatgactgtaagaattcctcacgcaaattttctgcttttcctagatatgtcggatacaattctccgtttggaacacccatatactgtttccacccactaactgtctgaggattcatccactggaaactgtcatacacagatccctgcccaatgcttgccctacatgggtagaagaaaccaaacgttccagaaaatgtcgccgacagataggtatctggatgcagaacaagatgacgaccccacaccttcagaaatgctctcaacgaaaaatcttttctgaaaagaactttcacaggatcaacgagttcgggcgaatatttaacgccaagatcactccatagcgtatcatctacaagcatctcgtttaactttttcttttcatcagccgtaaacgaagatggattatcccgaacctccctcgaaatctgctgaacaggaatcgttaacatttcaatacgactccccttctgcggattaatcaatgccgagctcatcaatgacgcaacagcaacgacaccaaccaagcccacggaaagaaaagtgtaaaatttctttttatctttcacctgagcaaaagaaacgagagcggcacatgcaatcgcaataattaaaccctcattgcggaagacactcatcaccataaaggcacaagaaaagaggacgacaaatgtcctctcatttatcactttcttgtcaccgatcacttccacgagtaaaaccgtcatcaccgcaatcgcggcagcataaggtacatcttttaaaacagacaatgagtacagcgggaaaagtggattcagcgcggaaaaaccaacaagcgcacaccacaagcaaaagactcgattgctcccctcttcaccttctgcaacaagcaggcgtttatatgcaaaccatgctataaacgctagaacagcggaaacaagcagtacttgaatactcgtgtagataaggaactggaaatttgttcccaacggtttcccaattgaaaataaaacaccaataacaagagttgccaagacaggatgctgagaattatatgaagtgtagccataaaactgcgacagctgccagaggctatcataaaaccctagtcccggcgcaaatatcgcataatatggaatccaagcaacaataatcagcacccaagcagaaaaaaatggatgacgtactttcctgcagctcttcgacagttccgattctttaggcacatttatacgagaaagaaccgcgtacataatcccaaatgctattaacgagataacgcagaatgagataaacgccttgtaggtatcaaaaaattgaaaactatacgttttagaaaaagagtatcctaataccattaaaaaggagaatagtaaagaaaaaagacctgaaaagatcattttccttcggaaactcacaacatgtttttccaaaattctctcattccattctctcttagaatagagtggcgcatagaggtacatcacccactatgcgccactctattgcttacttctcttcgtgatactctttgtcagtgttcacattccagatgttcttcttatcttcacgaccgctcttgatgttaccgaccgtttcaaaagcagtagccatggaatgatccatattgttgtagcggtgttggccattacgtccaacgcaatacaggtttccgaaggaatccagccacttcaccagatcatcgatctgataccaggtatcgaaataagcaggatatgccttttttacgcgttcgcgatgagaatcctgaatatcgttctttgatgcgataattcccatcttcacaagctcatcagctgcgaaatcaatgcactcctgatctgtcatttcccagaaagcatcgccttcattgcagaaatactccagaccaatccagaccttattgtcgacatcctgaaccaagtacgggctccagttgttgaatacctgaatacgtccaaccttcacgctggtatcctgcacataaatccagcagtccggaacgatttgcgggttgcccaaggtcggaatattcgtttcgttcttgaggttcaggtgatcgacaaggaaaccaaccgtcacgaaatcacgatacggaagaccatcggcaatcttcttcatatccgacggaaccggcttcgtggcttggtttccttccgcgatagaattaaccaggtccttcacaggcatggaggaaataaactcatcaccggcaaggatctgctcatgcccttcgctatcgcgataaacaacagaagcgatctttccttcgtccgtttcgttaatcttcacaacttcagcatgcttaacaatatgcgcgccaaactcttcatcatgcttagcgacggtttcccacagttggcctggaccgaacttcggataccagaactcttcaatcaatgaggtctcaccctcaccggccttcttctccttgccaacaagcttgccccaagcatccttaagcaccgccataatgctgatgcccttcacacgctgcgagccccaatcagcggaaataacagacgggtgacgcccccaaagcttctccgtatatccttcgaagaacattccgtagagggctttaccaaaacgattgatatagaagttttccagattatcttccggaagcttatgaataagggacttcaggtaggagaaacccactttcatggtctgaataaagcccatattcttcagggtctgcggtttcaggctcacagggtaatcgaagaacttgccatgccagtaaatacgggaaacacggtgacgcttcagcattacttcgtctgttttctccggatcagggccgccaggctccatgtcatgagcacggttcaacttcttatcgtcataagacggagcaccctgcagaggaagaatggtcttccaccaattcatcacacggtcatccttcgagaagaagcgatggccaccgatatccatacgattcccgttgtggcgcacagtacgggaaataccgccaaactcgccggaagcttcaaggacggtgacatcatactgctcagagccattatccttaagaagttcgtaagccgcagtcaagccagcgggaccgccgccgataattacaatggattttttagccattatgaaataatccttacctgcataaagctggtatcaactctttacggaaacaaactctactacagagtcaaaacaccatttctaacgtgcgtaaatcgaccctttctggaaatcctgcctccagatcgagcccagattacgctcctccgaaaccgggcctccaagctttgagaaaccacccttagcgtagtactcttttcgcagattcagcatcacgatgtacttctcggaagccccgttacgggtccacacatcaccgttctcgcaacgctgacgtggacgtggatgcatcatggcatctgaacaccccgttcggcttcgatgtgtccggcacgcccggtgaggtgaccgccgacggcgaggcgcaggccgcgaccgtcgtggaggcggacgggcaagtcacgtctcgcgcgggtgtggctctgagcatgttcgctgcggattgcctgccggtgctgatggccgacgcccaggccggcgtgatcggcgccgctcactgcgggcgcaagggcctgcagcgcggcatcatcggtgccacgattgatgcgatggtggccaagggcgctgcgccggagcgcatcgcggccacgctcggaccgtgcatctgcggcgactgctacgaggtcggcgacgccatcgccgacgagttcgacgcgcaattccccggtacgttcaccctgacgcgattcggaggccccggcatcgacatcgccaaggctgcccgcatggagctcgccaaggcgggtgttcccgccgacagcatcgtcgattcgcgcccgcgcgtcaacgccgcctcccaatacctgtatgaagacgaagagcttgcctcgctgtgtgccgccgacggcgaaggcgagcctgcgctcgccgaccgctggagcaccgtgcgccacagcatgtgcacgctggagaatccgctgtggtactcccaccgccgcgcctcgctcgccggcaaggcgcacgagggacgcctgctcgccctgatcatgcgcggctgaccccgatttgcctcggttgtgacgaatcgggccgctatcttcgtttcgtgaggttgattccaccggtcgggaacatctatcttcgtttcgtgaggttgatggccaagtagcccaaggccctaaaccgcatgattccaatggcgtttggcgcttaatactcgcggtatcgtgtttgggcaaccccttgaaacgcagatagatgttcggcggagccgaaatcaacccctcgaaagcgagatagcccgttgcggcggggccgacaccggtgtcggcggcctgttcgtcgtcgaatcagaaaaaattccgtgcagaagagtgtggcttccgtcacaaccggtcagggcggggcatacggtgggcggtatgactcagagagatgacagagaacccgaagcaccggtcgtcgccgtggtattggccgccggcttcggcacgcgcttcgatccggacaaccccaagcagctggtgagcgtcgacgacaagccgatcgtctgctggtccatcgaggcgttcgagcagaacccgcatgtcaccgacaccatcgtcgtcgtcaacccgcaggtgcgcgatgaagtggaacgcctggtcgatgaggccggctacccgaaggtgcgcatgatcatcgacggcggcgccgaacgcgccgacagcactgcggcggctctgcaggcgctgggggcagctggcatcccgccccgcgcgaaactgctgatccacgacgcggtgcgtccgttcgtcgagcagtcctcgatcgacggctgcatcaccgcgctggacgagttcgaggcagccacagtcgcattcgcctccaccgacacgatgctgctcaccgaggatctgggcgaccgcaaggtcgtgcgctccgtcccggaccgcgcgaacatgttccgggcgcagactccgcaggcattccggttcgagaccatccgccgcgcatacgagctagcctcgcgcgaccccgatttccacccgaccgatgatacgcgcgtggtcgtcgactacctgcccgacgtcccggtcgccatcgtggccggctcccggaccaacatgaagatcaccacgcgcgacgacctgccccaggccgagcagatctcgctggagatccgcaagcgtctcgcgcgcgaacggatgcatcaggtgttcgcccaggtccgcgagcaatagcagcggcaggcgttcgcggggtacactggcatcatgcagcagctcaatgtcgtgatttgtgggttcgaccactacgagaacatcgacgtcaacccgtcgtacgaagtgcccgaggcgctcgtccgcgacggcatcggggagccgtccgacgtggacgatccgctgcatgacgccaacgtgtccatcaacaccgtggcgctcccggtcagcttcgccaacgcttggcccacgttgctggagaccttggatgcgacccggccggacatcgtgatcgcgaccggtctcaagcatgcggcgcacagcgtggcgatggaacgctgcgccacgaacctgatgaatgctgcccgccccgacgccgacaacgcgctgccgcggttcgagccgatcatcaaggacggcccggccgcatattggacccgtttgccgttgcgggccatcatcaacgatttcgcgcgcgacggcatacccgccacgctcagttccgacgcgggcacgttcgtatgcaattcgctgttctaccagctgctgcactggacggcgacacaggatcgtgtgctggccggcttcgtcagcttccctccgatcaatggcggcagcaggctgcagaacggcctggatctgcgccagcaggtgcgtgccgggcgcgatgtggtgcgcgagacggtccgttattatctgcagccgtcgtccggggatattctcatcgcctgacgttttgctgggatgcagctggtttcttgccggcatgtgtgtacgttcgcgtatggttcgtcgcgtttctggcgtgggcttgacgccatgcggtacagtcgtgtgtggttgtgctaacgagcaggtgtaatggcgaaaggaaccgaacatggcggaccagttcccgattgtgatacgtggatacgataaagagcaggtggaccgggcgtttgccagcgcgcagcagacgctggccgcgttgcgtgcgcagatcaagcaggacggggatcgtctgctgcagttgcaggcgaagctgcaggaggaacgcaaccgtcagtcgtccaagaaccacacgttcgcctcgctgggcgccaacgcccagcagatgcttgcctccgcggagcagaccagcaccgagctgctggagcgtgccaagcaggatgccgcctcgactcgcgcgtccgccaaggctcaggcggagacgctgatcaacaatgcgaagctggatgcgcagcatcttctcgatgacgctcaggccaaggccgatacgattaccggcaacgccaccaatcaggcgcagaccattacgaccagcgcgcagcaggacgccgcccagctgcgcgccgaaacggcgaagatcgtgaccgagcagcgtcagtccgtcgatctcgaactcaccaattcgcgcgaggagcatgaaaagcgcatggcgtcggagcgcgccaagcaggagcgcgagatcgccgagatgcaggcgaaggcgacccagcagatcgcctcgcagcgcaggagcgcgaacgaggagattgccaagctcaagtccgagtccaacgaccagattcaggcggcgctcgcggaggcgaacaagaaactgtccgacgtgcgcgagcaggtgtccaagatgatggccgacgcgcagcgcagggcgggcgagattatcgatgcggccaaggcgaaggcgcaggagattcgcgacgacgccgaggtccgccacacgcagacgatgagccaggtcaacgccgaggtcgagcagattcgcactgacatcgccgcccagcaggacgaagcgaccaagaaggtgagcgagctgctcgaaaacctcgaagagcgtcgcgtggccgccaagaaggaatccgacgagctgatcggccaggcgaagaccgtgcgcgaggactggacggacgatatccaaacgtcacattcgcctcaaccgttgggctaaactgacagctgataatgagagcaggaggcgcgatatggtagatgcggtcggtacgggcgcactattggcggccgacagcggtcccgaactgccaacggtcaatgattttcttcctcccgagatcctgttccagggaacccccttcgcgatcaatcgcatcatattgatccgcatcgtggcgaccgtggtgcttctcgtggtgctcggtatcacggcgaagcgcgccaagctcatccccggccgctggcaaggcgtggtcgagatgggcatcgacttcgtgcgcgacagcgtcgtatatcaggtcatgggcgagctgcgcggcaagcgctacgtgccgatgatttcgacgttgttcttcacgatcttcgtgttcaacctgtgcggcatcatccccggcatgaacatggcggccaccgccacagtggtcatgccgctggtgttcgcggtctgggtgctcatccagtactggatcaccgcagcacgcgagaagggcctgtggggctacatccgcgacgagtgcttccccaagggagtgccgtggccggtgtacatcctgctggcgccgatccagctgtgcgagctggtgctgatccgccccgcatcgctgaccatccgtctgttcgccaacatgatctccgggcacttgctcgtggcatcctgcctggcgtttgcgcagtactgggtcatcgacgcgaccaataagcttgccggcatccccgtcggcgcgctgtggttcgtcttcggtttggtgctcaccctgttcgaggcgttcgtcgccttcctgcaggcctacgtgttcgccatcctctcgacggtgtacatcagcatgagctacccggaggaatgagccgcacccgcgtgagactcaccacggacaatacgaatactttgcaattcccgagacaactgaagaaattaaccaagtttttttaacggttacgttagaaaggaaacagaaatggacatcattactctcgctcaggtcaccggcagcctttccgtcatcggctacggcctcgcgaccctcggccccggcctcggcctgggcatcctgttcggcaaggcgatggagtccaccgcccgtcagcccgaggtgagcggcaagatccagatgatcatgttcatcggcctcgcactggtcgaggtgctgggtctgctcggcttcgtggccgccctgatcgttaagtgagacgacaggcgacgattcacacgtttattcgacattgaaaggagggcttcatgatgacaatagccgcaagtgacggcctcaagctgttcattccgcaggtctacgacatcgtgtggtccctgatcatccttgtcatcgtcgcgctgttcttccacaagttcttcatgccgaaattcaacgccatcttcgatgagcgtgcggcgaagatcgaaggcaacatcgccaaggcagagcagtccaagaaggatgccgacgccgccaagagcaagtacgaggcccagctgagcaccgctcgcgtcgaagcctccaagattcgtgacgacgcccgtgccgaagcttcccacatcatcgccgacgcacgctcccgcgcggagtccgacgccgcccagatcaccgccaacgcgcagcgctccatcgagtcgcagcagcagcaggcgctggtctccctcaagggcgaagtcggtactcttgccacggccctggccggcaagattctcggtgccaagcttgaaagcgacgacgtgcagtcctcgatgatcgacaagatgatcgacgacctggacacgaacgacaagaagtgattccggcgttccggaaagggaggtgaccaatgcgaggagaggcatcccgcatctcggatcgcgtttcgcgtgacgagttggcgcccaagctgcgctcgaccggcaaggacgcatggcgtatcggcaacgaactgttcacgatcaccaacgtgcttgaccacaccgtgcagctcgaacgcgctctcaccgatccgtcacgtccggtcgacgacaagatcggcgtgctcaaggagctcatcggtgcccaggcccatcccatgaccctggagatcatgagcgatctggtcggtcgcaaatggagccgtgccgcgcacatcgccaacgccgtcgaagacttcggcgttgacgccatgatgtactacgcggatgccgcgggcgtcaccctgcgcgtgtccgtggaactggccgagctgcattccgcgctgctcaacctgccggttctgcgttcgaagctcaatgacgacagcgtacccgccaaggcgcgcatcgatctgctgaacgccgtgctgggcaagaccgagttcaacgaggtcacgctccggctggcggaacacgccgcgtgcaacccgcgcaaccggcgctatctggagaccatccagtggctgatcaacaagttctcgcgccacatgggcgagtcgatgattaccgtgaccaccgcgtcgccgctgaacatcgaccagatcaagcgactgaccgccgtatattccgcgaagctcgaccatccggtgcacatcaactcggtcgtcgaccccacggtcctcggcggcatgcgcatccaggtcggcgacgaggtcacggacaacaccgtggtcgcccagctccagcagctgcaccgcacggtaagggcgaaagcctgacgatacggttccgggccgcgccacacgcggcgacggagtccgacttgaaattttccaacaataaggagtgatcatggcagaacttaccattgatcccgccacgatacgcaaggcgctcgatgatttcgtcgagtcgtacaagccgagtgacacccccacccaggaagtgggctatgtcgcgacggccggcgacggcattgcgcacgtgacgggactgcctggttgcatggccaacgagctgctgaccttcgaggacggcacgctcggcctggcgttcaatcttgatgcccgtgagatcggcgtggttatcctcggcgatttcgcaggtatcgaggaaggccaggaggtccgacgcaccggcgaagtgctctccgtgcccgtcggcgacggctatctcggccgcaccgtggacccgctgggcaacccgatcgatggtctgggtgaaatcaagggcattgaagggcgtcgaatcctcgaagcccaggctcctgacgttatgcaccgtcatcccgtcgacgaaccgctgtccaccggcctgaaggccatcgacgcgatgacgccgatcggccgcggccagcgtcagctcatcatcggagaccgccagaccggcaagaccgcaatcgcgatcgacaccatcatcaaccagaagaagaactgggagacgggcgacccgaagaagcaggtgcgctgcatctacgtggccatcggtcagaagggttcgaccatcgcatccgtgcgccagagcctcgaagaggccggtgccatggagtacaccaccatcgtggcctccccggcttccgattccgcaggtcgacgagcacgcagtccttgcccttgacatcgccgaccacacggttggcgaccgccttgttcgggcgcgtgatgtcacgagtcttgtgcacgaaggcgagcgggccgccgccgaggcgttgcgcccactgctcggccacgcggatgcggccggcatccggggagacgaccgcgacgttgcccagctcgttggagaaccgatcgcggatatagtccaccagcaccggcatagcgatcaggtggtcgaccgggccgtcgaagaagccctgggactgcgcggcgtgcaggtcgacgctcatgatgcggtcggcaccggcggtcttgagcaggtcgaagatcagacggcaggagatgggctcgcgtccgcgatgcttcttgtcctgacgggagtagcccagcagcgggcataccgcggtgatggaacgcgcggaggcacgcttcaacgcatcgatcatgatgagctgttccattatcgacttgttgaccagatccgcgtgggtctgcagcacgaacacgtccgcgccgcgcaccgattcggtgtagcgcacgtacatctcgccgttggcgaaatcgtatgcggtggtctccagtatgtcgatgccaagctgttcggcgacgtccgaggcaagcttcggatgcgtacggccggtcacgaggatgaggtttttatcgggctttccttcgaggattgcactcaccatgtctccaaacgtttgtgtttcgctgaagtggacaatgtcatagtaaccgtgcacaccgaccgcatgtcacatgcaggccagccccggttcatgttccgttagcgttcccggcacgactcgccggcgtgtcccggtcagccggaacgcctgcggtacaggccgtgcttgccgatgtactgcacgacgccgtcagggacgaggtaccataccggctcgccgtgcgtcgcgcgccggcgcacatcggtggaggatatggccagcgccgggatctccagcgtgtccaccttgccgtcgggcagccgcaccccctgtggcgacgagtagccgggccgtgtgaccgctacgaaatgcgccagatcccacatctggtcggcgtccttccactccatgatctccgccaccgcgtcggcgccggtgatgaagaacagctcggcgccgggatgctgcgagcgcaggtcgcgcagcgtatcgatggtgtaggtgacgcccggccggtcgatgtcgacgcgggacacggtgaatttcgggttcgacgcggtggcgatcaccgtcatcagataacggtcctcggcattggtgacctgcttgtcgagcttgaagaccggccggccggtcggcacgaaaatcacctcgtcgaggtcatacacccaggccacctccgaggcggcgaccaggtggccgttgtggatcgggtcgaaggttccgcccatgatgccgacgcgcgggcgcatgtgccagttgccgcgcgtggagaaccgcttggctccgtccggtttttcggatgacaggtccgacatgcggcgctccggctcgacgagatattggatttcgggcgaggggtcggcttctgcggccaatgggcttgcctcctgcggcggccttcgcgtcgtcatgcctccgagacctccggctggctgtccgcctcgtccgtctcgcgcttgccctggtccgcggtggtgttggcctcctgcgggtcgatcttgcccatgtcctcgtcccattcgtcctgcacgacgcggcggatctcggcgaacgtgggcagggggaagccaggctggtacaacctgcgcacttcggcgacgcgctcggtgatacggatcagcgtgtcggtcatgccgtcgacgtcgcccttgcgttccatggcgctgaagcgacggatgtactgctccatcatgctcatctgttcgcgcaccgtcttcagcttcgccgcgtccagttccacgacttccggggagtcggtctccggccagccgatgagcacggcgtcggcatattccagcgatgcccgctggctggccgaggcgatgccatcctcgatctgcaccaggaacacgtagcggacgatgctgagccgttccgcggcaatcttcaggcccaatgtctggtcgttgagatcgatatcgtcccggatggtggaaatcaccgttcgttcctcgctcatactcgcacctgccccgttccgtagccgatccatttcgtggtggtcatctctttgagtcccatcgggccgcgggcgtgcatcttctgcgtggagatgccgagctccgcgccgaagccgaacacccctccgtcggtgaaacgggtggaggcgttgaccatgacgacggccgagtcgatgcgcttggcgaacgtttctatcgcggagtagtcctcggagatgatcgattcggtgtggccggtggaatgcatgttgatgctgtcgatggcctcgtcgagcgaatcgacgatcttgacccccatggtgagcgccagatattcggtgtcccaatcctggtccgtggcgtgcttcatggcgaggcttgggatgccggccgcctcgatgatggcgaacgcccgctcgtcggcgtgcagctcgacacccttgtcggcgagcgccttcgccgcggccggcaggaaccgttcggccacgtcgcggtggaccagcagcttttcggcggcgttgcatacgccgacgcgctgcgtcttcgcgttgatgatgatggggatcgccttgtcgaggtcgccgctgcggtcgacatagatatggacgttgccggctccggtctcgatgaccggcactttggaattgcgtacgacggcctggatgagtccggctccgccgcgcgggatcagcacgtcgatgtggccgcgggcctccatcatcgccgtggcgccctcgcgtccgtattcgtcgacggtgttgatcagcgccgggtcgaatccgttcgcggcgagcgcgtcgtggatcaccgccagtgtcgccgcgttcgtgcgctctgcgtcgtgccctccgcgcagtatggcggcgttgccggatttgaggcacaggctggccacatccacggtcacgttcggccgggcttcgtagatcatgccgataacgccgatgggcacgtgcacctgattgagccgcagcccgttctccagcgtgtatccgcgctcgatctcgccgaccggatcgggcagcgaggccacgtggcgaacgccttcggcgctggcggcgatttgccgtatcgaggtcgtacgcgctggggcgcgagtccggcgaacgcgacacgctggcgggacaggggagcgattccggctcgctgttcggcaccgacgtgccggtgcgcgaggcggaacaggggctcatcgacgtcatgccgtccgaggtgatcgtctgcgacggcaacggttccgtgcggtgctccagcaaaagccaggtgaacgtcgatgtcatcgagaacggctggatcgtcaaggacgagatcctcgacatcctgcacgtcgtggtggagaacgggggcgtgcgggaacgcgagatgtgcgtctcgctcgacctgacccgcatgtcgagcgcgatttccggacgaggtgtcaccgccggcagctccgcgccctccgacagctacctgcgcgtacgcgtcggccatatctgcgacggtctgtacgcggtgttcatcaacgacgtgaccgagcagcgtcggttcgagcggatgcgccgcgacttcgtcaccaatgtctcccacgagctgaagacccccgcaggcgcgatctcgctgctcgccgaaaccgtctccgacgcggcggatgaccctggcgccgtgcggtatttcgccggccgcatcaccaaggagtccgcgcggctgaccgaactggtgacccacctgatcgaactgcagcgcgcgcaggacgcgccggcgatgctcaaggcgcagcgcatatccgccatgtcggtggtgcgcgcggccgtcggcgagaacctggtgcaggccggtgcgaagcacatcgccatacggctgtcgctgcgcggcgagcaggcgccggtcgacgctgacgccgccgcggacgacgaggcgcagcgcgacatcgccatcatggtcgaccgggagaccctcaccatggccgtgaagaacctcgtcgaaaacgccatccgctactcgcccgaatacacgacggtcagcgtgagcgtctcgctgtgcaaggacccaagctccatgacgattcgcgtgatcgaccagggcatcggcatcccctcggcgtcgctggaccgcgtattcgaacggttctaccgggtcgatccggcgcggtcgcgggccacgggcggctcggggcttggcctggccatcaccaagcattgcgtgcaggagtgcggcggtacgatctccgtatggtcgcgcgagggcgaaggctccacgttcaccatcgagctgccggtcgcccccgaaccggatgacgatgacggcgagcgggcggatgacggcgaagcgcccggcgagaccgtcggcgcgccgggaggcggcgacgccgcgacgcaggagtagacccgccgccacggtctccccggcgcgtcggccacccatcgtgaaacccgcggaaaagcaacgtagtcttcggagccgaatgcgggcggtgccggaacacgctacgatggtgacggtacggacattgaacacagtatgtgtgaaaggtaaacatgacacgcattctcatcgtggaagacgaggaatcatatcgtgagcccttggtgtaccagctgacgcgcgagggctacgacgtctccgccgcagccagcggtgaggagggcctggagctgttcaccaagggcggcatcgacctggtgctgctcgacctgatgctgccgggcatcgacggcacggccctgtgccggcgcatccgcgagcagagccgcgtgccgatcatcatgctcaccgccaaaagcgccgagatcgacaaagtcgtcggtctggagatcggcgcggacgattacgtgaccaagccctactcgttccgcgagctgctcgcgcgcatccgcgcggtcctgcggcgcaatcagggcgcggtcgaggccagcggtgtggtcgacgacgacatcccgctggtgtgcggcgacatctccatgcaggttggccagcatcaggtcaccgtgcgcggcgaaagcgtgttcttcccgctcaaggaattcgaactgctcgaatacctcatgcagaacaaggggcgcgtgatgacccgacaccagctcatcgaccgcatctggggctccgattacgtcggcgacacgaagaccctcgacgtgcacgtcaagcgcgtgcgctccaagatcgaggaggatccggcccatccccagtacctgaccaccgtgcgcggcctcggctacaagatcgacagcccgcagcagtgaccggcccgcacccggtataaagcgccctcggcccgcctgaaccacccggtgcaggcgggccgaaccatatcccgcaaaccgcgcattccaactacgtggcaaggtcggcaactattcatcttctgtttaccgattttgtcttccgacccctcgaacagcccataggctagtaactgtcatgaaaaggaatcggctctgaatcgtatgacacgagccgctatgacagttgataagaggaaagaaacaatgcgtaagaatctcttcgttcgttccatcgcggcggtttccggcatcgtgatgctggcgtcgctcgccgcctgtggcgacaacacttcgtccgccggcaacaactccggttccacctcgaccgagaagattaccggcagcttctccggcgctggtgccacctcccagcaggcggccgaggaagcctggatctccgcctacatggcggcgaactccggcgcgaacgtcacctacaacccgaccggttccggcgcgggcgtcaccaccttcctgagcggcgccaccgcgtgggccggctccgacaaggccctctccgatgacgaggtcacccagtcctccgacaaggcgtgcgccaacggcaccaccgcgttcgacgtgccggtctacatctccccgatcgccatcatcttcaacttgaagggcgtttccgacgccggcaagcacatcaacctcgatgcctcacaccgttgacctgaccgtcatagatgaaggtgcggaatgcttcgagcacgcccacgttgccgaccttgagcagtttgagcaacaggttggtattctgcttatcgccggcctcgccgccgccgacggaagcgacgctggatatatcagcaaggccaaagaagccaccggcgtattgcccgccttcaatagcgcgcagcccgttaacagtaagagaagccgggtcattgttcggatccgcttcactgccggtgcctttggcggaatccttgtcaccgaggatcgcggcctgcaacgaaccagcgaaaccgccggcgttcagggcatacttggttgtggtattacccttatcgtccctgctctcatatgcgccattgaccgtgtatccccatgccgggtcatccgagctcacatgtgcaccgcgaatcgtcgtaaccgtggcctgcaatacgctgaccagacttgccgggttcgataccagcgagtcgaggattccttgcaggaatccctcggacgcattggtgtccacatccgcaaccgcaccggcagtggccacgccgataaatccgccgacattgttgcgcccttccaccttgcgcaggttggaaacattggcaccggcagcggtgacacccttgacaagcttctggccgtcctggtcgagatcgccccagatctggccaccgaccgcgagaccgacatagcctccggcattaccggtaccgtgcgtgatgtcttcaccggtggccacgaccttcatacccttgcggtagccggccacgctcgaagatttgacgacgggcacaaatacctgtgccacgtcgagcatctgtcccaaatcaagtttgatgcctttgtcgccgaatagttggatagagccgaacgaggatgccgagccggattccatcgtgcccgcataaccgcctgccgcacgcatggcagagacggtcttgacatccatcgactggccatcggtgatcgtgccggtgcgcatcagaccgacgtgtccgccggcgacgccggaatcatgcaagttcgcgccagtcttatactccgcacgaccggcgacgacgttgaatccgaagatgtaggattcgaggaacttgtccagggaatcctgatcggtaacagagcccgcaccatcgcccgtagctacctcggtaaattccttgccatacgcaccgtacttgccgatgttgtcgacccacgtcttccattggtcgtagctcatattgcgcaaaggaccagtgaccttcgagtgctcctcggtcgggtagaccacagacagcacgccggcgagattgccggccttgatgagaccgccaagcaaggagagcgaaccgccttgagcggtatcggccgcctccatgaagccggtgtaaccgccggcgatttcggcaccgtatacgctgcggatgcgcgcggcgtaggctacgcgcttcggcccgttgtatttgccgccggtattctcctgcttccacgctgctgtgttgttgccccagatatgaccgccacgattacgacctgcatagccgccggccatgccgcggcgtgtggtcgtatccgatgccgcctgggcacgcaccgcgccgccgcacactgcggcatcggtcgagctgttgcgaatcgtcggtgtgaagtcctgcacgagcgagagcaggttgtcgaggttggcaagcttcttgagcacgctgccgtcaccaagcacgttcgccacggctcccggctgcatggtgcccacgtaaccgccggccgaaacctggccgatgatgtatacgaactcatgagagctcgagtcctgaatgtggccgccttcgatgtctccggcgaaaccaccagccatacccagtggatcgggctcattgttggcattcctatgatctgcggcgctggccagaacggagtatccgccgatgccgccagtcacatcggagtgttcaatcgtcgagacgacgacatccagcacactgagtacatcgttgagattgactttctggccgagcaggctcaggccaccgcccacggccgccgccgagccgatgtccattttgccgatgtagccgccggcataccgagcggcggtgactgcatacgagctgtctttgctcagataggtgtcgtcgatggatccggtggtttccagattcttcggtgccttgacgtcggtgtggcgcagttgggtcacgctggaatgggatacctgcacgccggaaccgtagccgatgtagccgccggcggaaccggattgcgtatcggattggtcaagtcgggtggcggagacggtgaagccgggatcgtccgggtcggaaatcccgttaccgctagttgcctccacggtggtggcatcggaatgcacacccgcgtaggagatgaatggcacatagccctgcaccacctgcagcaggttggcgagatccaccgtaccgaatttgccgagcaaactcaggccgccgttgccagccgaagcgagcgcaccggagacaaccttgccgccgaaaccacctgcgtatgcgccgccggtcacatggtcaaggttgacaacggccacggggttggtttgcacgcgggactgtacaccggccagcgttgagtcgttcttgagagcggtttcggagaactggttgaccttgccgctttggaagtttcccgcatagccgcccgcgatatcgccttcgacataaccgccgttgacgtatgtcacggtggtatccgtataacttggaatcagatacggtacggcaccgagcaggtcgttcacggacagcaggccgcctttgatcaggccatccaatacgctggaatcttctgcgttgctgagcgcgtcgtgctggaaagcgtcatctccggactgatcgaaccccggcaggacgcccccgaaagctataagccaacgctgatttcgaaccgcccaggcgacctcaccatgcatgatggaatcagcgatgcgctcacgaacagcgattccttcgacatctccgtcgccttcgtctctcctgatgccatactcagtttgttcgaggacttccgcagtcatcatgccaatgcgcccgagcaggtcagcagactgatcacgtcgacgaagaatcatttcaacgacccacgcgctttctgggaactgcttcacctacagcggacggcaggcgtggacgtccgcgtgtgggcaggctccgactcttcagtatcagtcgctcaagggcagccgttccatcccaaaggatacgtattctcgcgccgcatgcgcaacggcaccccgtactacgacctgttcgtcggcagttcgaatcttaccggcgccgcattgaacactcaacgcgaatggaatctcaaggtctcatccctcgccaatggcgaactggtcgcgcaggtgcgagatgaaatcgactcacagatcgccgattccaagccgctcaccgaggaatggatcaaacagtatgaggaggatttcaagaagtacgcgccgccacggcgcgacattctgaagtccctcgaaggccgtgagatccagccgaacgccatgcagaaagaagccctcgcgagcctgaagaaactacgcgagaaaggggagcatcgtgcgatcatcgtgtcggccacgggaacaggcaaaacctatctttccgcgttcgacgtgcgtgagtaccggccccggcgcatgctgtacatcgcccagcagcaaatgatcctcaaagcggcgatgaaatcctaccagaaggtgctcggttgtccgcaatccgagctgggactgtataccggcaccagcaaacaacaggatcggcgctacgtgttcgccacggtgcagaccatgcgtcagccggaggccctggcgcaattcgcctctgacgagttcgactacgttcttgtcgacgaagttcatcatgcgggcgccgaagggtatcagcgcgtcatcgaccatttcagggacgccgacttcatgctgggcatgaccgccacaccggaacgcaccgatggcatcaacatcttcgagttgttcggccacaacatcgcctatgagatccggctacagaaggctctggacgaaaacatgctctgcccgttccattattacggcgtcgcagaatatctcggttccgacgaggacccggaccaggacatgcaccgcctcgatgtttcacaggggctcgacgcgaaggagtcgaaacagctcaaatacgagatcgggcagctcgccaccgagcagcgcgtgcgctatatcatcgacaagctgcaggaatacgggcaattcgggatccccgtcaccgggctggtgttctgcagcaggcaggaggaggcgcacgagctgtcccgcttgttcaacgagcattggaaccagcaagcggaacgcccctatcgcacggcagcggtgaccagcaaagacgtcaacggcaagccgttatcgcaggaaaaacgcgacgaatacgtccggcagctcaccgacggcgaactcgactacctgttcaccgtcgacatgttcaacgaaggcgtcgatatccccgccgtcaaccagatcgtgatgctgcgcagcacagagtccagcatcatattcacccagcagcttggccgcggactgcgcaagttcccgtacaaggacagcgtcgtggtcatcgattttatcggcaactacaacaacaactacctgatccccgtggccctgtacggcaacaccggtgaccgcgaccgcgcgcgcaagaacctgcagcgcaaatcgatcgggttgtcctccataagcttcgacccgatcgccaaggaacgcgtgctgaaatcactggacaccgccaactggtccgaaatgaagaagctatcggaacaataccggcaggtgcgatacgagctcggccgcattccgatgctcatggatatctacgcctacgatccttccttgccgtatacattggccacgaagcgcagcaggccggtgccgatcagcacgggcacgccgatgttcgggtcggcttccgggtattgcgccgcgatgttcgccgcgatggtctggttctgggatgcccgcagcagcttgatcgagtacgttaggccgggggaaagaatcatgaggacggccatggtctcgccgagtgcgcggcccaggccgagcatggatgcggagacgatgccggacttgccgaacggcagcacggccagcttgatcatctcccacttggtggcgcccaggccgatggccgcctcctcctgcagacgcggggtctgcatgaagatgtcgcgcgacaccgaggtgatgatcggcaggatcatgacggccagcacgacggcgaccgtggcgacggttcgcgaggggctgtcggcgaccgacgggtcattgagcgatccatcgaagatgtaggtccacctcaggtacttcgcgaaccagttccacaccggctggatggccggcaccagaatcaggccgccccacaggccgtagatgacggacgggatggcggcgagcaggtcgaccacgtagctcagcgcggtcgccagcttcttgggtgcgtaatgcgagatgaacagggcgatgccgatcgagatgaaaaacgcgatgatcagcgacagcgcggagacaagcactgtgccgaacaccagcgggcccacgtactgccagaagttgtgcgcgcggttgccggtgaatgattcgatggtggcggtgttcgcggcctgatcgcctccgatcagcggccacgcctgaaacagcaggaacaggaacaccgccgcaagcgcgacgagaatgagaatgccggcagcataggcgatcgtcttgaacacgacatcgccggtcttgcctgtactggccggactgtctgccgctttgtcttgcgaactcacaggttctccttcgtatgcattttcaatggtggcttcacggccgtgtacaaccgacagaagccgcagacacctttcattgtgtcaggtgttctgcggcatccgccatacggcgtgtcagctcacgctgatcacttggtcttgatggcctcgatggacttggtgaccttctcgacgatgttgctcggcagcggggcggagccggcagcggaggaggcggtcttctggccttcgtcgctggtcacgtaggtgagccagctcttgacgaacttggcggtgttggcgtccttgtaggcggggcaagcgatgtcgtaggagaccagcacgatcgggtaggcgcccttggctttggtggcgtggttgatcttcacgaccacgcggttgtcgcccttggcggatgtgtcgatctcggaatcctcgatgaccttggaaccggcgtcagcggagatctcgttgtagttctcgccgaccttgatggccgcggtgcccaggtcgccgacctgggagaagtcggcgtagccgatggtgccgtcggcctgcttgacggcggtgacgacgcccgaggtgcccttggcgctctgctggccggggatgtcaggccagttctcggagagctcatgggtccaggagtcgggggcctggtccttgaagtagctcacgaagttctgcgtggtgccggacttgtcggagcggtgcacgacggtgatctgggtgtcgggcaaggtcaggtccttgttctggttggcgatggccggatcgttccacttgacgatcttgccgtcgaagatcttggcggcggtgtcggcatcgaggttgatgtgcttgccggcgtcggaaacgcccttcaagttgaagatgatggcgatcggggagatgtagacttaaagaactcaacgccctgcatacgaaaagacagaatctcttccaagagcttgatgcggttatccatctgcttatggaagccaagcattggggattgagaaagagtagaaatgccacaagcctcaatagcaggtttaagagcctcgatacgctcaaagtcaaaataatcagcgtgacattcagaagggtaataagaacgaaccataaaaaagcctccaagatttggaggcatgaaaacatacaattgggagggtgtcaatcctgacggttatttcctagacaaattagagccaataccatcagctttaccgtctttccagaaattgttccaagtatcggcaacagctttatcaataccatgaaaaatatcaaccacaccagaagcagcatcagtgacgacattagaaatatcctttgcagtagcgccaatatgagaagagccataccgctgattctgcgtttgctgatgaactaagtcaacctcagcactaaccttgcgagtcatttctttgatttggtcattggtaaaatactgaccagccgtttgagcttgagtaagcatttggcgcataatctcggaaacctgctgttgcttggaaagattggtgttttccataatagacgcaacgcgagcagtagactccttctgttgataagcaagcatctcattttgtgcatatacctggtctttcgtattctggcgtgaagtcgccgactgaatgccagcaatctctttttgagtctcattttgcatctcggcaatctctttctgattgtccagttgcattttagtaagctctttttgattctcaaatccggcgtcaaccataccagcagaggaagcatcagcaccagcacgctcccaagcattaagctcaggaaatgcagcagcaagataatcacgagtatcctttcctttatcagcggcagacttgccaccaagtccaaccaaatcaagcaacttatcagaaacggcagaagtgccagcctgcaacgtaccttcaagaagtcctttaccagctttagccatagcaccagaaacaaaactagggacggcctcatcagggttaggaacattagagccttgaatggcagatttaataccagcatcacccatgcctacagtattgttatcggtagcaagcacatcaccttgaatgccaccggaggcggctttttgaccgcctccaaacaatttagacatggcgccaccagcaagagcagaagcaataccgccagcaatagcaccaaacataaatcacctcacttaagtggctggagacaaataatctctttaataacctgattcagcgaaaccaatccgcggcatttagtagcggtaaagttagaccaaaccatgaaaccaacataaacattattgcccggcgtacggggaaggacgtcaatagtcacacagtccttgacggtataataaccaccatcatggcgaccatccaaaggataaacatcataggcagtcgggagggtagtcggaaccgaagaagactcaaagcgaaccaaacaggcaaaaaatttagggtcggcatcaaaagcaatatcagcaccaacagaaacaacctgattagcggcgttgacagatgtatccatctgaatgcaatgaagaaaggcgatggtactgcacccgacagggtgtgggagagtagcacgccgccgcaccacacgacaaggacccccggacgaggcaaacaacccccgggggtccacccatacccaaacacaacaaccaacaggcatgaggtcaatgcacctcatccgcttcacaggggctaccgtcagcgaggacggaagccgatggagtcgtactgtactcaatgtaatggctgcaacgcataagccaaagagaacataatgtccgttatcggcattatgcatcatcgtccatgtatttcactgcgcgtatcgtcactgcgcgtatcgtcgtccaatcgctgtcgcctgtatccaggcgcgaccggatcggatgctctcatgcacggaacggattatccgaatacctcacaggcggcgaccagccgcagtgtttccatgtcgatgagatcacgtccgtaggcatccagaaggcggtcgccatatgcatcggtatgcaaattgaaccatagcgtccacaaagcccagtacacatccacatgtctgtcgccgactccggcgcaatccaaatcaacgaaaccactgaaccgccaatcgtcaagtatgacattcggcaggcaataatcaccatgcagcaacgtatcgtgacgcaattcgtcgccatgctgccgcaccaggcgatatatcgattcggtgtcggcgttcccgtagacctgcgtgaagaaggaacggtccgcacatccctgtgcatgattccgcttcactgtcgccagatagtctttcgtacggttcgacacagggcatccggttggatcctgctcatgcagcatacgcaaccgtcgtcccaggacggcggacaaacgttcgggctccctcacgtaaagagacgcggtgcagtcgtcacctggcagacatgccgtcgccaaccagtcattgccgtcatggtcctgaccataatgcagcaccgcggcggacagtcctttgtcatgaaaataccgtgtcattgccgcctcgttccgcagtgcgccgtgacgggccttcttgatatagcacccctggccgatgtcggaataatatacggttgcttcggcggacgagctgctgtcgaatacatgcccagggcgtagatacctgcgcagcggttcgggaaattccgccatgtcgccgtcccacggaatgtgctgcatttcatcctcccggtgtcattgcaacctcagtgccattgcacatagtgtcgtcgcggcgcggtgccgcgtcatgtcgttatctcgacggtatcgcatcatcgtgtcgaactggtgagccgccgcatgcccttcccggtatcctgcggtcgccgggaaggcgttacgtcttccgatttgtcgtggatggcttcgataggtgccgtgaatcgctgccggacctcggtgaacatggtctgaatagtttgcgacacgcccgagaacaatgaaatatgagttttttccgccctgccaggaggggtgttctggtcatagggtgtgtttgaaggccattttcgacacgccgatggaatgttgttgtttcaacggttttgggtgtcttggggcatgtcgatttgcgttggtcggccaactcgtgtaagttatctactcgctgccggttagcgatcgccgacgcgccgaagctcgcccgcccgctgatgctgattcacggcttcgccgacgacaacgtgaccatcgcgcacagcctgcgcctcagtcaggcgctgatggccgccggccgtccgcacaccttcctgccgctgaccggaatcacgcatatgaccaatgacccggtcgtcgcggagaacctgctgacgctgcagcgcgacttcctgcgcgatgccctcgatctgtgaccggtcgcccgtttcggggcggaatggaacggcattccgccccgaaacgcggcaaatgcgacatcggcggcgcttgtgcacagtatgtccgatatcgcgttcgacatatgggcggttcgtgtccacatatgacctcggtggtgcgctgtgggcgaatccagctcttacggctggggatatactctcactgagcatgatcgggcggaagatacgaaacgaggggtttggtgcgtacgatttggcgaatattcacgcgcgacctcatgcgcatcctgcgcaacccggtcgcggtggtggtgacgctgggcgtggccatcatcccctctctgtatgcatggttcaacatcctcgccaactgggacccgtattcgtcgaccggcaacctccaggtcgccgtcgccaatgaagacaagggcactacatcagatctggtcgggcggctcgacgcgggcaagcaggtcgtcagccagctcaagaagaacgaccggctcggctggacgttcgtcagcgccgacaaggccgtggaaggcgtgcagtccggcgaatactacgcggcgatcgtactgccgaaggacttcagcgaaagcctgatcaattcgatcaccggctcttccgacaagccgaacatcatctactacgtcaacgagaaaaagaacgccatcgcgccgaaaatcaccgatacgggcgccacgaccatcgactcccagatcaatgcgacattcgtctccaccgtcagcaagacactcgcccaaacgatgacgaaggagggcggcaagctcagccagtccgccgacggcacgcgcaccagcgtcgtcaacgacctcaacggcctcatcgagcagctgaacgacatcgactcatcgctcgggcgcatgggcggcacgttcgacgatgcggaaaagggcatcaaacaggccaagtccaccgtcgcctcgctgaaacgtcagatctcatccgcgcagaaagccgcgaaacagtcacagagactgctcacgcaggtgcagggcagcgcccaatcgttctcgtcgtcgcttgcgggcgcgttcgataacggatccgtgcagctgtccggcatcggcgtcagcgtgaacaacgcggcgggagacgcgctcagcgccttcaacaccgcacaaggcagcatcgacgacatcaccaatgctctgcagaagccgatcgacggcgcggctacgctgtccagcgacctcaaggacgcgatgaacaaggccggcatcggccgcgacaccgccatcggcaagcagatttggcagcagatagacgcgctcgacaagaccgtgaacacccagcagggcgatggtactgcacccgacagggtgtgggagagtagcacgccgccgcaccacacgacaaggacccccggacgaggcaaacaacccccgggggtccacccatacccaaacacaacaaccaacagccgttgcaacagaagaattcctgtcctagactgtggtgttgctatgcattatttcactccgaaacgctgttccacctcgaacaagatcatgtaccatgacaaggcccaggcgcagcatgccgccgaccagagccttatcgaacgcggagcggagctgtgggtgtatcggtgcgaatactgcggcacctggcatctgacgcatcgtgatcccgctcatgagcacacgtatgtccccctgaaccagcagataaaaccgcacagccgcaagaagggctacaagccgcggtggcgttgatgctcttctcccgtcattcgctgaataggcgaatccgcgagggccgaacaacacgagtcagataacacaatgggcggtggccggaacccgatatcaggttccgaccaccgcccattatcgtttgggggtcatttaccggtcgagacggaatccctgcgatgtggcgttcggtatcacctgatgcgcggcgtccatgcgctgggctgcaatcgaggcgatctgatcgctgaatgcgtcaacgggacgatcggtgttgcgcagatcgtagtactcatgcactgaaacgtcaaaggcgccgatacgctccttgatggattcaatggcgtcatcatccgacggatacacgtcatcgaagaactgcagctcgcgaggcatgcgaggcttgagcgcgggagcctgatcgggcttgccgatcgccaatcccagcacaggatacgtgtactggggcaggtgcagcgcttcgatcagaccgggaacatcattgagcagggaaccgaggatgacgcatcccaggccgagcgaataggcggcggtctccatcgcatgcaaagccagaaccgcatcgttctgggcctgagagaaccggtagctaccggcgagaccgtaggtgtccgaatccgtggacacgcccttcgactcggcgataatcgcattgcggtgctcgtccgcgacgaacacatacagcagcggtgcttcggcgatatacggctgcctgccgatctcggacatgcgcttcttaagcgccggatccttgacacggacagccgaccagtcgttcagatactggctggaagcggcgtgctgggccacggtctccagtgtggcgacggtatcatcgtcgaagggctcggcaacgaatttgcggatggacctgcgattgagcagcgtctcgatagtgctgttggtaaccatgctgtcattgtcgcaaagagacgccccaagagccacccatttgcgctgacggggaacacgtcggtaatgctggcgccccaaaacgtctttaagtgcgcgccgaaacgacgaccggggggtgcggatgtttttttggacggttagacggccagtccaaggtgtttgcggtattgcacggggctcagccagccctgcgccgatcctccatcgaaaacatgcgaactccaatccggacaccaaagcgtccaacttttcatccgcaccccctaacgcccgaattcttgcgcactttcggattccggccctgacgtaagagggcatggcccgcgtcctgtgtacgattttcattcgccaaaacaaaaaaccgcgattggaagccaggagacggaaccatgcccgagaacatcatacagatcgaccagaacctgctcgagaccaggctcgaccggctgatcaccgagaagatgacgcagatcctcaacgcgatgctcgacgccgaggccgacgagatcaccggggccgccagatacgagcgcagcggggggcggaaggcgtacagggccggccactacgaacgcaagctcaccgccaaggccggcaggctcgagctgaaggtgccgaaactcaagggcgccctgttcgagtccgcggtgatcgaacgctaccggcggcgcgagcagagcgtcgaggaatccctgatcgacatgtacctggcgggcgtgagcacccgccaggtcgacgacatcagccaattgctgtggggagaccgcatgccctcgcagacattgagcgacaagctcaaaaggatctacggggagatcgaccagtggcgcacgaggccgttggaatccgaatacccgtacgtgttcgtggacggcgtgtggcacaagcgctcatggggcgggcacgtggagaacgtgagcgtcctggtcgccatcggaatcaacgcggaggggcatcgcgaggtcatcggcgtcacggagggcatgagggaggactcggccagctgggagcagttcttcagaggcatgatcgaacgcggcctgaagggcgtcaggctcgtggtcggcgaccggtgcgccggactggtggccacggtcggctcgatgctgcccaaggcgaagtaccaacgctgcatggtgcatttcatgcgcaacgtgctctccaaggtcccgccgatccacagagaatgggcgtccgccgccctgaaggcggtattcgccatggaaagccgggaatccgcgctggacaaagccgaacaagtcgccgcggagatgaggtctaggaggctgagggccgccgccaactgcctgcgggagggcgtcggcgagacgacgacctacctgctggacgagttcccggacgggcaccgcaggcgcatccgcacgaacaacatgatcgagcggttgaacagggagatccgccggcgcacgcgcgtcgtgggcggcttccccgacgggaacagcgcgctcatgctcgtctgcgcgcgcatccggtacgtcaccgcgaacgaatggtcgacccgccgctacctcgacatgtcccggttcgatgacaacctcgtggaagcgaactgatcatcgctccatggacggccatgatccaaagtgcgcaacttttcgggcactagggggtgcggatgaaaagttggacgctttggtgtccggattggagttcgcatgttttcgatggaggatcggcgcaggcttctcagagccaccatgagaagccccctgaggtcacctgcacaagtcgagggaacccagggtttcctgcctcaacccgggaaagacctcgagagaccttcttcaacacgtctcgaggccagattcccctaccatggctcgggagcaatgacgcgctccccctcgccactcgcatggagacccgacttccctggcgccccacgagaggctcactgacctcgccgtcgtacctcgtgagaaaccgcacactggggccgccgctcgagaacaaccccgagactcccccgtcatcgagagatgagggccttcgtctcctgcatggcctagagaccaatctcgcggcctctctccaaacgcctcaggaggcttgactcccttgagtccacccagtgagctccaagagatacccgtcgcgactcgagagcagagcggggttcttggcttccactcgagatgaatgcctgtctccccgggtgcgtctggaatgcaaccccgagatccctgtcgcccctggagaggaacattggcttctggacacaagcctagatgaggtctattggccctgcagtcactcgagagcaatccccagctttccttcgcaactcgaatggaagattggacttgcctgggccaacacaagaggcagcctgaattccccgtcgtaactcgagaatcccgccgtaactcgagaaaaaccacgtggctcccccgtcatcgcaagatgaagccctttcccgctacagcgcctcaggagaagtcccacgttaggaattggaggtcgaaagggcacttggcacccttgatgcgacccacaaagttccccgaaatcccggtctccctcgagaggaacaccgaggttttccggcaccccctcctctgagccctttctcccctcctgatctggacaggagggtcgactcccctgctttgtctggaaggggttcccgaccttccggtcgcacctcaggatgaggccggtctcacgaagacattccagacgtggcctcgtgggtggttccacattccgaaggaccccgatttcccggtcccctcttgataagaacccgatgcccggacacctctccgaactccaccctgtgaatgaagtcaacacgaaggggcagtttttccgtgcatcgttcggaaaaaaccccaggttccaaatacagctcgacaagcggcctctctccccggggacatctcgagaggcaagcggagttccatgcctcaacccaagacgaggcctgactctcctgtccccagtctgcagggaccctgcgatcggagtctgaaatcagaggtaccctgcggttcctgcctcaactggagatgaggccctcttccaatgcaccaagcccagtggagtcccgagaggcccctcccacctccagtttccctgacttctcagagccaccatgagaagccccctgaggtcacctgcacaagtcgagggaacccagggtttcctgcctcaacctttttttttcaagcagaagacggcatacgagatttcgcggagtgactggagttcagacgtgtgctcttccgatctacttttattttcttttgccctctctgtcgctctgccttaactacgtatttcttgccgagaaaaacttcaatttaagctattctccaaaaatcttagcgtatatttttttcttttttttttccaaagtgacaggtgccccgggtaacccagttcctcacttttttttactgcggaagcggaagcggaagcggaagcggaagcggaagcggaaaatacggaagcggaaaatacggaaacgcgcgggaacatacaaaatatacctttctcacacaagaaatatatgctacttgcaaaatatcataccaaaaaacttttcacaaccgaaaccaaaaccaacggatatcatacattacactaccaccattcaaactttactactatcctcccttcagtttccctttttctgcctttttcggtgacggaaatacgcttcagagaccctaaagggaaatccatgccataacaggaaagtaacatcccaatgcggactataccaccccaccacactcctaccaataatggtaactattctatgttttcttactcctatgtctattcatctttcatctaactacctaatactatgcaaaaatgtaaaattatcacacaaaacataaacaatcaaaatcagccatttccgcaccttttcctctgtccactttcaaccgtccctccaaatgtaaaatggcctatcggaatacatttcctacatcctaactactataaaacaacctttagacttacgtttgctactctcatggtctcaatactgccgccgaaattctgtcccacatactaaatctcttcccgtcattatcgcccgcatccggtgccgtaaatgcaaaacaaataccatctatgtcttccacaccatcattttactatgcctgccaccatccatttgtcttttgcaccatatcttcataacctgtcaccttgaaactacctctgcatgccacctaccgaccaactttcatgttctgtttcgacctacctcttgtaaatgacaaatcacctttttcatcgtatgcaccttattctccacatcacaatgcactattgcttttgctttttcacctctcatatcctattgctattagatgaaatataataaaaattgtcctccacccataacacctctcactcccacctactgaacatgtctggaccctgccctcatatcacctgcgtttccgttaaactatcggttgcggccatatctaccagaaagcaccgtttcccgtccgatcaactgtagttaagctggtaagagcctgacagatcggaagagcacacgtctgaactccagtcactccgcgaaatctcgtatgccgtcttctgcttgaaaaaaaatttttttttcaagcagaagacggcatacgagatttcgcggagtgactggagttcagacgtgtgctcttccgatctacaatccatttttctcatgagcatttcggtagctctcttcttgtctttctcgggcaatcttcctattattatagcaatagatttgtatagttgctttctattgtctaacagcttgttattctgtagcatcaaatctatggcagcctgacttgcttcttgtgaagagagcataccatttccaatcgaatcaaacctttccttaaccatcttcgcagcaggcaaaattacctcagcactggagtcagaagatacgctggaatcttctgcgctagaatcaagaccatacggcctaccggttgtgagagattccatgggccttatgacatatcctggaaagagtagctcatcagacttacgtttactctctatatcaatatctacatcaggagcaatcatttcaataaacagccgacatacatcccagacgctataagctgtacgtgcttttaccgtcagattcttggctgtttcaatgtcgtccattttggttttcttttaccagtattgttcgtttgataatgtattcttgcttattacattataaaatctgtgcagatcacatgtcaaaacaactttttatcacaagatagtaccgcaaaacgaacctgcgggccgtctaaaaattaaggaaaagcagcaaaggtgcatttttaaaatatgaaatgaagataccgcagtaccaattattttcgcagtacaaataatgcgcggccggtgcatttttcgaaagaacgcgagacaaacaggacaattaaagttagtttttcgagttagcgtgtttgaatactgcaagatacaagataaatagagtagttgaaactagatatcaattgcacacaagatcggcgctaagcatgccacaatttgatatattatgtaaaacaccacctaaggtgcttgttcgtcagtttgtggaaaggtttgaaagaccttcaggtgagaaaatagcattatgtgctgctgaactaacctatttatgttggatgattacacataacggaacagcaatcaagagagccacattcatgagctataatactatcataagcaattcgctgagatcggaagagcacacgtctgaactccagtcactccgcgaaatctcgtatgccgtcttctgcttgaaaaaaaacgtgctcctcgcagatgcgaatccattcgtcccaccggtagtggcagccgcggtcggaatggatgatcggatgctcgtcgtccttgagcgtggcgaccgcgtcgaggagcatccggttcgccatgccggcgttcggggagagcgacagggtccaggagacgaccatcccgtcgaagcagtcgaccaccggggagagccagcacttgtacccgtccatcgtgaactgggtgacgtccgtgacccacaacaggttcggcgcgtcggcgtggaagtcccggtccacgaggttcgcgggcgcctgcgtgatctccccctcataggagctccaccgcttcggccttttcaggtacacgggccgcagaccctcctcgcgcatgatccggcgcacgaccttctccgagacgaggaccggctcgtccccgtccaggcgcagcatgcggtggatggtccggtagccccacacgcgcccgcccttctcgaacaggtccgcgacgcgggcccgcaatgcggcgtatttgtcgcccgcggcaatcgcgccgcgctcgtaataataggtgctgcgcttcagccccacggcatccagacaagctgtcaggccgaactcacccctgaccgcgtcgacgacccgcgtcctctccctgttcgtcatcatggacgggtcgaggcgcgggtcgtcggcttttaaaacattgatcgtctcccgcatcaccgcgttctccagccgcagggcctccacctgccggcgcaacccgtccacgtcatcgccggccgcgggcgtcggcccggcgggcgtcggcgcgtttcttgcgttcatcagtcccagtatcccctcgctgtggtagcggcgcatccactggtacacgctcgtcggcgtgcagcccgcgtcgcgcgccacgctggcgagggactcgccgccgagcgcgcgtctggccgcgttcgtcttgcattccagcgtatacgaacgcctgcacgcgcccgtgtagcgcgggtcctcgcggacccatttcaccagcgcgccctcggatggatagccgagctcggcgacgaccttcctgatggtcatgccctccgtgaaatacaggtcaacggccctgcgccgatcctccatcgaaaacatgcgaactccaatccggacaccaaagcgtccaacttttcatccgcaccccctctcaacgagcgtcactacggcgctctgcagggcaagaacaagaccgagattcgtcaggagtacggtgacgagaagttcatgctgtggcgtcgctcctacgcgaccccgccgcccgagatcgacccgaacgaccagtacgcgcagaaccacgacccgcgttacgccggtgacccggttccggaagccgagtgcctggccaacgtcgtcgagcgtgtcaagccctacttcgagtccgccatcgagcctgagctgcgcgccggcaagaccgtgctgatcgccgcccacggcaactcgctgcgtgccatcgtcaagatgctcgacaacctgtccgaggacgagatcgccaaggtcaacatcccgaccgccatcccgctgctctacgagctggacgagaacttcaagccggtcaagccgcgtggcgagtacctggacccggaggccgccgccgccggtgccgccgccgtcgccgctcagggccagaagtgattctctgacccggcattagcctgatgcatagggccgttccctcatgggagcggcccttttgcgtatccggccacgagccgacgtgtatgatgcaggccgaggggggcgtctcctcggtatgcgaaacgctgctcggcgtattcggcgccgtggcaccggtcgtggtcggcggcatgctgcggttcgtgccgggcgggttcacgctgatcgccgccgtggtgtgcgcactggccacggcgggcatggtcgtggccgtcttctcgccgattcgcaccattcccgcttccgctgactgggagcgcagcgaagcgtgactcgtgcggggtgccacgctgcgagggcgcgcgcggtgacgcaactcacgcacggtgacgtcgcgatggagtctatgatccgggttccaaagccgcgcaccgcccgccggggcatacaaaaacggcgagcagccgtggccgtctcgccgttcatgggactctccgtggagagaagttcagttatggcggaatgccggtgacggcatcgccgcggtcgtcgtcactcgacggcgccgtcctcgtcgcgcgacggctccttgagtcccggcacatgcggaccgaacgtcagatacatggcgaagtgtccgatggaagcgcccaatgcgttgatgatgatgaattgcaggacgagaacattagcgatggcgacgatccagggccgattattgaaggcgccgcccaatatccatggcattatgcccccggggccgaacaggatgggcagaaccgcgatcggccgccagtcgcccgccagggtgatgccgaacatgtgcagatactattcccccatcctcgcgctgtcacgggtctgtcgcattcatggcggtctgccccatgatattccccttgctgttcgtctgcgataccgaacccagcatagccggtcatgaatgagccgggcattgacggcgtgattgtggataaccggttttctatccacatgctgtccacaacacgccaaaggggtagccttcgaccacattgtccgaaaaccatgtgatgccggcgggaaatctgcgatagtgagtacaccgccgaagggggatcggcggtccaacgtcagtacagggaaggaaaggaggccgacatggccatacaacaggggacggtgaccatcaccgggttcgtcggatcgatgccggtgccgttcgggcgcagcgggggagtcgagggatgctcgttccggatgggcagcacgcggcggtaccgggacggcggaaccggcgaatggcacaacctgccgaccacatggattaccgtgaaggcgttcaggacgctcgcgtccaacgctcgcatgtcattgcacgtgggggaggcggcgatcgtgaccggcgtgctcagcacggaggaatggacgacccagaacgatgagaggcgctcccgcatcgttgtggaggccaccaatatcggccacgacatcaattacggggtgtcggaactgaagaagttccagaaatcggatcgtgacgccccggcgcaggggaacggcacgccggcgaatcccggcctgccgccatctccgggcggcggcacggcaacggcggacgcgggacagcaggcggatgcttttttttcaagcagaagacggcatacgagatttcgcggagtgactggagttcagacgtgtgctcttccgatctgaataaaagtaagattttagtttgtaatgggagggggggtttagtcatggagtacaagtgtgaggaaaagtagttgggaggtacttcatgcgaaagcagttgaagacaagttcgaaaagagtttggaaacgaattcgagtaggcttgtcgttcgttatgtttttgtaaatggcctcgtcaaacggtggagagagtcgctaggtgatcgtcagatctgcctagtctctatacagcgtgtttaattgacatgggttgatgcgtattgagagatacaatttgggaagaaattcccagagtgtgtttcttttgcgtttaacctgaacagtctcatcgtgggcatcttgcgattccattggtgagcagcgaaggatttggtggattactagctaatagcaatctatttcaaagaattcaaacttgggggaatgccttgttgaatagccggtcgcaagactgtgattcttcaagtgtaacctcctctcaaatcagcgatatcaaacgtaccattccgtgaaacaccggggtatctgtttggtggaacctgattagaggaaactcaaagagtgctatggtatggtgacggagtgcgctggtcaagagtgtaaaagctttttgaacagagagcatttccggcagcagagagacctgaaaaagcaatttttctggaatttcagctgtttccaaactcaataagtatcttctagcaagagggaatgggtgggaaaaaaaaaagagatttcggtttctttcttttttactgcttgttgcttcttcttttaagatagttatctggttgatcctgccagtagtcatatgcttgtctcaaagattaagccatgcatgtctaagtataagatcggaagagcgtcgtgtagggaaagagtgttaagattagtgtagatctcggtggtcgccgtatcattaaaa
